United States Patent 11,098,302 (IDENTIFICATION OF POLYNUCLEOTIDES ASSOCIATED WITH A SAMPLE) - sequence listing, part 73

SEQ ID NO: 250463 - DNA, 592 bp, Homo sapiens
  misc_feature: GYAE6OF02F7HAH.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattactgtgacgaagcgggaattggtggcggtgactgctattgactacgtgggaccagggaaccctggtaccaccgttctccctcgacgccctaccaccgaacgggcccacgttccggtccttcccccgtcggcccaccctcctaccaacgacgcctacccgtcgtcggggccacgacgccggtcccgtcgggctcgccgtacggtacgaacggtacctacgttccgagtacgtaacctacgtcggaggcgggtcgtcggacgtaacggcgacgagtacg

SEQ ID NO: 250464 - DNA, 624 bp, Homo sapiens
  misc_feature: GYAE6OF02HQ15I.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctagagagtcgaggacacggccatatattactgtgcgaagcgggaattgggtggcggtgacgtgcttagttgacttacgtcggggaccgaaggggtaaccccgtggtacccgacccgttcctccctcgacgccctacccgaaccgaacggggccccacgttcccggttcctttcccccgtcggaccctacccctcccgttacccaacgaccgccacccgtccggtcggggccacgacggccggcccgtgggcctcgccgtggacgaacggtaccttaccgttccgaggtacgtaccgacgtgacggccggacgtggaccgtacgggcgacgtagtacg

SEQ ID NO: 250465 - DNA, 580 bp, Homo sapiens
  misc_feature: GYAE6OF02HRZQP.16.37.D04.1.454.CMB.1.raw
  modified_base (364)..(364): a, c, t, g, unknown or other
  misc_feature (364)..(364): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtacgccaggctccgagggaaggggctagaatgggtctcaagtatcacaagcagtagtagtaccgcatggtacgcagactccgtgaagggccgtttcaccatctcagagacaattccaagaacacgctgtatttgacaaatgaacagtctgagagtcgaggacacggcatatattactgtgacgaagcgggaattgggtggcggtgactgactagttgactacgngggccaagggaccctggtcaccgtctcgcacgcctccacgaacggcccacgtcgtcctcccgtcgcctccctcctaccagacgcctacctcggacggggcaccgacggcccggtcccgtcggtccgtcgcccggtggtaccaacggtacctaccgttccggtacgtaacgtacgacgtcggtacggccggcgtcggacggtacggcgactagtacg

SEQ ID NO: 250466 - DNA, 979 bp, Homo sapiens
  misc_feature: GYAE6OF02JZLKW.16.37.D04.1.454.CMB.1.raw
tcagtgtactactccacgaccggtgctcgattagtagcatactgtgggtttgggggaggacttagtacagccgggggggtcccgtgagactctcctgtgcagcctctggattcacctttagtgcctatgccatgagctgggtccgccaggcctccgagggaaggggctagaatgggtctcaagtatcacaagcagtagtacgtaccgctagtcggtacgcaggtacctccggtagaacggggtcccttttacacccgtattccgtaccgaaggacggtaacctaactttcccgaaaaggaaccctacggtccttagtttacttttacggacctaaaagttcgaaaaccgtacggttaccgttaggaagggtacggtaccggtaacgggaaccgtacccgggtaccctaagttaacttaacgttttacccgtaggttcggaaccggtaaacgggtacggggttaacgtttagggggtcggggtaccgggtacgttaacccgttacggtaccgttttaacggttccggttaaaccggtttacccggggtacccgggggtacccggggtaaacccggggttaaccccggttttacggggttaccccgttaaccccggttttcccccgttaacccgtcccggtaacccggtcccccgtttaacccccgaacccggtaaacccgggggtcccccttaaaccgggtttccccgggtttacccccgtttcccccggttaccgggtaacccccgtaccccgttaccccgttaaacccgaacgggtaccgaccccgttaacccggttcgggtaccggggacctaccgggtaccggcccgggtcccggtaccgggaccgttaccgtcccgttaacggtaccgtaaccgggtaccttacccggttcggtaacggttaacccggtactacggtacggtaaccgggccgggttaccggtaccgggaacggaaccggaccggttacaggtacg

SEQ ID NO: 250467 - DNA, 608 bp, Homo sapiens
  misc_feature: GYAE6OF02GBRZ5.16.37.D04.1.454.CMB.1.raw
  modified_base (317)..(317): a, c, t, g, unknown or other
  misc_feature (317)..(317): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattacngtgcgaagcgggtaattggtggcggtgactgctattgaacctacgcgggccacgggaaccctggtccaaccgtctccctcgacgtccctacccaccgaacgggccctacgttccggttcccttcccccgtcggtcccacccccgttccttacccgaacgacgccctaccgtccgtcggggccacgacggcccggccgtcggcgtccgccgtcggtacgaacgaccttacgtccgacggtacgtaccgtaccgtgacggtccggacgttcggaccgtacggccgacgatacg

SEQ ID NO: 250468 - DNA, 614 bp, Homo sapiens
  misc_feature: GYAE6OF02IEFR2.16.37.D04.1.454.CMB.1.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (338)..(338): a, c, t, g, unknown or other
  misc_feature (338)..(338): n is a, c, g, or t
  modified_base (482)..(482): a, c, t, g, unknown or other
  misc_feature (482)..(482): n is a, c, g, or t
  modified_base (610)..(610): a, c, t, g, unknown or other
  misc_feature (610)..(610): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacaagcagtagtagtaccgnatggtacncagactccgtgaagggcctttcaccatctccaganacatccaagaacacgctgtatttgcaaatgaacagtctgagaggtcaggacacggcctatanattacngtgcgaagcgggaattggtggnggtagactgctattgacgttactgggggaccacgggtaacccctggtcctacccgtctcctcgacgtccctcccgaacccgacgggtccccaggttcccggttccctcccccgttacgggcccctaccccctccgtacccgaanaacgcctaccgtccgtacgggggcaccgacggacccggtcccgtcggggtctccgccgtacggtcaacgggaccttacgtaccgtaggtaactaccacgtgccggacgggtcgcgggacaacgggcgnatag

SEQ ID NO: 250469 - DNA, 564 bp, Homo sapiens
  misc_feature: GYAE6OF02IVJ91.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaaatgaacagtctgagagtcgaggacacggccatatattactgtgcgaagcgggaattggtggcggtgactgctattgactactggggccagggaaccctggtcaccggtctcctcacgcctccaccaaggcccagtccggtcttcccctggcccaccctcctccgaacgcgccacctcgtcggggcacgacgccggacccgtgggcctcgccgtcggtacgaacggtacctacgttccgacgtacgtaaccactagacggcggcgtcggccgtaaggcgacagtacg

SEQ ID NO: 250470 - DNA, 574 bp, Homo sapiens
  misc_feature: GYAE6OF02G6PA5.16.37.D04.1.454.CMB.1.raw
  modified_base (393)..(393): a, c, t, g, unknown or other
  misc_feature (393)..(393): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggtaattgggtggcggtgactgctattgactacgtgggccagggaccctggtccaccgtctcctcncgcctccaccgacgggcccacgtccggtccttcccctcggcccacccctcctccaacgacgcctacctccggtacggggccacgacggccggtacccgtcgggcgtcggcccgtggtaccgacggtaccttacgttccggagtacgtacacgtggaggcggcgtcggacgaggcgagatcg

SEQ ID NO: 250471 - DNA, 690 bp, Homo sapiens
  misc_feature: GYAE6OF02JBO64.16.37.D04.1.454.CMB.1.raw
  modified_base (338)..(338): a, c, t, g, unknown or other
  misc_feature (338)..(338): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaagggctagaatgggtctcaagtatcacaagcagtagtagtaccgcatggtacgcagactccgtgaacgggcccgtttcaccatctccagagacaattccaagaacacgctgtatttgcaaatgaacagtctgagagtcgaggacacggccatatattactgtgcgaagacgggaattggnggcgtgactgacttagttcgacttacgtggggaccacgggaaccctggtccctaacccggttctacccgttcacgtccccgtacccgaacccgaacgggtccccacgttcccggttccctttccccccgtcggtcccctaacccccgttaccgttacccaaccggtacgccctacccgtcggtaccgggggccaacggtccgaccgggtcccgtacgggggtccttacgggtcccgtacggaccggtaaccggtaccgttaccgttcccggtaggttaaccgttacccgtaacggtcggtacggtccggggacccgttcgggaccgtaacgggcccggtacgtaacggtcgg

SEQ ID NO: 250472 - DNA, 573 bp, Homo sapiens
  misc_feature: GYAE6OF02GXVQO.16.37.D04.1.454.CMB.1.raw
  modified_base (287)..(287): a, c, t, g, unknown or other
  misc_feature (287)..(287): n is a, c, g, or t
  modified_base (448)..(448): a, c, t, g, unknown or other
  misc_feature (448)..(448): n is a, c, g, or t
  modified_base (553)..(553): a, c, t, g, unknown or other
  misc_feature (553)..(553): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggtccgtttcaccatctccagagacaattccaagaacacgcttgtatttgacaaatgaacngtcgtagagagtacggaggacacggctatatattactgtgacggaagcgggtaattgggtggcggtgactgactagtgactacgtggggaccagggtaaccctggtccaccggtcctcctcgacgcctaccaccgaagggccctagtccgtccttccccgnggcccaccctccaccgaagcgcctacctcggtcgggccacgacgcccggccgtggctcgccgtggtacgacgtccttacgcgtacgtgtaccacgtgacgcggcncgggaccgaaggcgacgatg

SEQ ID NO: 250473 - DNA, 588 bp, Homo sapiens
  misc_feature: GYAE6OF02G3270.16.37.D04.1.454.CMB.1.raw
  modified_base (388)..(388): a, c, t, g, unknown or other
  misc_feature (388)..(388): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaagggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggaccatatattactgtgcgaagcggaattggtgcggtgactgctatgactacgtgggccagggaaccctggtcaccggtctcctnacgcctccaccaaggcccatccgtctcccctcgccaccctcctccaacgacgccaccctcgtcgggggcacgacggaccggcccgtacgggccgttcgcccgtcggtcgacggtaccgtaccgttaccggtacggtaacgttaccgtaacttcggaggtccgggaccgtcgggaccgtaacgggaccgtacgagtaacgg

SEQ ID NO: 250474 - DNA, 844 bp, Homo sapiens
  misc_feature: GYAE6OF02G8HZQ.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggcctccgaggggaaggggctagaatgggtctcaagtatcacaagcagtagtagtaccgcatggtacgcagactccgtgaacgggtccgtttcaccatctccgagagacaattccaaagaacacgcttagtatttagactaaaagtcgaaacagtctaggaagagtcggaaggtacaccgggacctaagttaactaatttaacctggttacggaccggaaaggtccggggtaaattttcggggtgggaccgggttgaaccgtcggtacttaacgtttacgaaccgttaacggtcgggggaacccgaaacggggtaaacccctggggttaccccgaaccgggtttccctaccctacggtaaccgtacccgttaccccgaaaccccggaaaacgggggtccccctaacggttcccgggtttccccgtttccccccgtacggggtcccctaacccccgttccccttaacccgtaaaccggaaccgtaccccgtaacccgtccgggtacgggggacccaacccggaccgggtcccgggcccccgttaggggtcccttaccgggtcccggtacgggttacccgaaacgggttaccctttacccggttacccggtaacggtaaaccggttaccgtaaccgtacggaaccggggtcccgggtacgtacggggtaaccgaacgggcccggtacgaacgttaacgg

SEQ ID NO: 250475 - DNA, 617 bp, Homo sapiens
  misc_feature: GYAE6OF02HGVYC.16.37.D04.1.454.CMB.1.raw
  modified_base (425)..(425): a, c, t, g, unknown or other
  misc_feature (425)..(425): n is a, c, g, or t
  modified_base (612)..(612): a, c, t, g, unknown or other
  misc_feature (612)..(612): n is a, c, g, or t
tcagtgtactactccacgaccggtgctcgatttagtagcatactgttgggtttgggggagacttagtacagccggggggtccctgagactctcctgtgcagcctctggattcacctttagtgcctatgccatgagcttgggtccgccaggcgttcccaggggaaggggcttagtaatggggtctcaagtatcacaaagcagtagtagtaccggcatggtacgcagacgtccgtgaagggccgttttcaccattcctccgtagagaccaattccaagaaacacgtctgtatttcgactaaatgaacagtctgagagtcgaggacgacgccgatagtattactggtgacgaagcgggaattggtggcggtgacttgacttagttgactacggtgggccgaagggaccctgtccacgttctcctccgngacccgtccaccgaacggcccacgtaccgttccttccccgtcggtaccctacccttcctccaagaccgtcaccgttccgtacggggcctaccgacgccggacccgtcggtctcgtccgtgtacgaacgacttacgtccgaggtacgtacgacgtcgacggccgggtacgtcggacctacggccgtanagtcg

SEQ ID NO: 250476 - DNA, 640 bp, Homo sapiens
  misc_feature: GYAE6OF02IQ14T.16.37.D04.1.454.CMB.1.raw
tcagtgtactactccacgaccggtgctcgatttagtagcatactgtgggtttgggggagacttagtacagccggggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggcccgtttcaccatctccagagacaattccaagaacacgctgtatttgcaaatgaacagtctagagagtcgaggacacggccatatattactgtgcgaagcgggtaattgggtggcggtgactgctattgactacgtggggccgacgggaaccctgggtcctaccgtctcctcgacgccctacccgaaccgaaccgggcccctacgtcccggttccctttcccccgtccggtaccctacccccgtccctacccgaaacgccgaccgtacccgttccggtcgggggtaccacgaccggcccggcccgtcgggccgtcgtcccgtcggtacgaacggaccgttaccgttaccgtaacggttacgtaaccgacggtggacggcgggcgtcgggaccgagggcggacgtagtacgg

SEQ ID NO: 250477 - DNA, 593 bp, Homo sapiens
  misc_feature: GYAE6OF02JJLBT.16.37.D04.1.454.CMB.1.raw
  modified_base (317)..(317): a, c, t, g, unknown or other
  misc_feature (317)..(317): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (553)..(553): a, c, t, g, unknown or other
  misc_feature (553)..(553): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccgagggaaggggctagaatgggtctcaagtatcacaagcagtagtagtaccgcatggtacgcagactccgtgaagggcctttcaccatctccagagacaattccaagaacacgctagtatttgacaaatgaacagtctgagagtcgaggcacggccatatattacngtgcgaaagcgggtaattgggtggcggtnactgctagttnactagngggacncgggaaccgtgttcgctcctcncgacnccgtccacccgaggcccgactaccggttccgttccccctcggcctaccctcccttccgaacgacggaccaccttccggcggggccgaaccaccggccggcccgtcgggcctcgcccgtggtaccgaacggacctccgtttaccgtacgaacgtccgnggtacggaccgggcgtcgacggacgaccggatacctagcg

SEQ ID NO: 250478 - DNA, 669 bp, Homo sapiens
  misc_feature: GYAE6OF02FFTEM.16.37.D04.1.454.CMB.1.raw
  modified_base (279)..(279): a, c, t, g, unknown or other
  misc_feature (279)..(279): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgacgggcctttcaccatctccagagacaattccaagaacacgctgtatttgacaaatnaacagtctgagtagtcgaggacacggccatatacttactgtgacgaagcgggtaattgggtggcggtgactgtcttattcgacttacgtcggggaccagggacccctgggtacccaccggtctcctcacgtccctccaccgacgggcccctacgttcccggtaccctttcccccgtcggacccacccccgttccctaccgaacgaccgtaccctaaccgtccggttcgggggaccctaccgacggtccccgggtcccggttacgggccttcggcccgttacgggtaccgaacgggtacccttacgttaccggacgttaacggtaccgtaaccgtgggtaccggaccgggtaccgttacgggaccgtaacgggaccgtaccggtaatacgg

SEQ ID NO: 250479 - DNA, 604 bp, Homo sapiens
  misc_feature: GYAE6OF02GYYU3.16.37.D04.1.454.CMB.1.raw
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggtccgtttcaccatctccagagactaattccaagaacacgctgtattgacaaatgaacngtctgagagtcgaggacacggccaatatattacngtgcgaaggcgggtaattgggtggcggtgacgtgcttaagttcgaactacggtcggggaccaaggggtaaccccttgggtaccaccggttcctcctcgacgtcctacccaccgaacggcccaacgttccggttcccttccccgcggtccctacccctcctaccgaacgacgcctaccgtcggtcggggccacgacggccggccgtcggctcgcctcggtacacgtactacgtaccgagtacgtacgacgtcgacggcggacgtggaccgacggcgtacagtacg

SEQ ID NO: 250480 - DNA, 627 bp, Homo sapiens
  misc_feature: GYAE6OF02IWZOG.16.37.D04.1.454.CMB.1.raw
  modified_base (213)..(213): a, c, t, g, unknown or other
  misc_feature (213)..(213): n is a, c, g, or t
  modified_base (312)..(312): a, c, t, g, unknown or other
  misc_feature (312)..(312): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgnagactccgtgaagggccgtttcaccatctccagagacaattccaagaacacgctgtattgcaaatgaacagtctgagagtcgaggacacggaccatatnttactgtagcgaagcgggaattgggacggcggtgtacgtgctagttgacgttacgtggggtccacggggaaccctgggtacctaccgtctacctcgacgccgtccaccgacggccccagtccgtccttccctcggccaccctccctaccaacgtcgccaccgtcgtcggggcaccgtacggccggcccgtcgggtccgtcgtcccgtcgggtccgtaaacggtaccgttacccgttaccggacggttaaccggttaaccgtacggttggaaccggccgggtacgtcgggaccgaccgggtcggaccgtagtacgg

SEQ ID NO: 250481 - DNA, 561 bp, Homo sapiens
  misc_feature: GYAE6OF02HF020.16.37.D04.1.454.CMB.1.raw
  modified_base (304)..(304): a, c, t, g, unknown or other
  misc_feature (304)..(304): n is a, c, g, or t
  modified_base (477)..(477): a, c, t, g, unknown or other
  misc_feature (477)..(477): n is a, c, g, or t
  modified_base (538)..(538): a, c, t, g, unknown or other
  misc_feature (538)..(538): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctagagagtcgaggacncggccatatattactgtgacaaggcgggaattgggtggcggtgactgctattgactacgtgggccagggacctggtcaccgtctcctcacgcctcaccacggcccagtccgtccttccccgtggcccaccctcctaccacgacgccaccgtcgtcgggcacgacggccgccgngggctcgcgtcgacgaacggactacgttcgacgttacgtaccacgtcggaggtccggtcgngggaccgtaagggcgacgatcgg

SEQ ID NO: 250482 - DNA, 659 bp, Homo sapiens
  misc_feature: GYAE6OF02IH23O.16.37.D04.1.454.CMB.1.raw
  modified_base (292)..(292): a, c, t, g, unknown or other
  misc_feature (292)..(292): n is a, c, g, or t
  modified_base (356)..(356): a, c, t, g, unknown or other
  misc_feature (356)..(356): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacaagcagtagtagtaccgcatggtacgcagacctccgtggaagggtccgtttcaaccatcctccagagacaacttccaagaacacgctgtatttgacaaatgaacngttctggaagagtacggagacgacggaccattatattactgtgacgaaggcgggtaatttgggngggtcggtgtacgtggtactagtttaggaccttacggtggggacccgaacgggtacccttgggtacccacccggttccttcccgtcacgtccctacccaccgaaccgggcccacgtccggtcccttccccctcggtccctacccctaccctacccgaacgacgaccctaccgtccggtcggggaccaccgacggacccggcccggtcggcgtcgtccgtcgtaccgaagtacctaccgttccgtacgtaacgtaccgacgtacggcggccgggtcgacgggtaccgaacggtcgacgtgtacg

SEQ ID NO: 250483 - DNA, 867 bp, Homo sapiens
  misc_feature: GYAE6OF02H8VBV.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacaagcagtagtagtaccgcatggtacgcagactccgtgaaggccgtttcaccatctccagacgactaacttccaagaacacgctagttatttgacaaagtgaacagtctagagacgtacgaggacacggccaagtatatttactggtacgacggaaggacgggaagtttgggtaggggtcggtgtacgtggacttaggttttacgacttaccggtcgggggtacccgaacgggggtaaccccttgggtaccccaacccgggtttcccttcccgtcgtaaccccgtcccgttaacccccgaaccccggtaaaccggggtcccccctaacgggtttcccccgggttccctttaaccccccccccggttccgggggtaccccctaacccccgttttccccccgtaacccggttaaaccggaacccggtaccccgttaacccggttcccgggttaaccggggggacccgtaaaccggttaccggggttccggtcccccgggttcggggtccccgttccggtacccgggtttacgggtaccgggtaaaaccggtacccgtttaccccggtttaaccgggtaaccggtttaaccggttaacccgtaccggttaccgggtaaccggggtcccgggggtacccgttacgggggaaccccggtaaggggtaccccggtacgtagtaacgg

SEQ ID NO: 250484 - DNA, 590 bp, Homo sapiens
  misc_feature: GYAE6OF02I67M9.16.37.D04.1.454.CMB.1.raw
  modified_base (487)..(487): a, c, t, g, unknown or other
  misc_feature (487)..(487): n is a, c, g, or t
  modified_base (555)..(555): a, c, t, g, unknown or other
  misc_feature (555)..(555): n is a, c, g, or t
  modified_base (584)..(584): a, c, t, g, unknown or other
  misc_feature (584)..(584): n is a, c, g, or t
  modified_base (586)..(590): a, c, t, g, unknown or other
  misc_feature (586)..(590): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgttttcaccatcctccagagacaattccaagaacacggtgaatcttacaaatgaacagcctgagaaccgaggacacggccgtatattattgtataggttatggtaggtaattcgggcccgtggggccgagggaaccgtggtcaccgtctcctcacgcctccaccgaacggcccatccggttccttcccccgtggccgccccgtgccctaccgaggacgtaccacctacccggagacgccgaccacggccgtccccgngggcctcggccttgggtccaacggaccttaccgttcgagttaacgtaccacgttggacggcggtccgngggaccgtaacgggcgaccagttagagcnannnnn

SEQ ID NO: 250485 - DNA, 622 bp, Homo sapiens
  misc_feature: GYAE6OF02FZRNF.16.37.D04.1.454.CMB.1.raw
  modified_base (321)..(321): a, c, t, g, unknown or other
  misc_feature (321)..(321): n is a, c, g, or t
  modified_base (392)..(392): a, c, t, g, unknown or other
  misc_feature (392)..(392): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaaatgaaacagtctgagagtcgaggacacggccatataattacngtgcgaagcgggaattggtggcggtgactgctatgactacgtgggcagggacctggcaccgtctcctcacncctaccgaccaacgggcccagttccggtccttcccccgtcggccctaccccttcctacccaagacgcctaacctccggtcggggccaccgacggccggacccggtcgggccgttcgacccgttcgggtaccgaacgggtaccgttacgttacccgggtaagttaacggtaacctaccgtaccggtacggaccggggtccgtcgggaccggaagggccggaccgtagtacg

SEQ ID NO: 250486 - DNA, 724 bp, Homo sapiens
  misc_feature: GYAE6OF02HV1JS.16.37.D04.1.454.CMB.1.raw
  modified_base (204)..(204): a, c, t, g, unknown or other
  misc_feature (204)..(204): n is a, c, g, or t
  modified_base (285)..(285): a, c, t, g, unknown or other
  misc_feature (285)..(285): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgnatggtacgcagacctccgtgaagggccgtttcaccatcctccagagacaatcaagaacacgctgtatttgacaaatgaacngttctaggacgagtcgaaggccgtacggaccattagttacttacgtgcggacgaagtaacggggtaatttggggtacggggtcggtacggtactcgtcttaagtttcgaaccgtttacggtcggggccgaaacgggtacccgtacggtccacccggttcctccgttcgactcccgtaccaaccgtaccgggaccctaccgttccgttccccgttaccccgtccggtaccctacccctcccttacccgaacgaccgtacccacccggtccggtccgggggacacccgtaaccggcccggtacccggtccgggtcgtaccgtcccgtaggtaccgtaaccgggtaccttacccgttaccggtacgttaacccggtacgtaacggttacggaaccgggtccggtacggtacgggaccgttaacgggcctacggtactaacgg

SEQ ID NO: 250487 - DNA, 522 bp, Homo sapiens
  misc_feature: GYAE6OF02HEKOX.16.37.D04.1.454.CMB.1.raw
  modified_base (316)..(316): a, c, t, g, unknown or other
  misc_feature (316)..(316): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
  modified_base (496)..(496): a, c, t, g, unknown or other
  misc_feature (496)..(496): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaacgggccgtttcaccatctccagagacaattccaaagaacacgctgtatttgacaaatgaacagtctgagagtcgagacacgcatatatacngtgacgaagcggaattggtggcggtgactgctattgactacgtggggcacgggaacctggtccnccgtcnctcacgccaccacgacggccacgtcgtcctcccngccnccctcctcagacncactcgcgggcacgacgccgccgtggcctgctggacaacgctactcgagtacgacacgngacgcggctcggacacggcgagatag

SEQ ID NO: 250488 - DNA, 574 bp, Homo sapiens
  misc_feature: GYAE6OF02H11CS.16.37.D04.1.454.CMB.1.raw
  modified_base (317)..(317): a, c, t, g, unknown or other
  misc_feature (317)..(317): n is a, c, g, or t
  modified_base (336)..(336): a, c, t, g, unknown or other
  misc_feature (336)..(336): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactcgtgaagggcctttcaccatctccagagacaattccaaagaacacgctgtatttgacaaatgaacagtctgagagtcgagacacgccatatattactgngacgaagcgggtaattggnggcgtgactgctattgacgtactgggccagggaccctggcaccgtnacctnacgcctccaccacggcccagtcgtcttccccgtgccaccctcctaccaagacgcctacctcgtacggggcaccgacgccggcccgtcggcttcgccgtaggtacaacggtaccttaccgttaccgtaggtaacgtaccgacgtaggacggtcgggacgtcggaccgtaacgggaccgacgtatacgg

SEQ ID NO: 250489 - DNA, 891 bp, Homo sapiens
  misc_feature: GYAE6OF02F3MJ2.16.37.D04.1.454.CMB.1.raw
tcagtgtactactccacgaccggtgctcgatttagtagcatactgtgggtttgggggaggaacttagtactagccgggggggtccctgagactcgtccctgtgcagcctactggattcacctttagtgccttatcgccatgagcgtgggtcccgccaaggccttccaggggaacgggcttagaatgggtctacgaagtactccaacaagcgagtaagtacgtaccgcatcggtacgcagacttccggtgaacgggtcctttcacctagttcctaccgacgtagaacctaaacttaccgaaagtaacctcgtcttaggttactttggacctaaaacgtcgaaaccacggtacgtagacggtacggttacggaacggtacgaccgggactaacttacgttaactttaacgtaggtacgtacggaaacgggtaccggggtaaactttcgggtacgggtcggttacgtaccgttagtacgttaagtttcgaaccgtttacggtacggggacctaacggggtaaccctggggtacccacccggttctacccgtacgaccgtcccgttacccgaaccggaacccgggtccctaacggtttccccggttaccccgtttacccccggtacccgggtaccccctaccccgttaccccgttaacccgaacggttaccgtacccttacccggttacgggtccgggggtaccctaaccggaccgggtaccccgggtcccggttcggggtacccggttacgtcccggttacggttaacccggtaaccggtacccgtttaccgttaacccgggtaacgttaacccggttaccgttaacggtacggtaccggtaccggggtaccgttccgggtaaccgggaccggtaccggtaccgttaagaccgg

SEQ ID NO: 250490 - DNA, 590 bp, Homo sapiens
  misc_feature: GYAE6OF02GCEBZ.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgagacacggccatatattactgtgcgaaggcgggaattgggaggcggtgactgcttattgactacggtcgggaccagggtaccctggtaccaccgtctcctcgacgcctccaccgaacggcccagtccggtccttccccgtggccctaccctcctaccgaacgacgacctaccgtcggtcggggaccacgacggccggtacccgtcgggcgtcgccgtcggtacgaacgaccttaccgttaccggagtaacgacctaccgtaggacggcggtcgtcggacgacggcgacagtacg

SEQ ID NO: 250491 - DNA, 583 bp, Homo sapiens
  misc_feature: GYAE6OF02FINH0.16.37.D04.1.454.CMB.1.raw
  modified_base (183)..(183): a, c, t, g, unknown or other
  misc_feature (183)..(183): n is a, c, g, or t
  modified_base (338)..(338): a, c, t, g, unknown or other
  misc_feature (338)..(338): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtancacaagcagtagtagtaccgcatggtacgcagactccgtgaagggccgtttcaccatcctccagagacaattccaagaacacgctgtatttgacaaatgaacagtctgagagtcgaggacacggccatatattactgtgcgagcgggaagttggnggcggtgactgcttattgactacgtgggccacgggaccctggtccaccgtctcctcacgcctccaccgaacggcccatccggtccttcccctggccaccctcctccaagacgcctacctcgtacggggcacgacgacccggcccgtgggcctggcccgtggtaccaacggtaccttaccgtccggagttaacggtacctaccgtaggacggcgggtactcgggaccgaacggcgtaccgagtacg

SEQ ID NO: 250492 - DNA, 559 bp, Homo sapiens
  misc_feature: GYAE6OF02GK0JX.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactacgtggggccaggggaaccctgggtcacccggtctcctcacgcctccaccaagggccccatccggtccttcccccgtcggcccaccctccctccaacgcgccacctcgtcgggggcacgacgccggccgtgggcctgccgtcggtcaacggacctacttccgagtacgtacacgtgacgcgggtctcggcgaaggcgcgatacg

SEQ ID NO: 250493 - DNA, 617 bp, Homo sapiens
  misc_feature: GYAE6OF02GSAMX.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattactgtgacgaagacgggtaattgggtggcggtgactgctattgactacgtgggaccagggaccctggtccaccgtctccgtcgacgcctcccgaccgaacgggccctacgttccggtccttcccccgtcggtcccaccccttcctacccgaacgacgacccgtacccgttcggcggggaccaccgacggcccggtcccgtcgggtcctcggtcccgtacggtccgtaacgtaccgttacgtccggtaggttacgtaccacgtcggacggtccgggtacgtcgggacgacggcgacgagtacg

SEQ ID NO: 250494 - DNA, 567 bp, Homo sapiens
  misc_feature: GYAE6OF02GOSO8.16.37.D04.1.454.CMB.1.raw
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (551)..(551): a, c, t, g, unknown or other
  misc_feature (551)..(551): n is a, c, g, or t
  modified_base (555)..(556): a, c, t, g, unknown or other
  misc_feature (555)..(556): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(564): a, c, t, g, unknown or other
  misc_feature (563)..(564): n is a, c, g, or t
  modified_base (567)..(567): a, c, t, g, unknown or other
  misc_feature (567)..(567): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattaccaagaaccacggtgaattcttacaaatgaacagcctagagaaccgaggacacggccgtatattattgtataggttatggtgtatcggcctgggcaggacgtgtcacgtctcncngcctcacacggccagtccgtccttccccgtggccgcctcgcctccgacggcgcccaccgtaccgagacgacacgaacggccggcccgtgggcctcggcccgtggtacgaacgggtaccttacgttacccgagttaacgtactacgtacggacgcgggactcgggcaacgggccgactaagngtcnncgnancnncgn

SEQ ID NO: 250495 - DNA, 679 bp, Homo sapiens
  misc_feature: GYAE6OF02HWVM6.16.37.D04.1.454.CMB.1.raw
  modified_base (247)..(247): a, c, t, g, unknown or other
  misc_feature (247)..(247): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaagggctagaatgggtctcaagtatcacaagcagtagtagtaccgcatggtacgcacgacctccggtgaacgggtcctttccaccatcnccagagacaattccaagacacgctgtatttacgacaaatgaacagttcctgagacgtcggaaggacacggctaatatattactgtgacgagcgggtaagttgggtaggcggttagacgtgacttattcggaccgttacggtacgggggacctaacggggtaccccgtggtaccgaccccggttcttacccgtccgtaacgcccttacccgaaccgaacccgggtcccctaggtcccggttccctttaccccccgaggtccctaccccgtccctacccgaggaccgtaccacccgtcggtcgggccacgacggcccggtcccgtgggtacctccgtccgtcggttaccgaacggtaccttacggtaccgtaggttccgtaacgcgttggaaccggtcggtacggtacggtcggaaccggtcgcgtaacgtcgg

SEQ ID NO: 250496 - DNA, 681 bp, Homo sapiens
  misc_feature: GYAE6OF02JTNS4.16.37.D04.1.454.CMB.1.raw
  modified_base (420)..(420): a, c, t, g, unknown or other
  misc_feature (420)..(420): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccgagggaagggctagaatgggtctcaagtatcacaagcagtagtagtaccgcagtggtacgcagactccgtgaacgggccgtttacaccatctaccagagacaatccaagacacgctgtattgacaatgaacagtctagagagtcgacgacacggacctagtatattacgtggtagacgaaggcggtaagttcgggtaggcggtagtaacgtgtctaagttaggaccttacggtgggaccgaacgggtaccctggcctaccgtctaccncgacgtcccaccgtaaccgaaccgggtcccaacgttccggtaccctttccccggtaggacccctaccccgttcctaaccgtaaggccgtacccgtaacccgttcggaacccggggtcaaaccgtcccgggtccggtaccccggttgggccctaccgggtccgttacgggtaacctaacggtacccgtaccgttaccggaagttaccggtacctacggtacggacgggtacggtcgacggtaccgacggtcgtactaggacg

SEQ ID NO: 250497 - DNA, 723 bp, Homo sapiens
  misc_feature: GYAE6OF02GYHQA.16.37.D04.1.454.CMB.1.raw
  modified_base (209)..(209): a, c, t, g, unknown or other
  misc_feature (209)..(209): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggcctccgaggggaagggctaagaagtgggtctacaagtatcacaagcagtagtagtaccgnagtggtacgcgagacctccggtagaacgggtccgtttcacatctaccagagaactaattaccaaagaaccgacgcttagttactttgactaaatgaactagtctagagagtcgacggacacggcaatattatactgtacgacgaagtcgggtaattgggaggcggtagtacgtgtactagttcgacgtacggtcggggaccgtaaccggggtaaccctgggtacccaccggttcctccctacgacgtcccctaccgacccgaaccgggtccccaaggttcccggttcccttcccccgtcggtaccccctccccgttacccgtaaccgaagaccgtaccctaccgttcggtacggggacaaccggaccggtcccgggtcccgttcgggaccgttcggacccgttagggtaacccgaacgggttaaccttacccgttaccggaacggttaacgtaaccgtacggtacggacgggtccggtccggtagggaaccgacggggtccgtacgaagtacgg

SEQ ID NO: 250498 - DNA, 618 bp, Homo sapiens
  misc_feature: GYAE6OF02JG69O.16.37.D04.1.454.CMB.1.raw
  modified_base (344)..(344): a, c, t, g, unknown or other
  misc_feature (344)..(344): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaagggctagaatgggtctcaagtatcacaagcagtagtagtaccgcatggtacgcagactccgtgaagggccgtttcaccatcctccagagacaattccaagaacacgctgtatttgacaaatgaacagtctgagagtcgaggacacggccatatattctgtgcgaagcgggtaattgggtggcggtncgtgcttatgactacgtgggcaggacctgtcaccgtctcacgacgcctacccacgacggtccctagtccggttcccttccccgtcggccctacccttcccgttaccaaccgagtacccaccgtacggcggggccaaccgacggtcccgggcccgtcgggcctcggcccggtttacggcccgtaaacggtacccgtacgtttacccggaacggttaacgtaaccgtaccgtaggccggtcgggcgttcgggaccgtaagggcctacggtatacgg

SEQ ID NO: 250499 - DNA, 700 bp, Homo sapiens
  misc_feature: GYAE6OF02FPTQM.16.37.D04.1.454.CMB.1.raw
  modified_base (182)..(182): a, c, t, g, unknown or other
  misc_feature (182)..(182): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtntcacaagcagtagtagtaccgcatggtacgcagactccgtgaacgggccgtttcaccatctccagagacaattccaagaacacgctgtatttgactaaatgaacagtctgagagtcgagacacggccatatattactgtgcgaagcgggtattgggtggcggtgactgactattcgactacgtgggccaagggacctggtcaccgtctcctcacgccctaccaccgaacggccctacgtccggtccttcccccgtcgggacccaccccgtccctacccgaacgtacgacccgacccgttacggtccgggggtaccgaacccgtacgggcccgggtccccggttacggggtacccgttccgggaccccggtttacggggtacccgtaaaccgggttaaccctttaccggttaccccggtaaggttaaaccgggttaaccctaaccggtacgggtaaccgggtcccgggggtaccggttccggggtaaccggaacggggcccggtaccgtagttaaccgg

SEQ ID NO: 250500 - DNA, 544 bp, Homo sapiens
  misc_feature: GYAE6OF02JB55L.16.37.D04.1.454.CMB.1.raw
  modified_base (248)..(248): a, c, t, g, unknown or other
  misc_feature (248)..(248): n is a, c, g, or t
  modified_base (395)..(395): a, c, t, g, unknown or other
  misc_feature (395)..(395): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccgaggggaaggggctagaatgggtctcaagtatcacaagcagtagtagtaccgcatggtacgcagactccgtgaagggcctttcaccatctccaganacatccaagaacacgctgtactttgcaaatgaaacagtctgagagtcgagacacggcatatattactgtgacgaagcgggtaattgggtaggcggtgactggctattgactacgtggggaccaacgggaccctgtcaccgtctcctncgcctccacgaacggccacgtcgtccgtccctcgccaccctcctaccagacacgacctcgtcgggcacgacgccgccgtggctcgcgtgacgacgacgtacgtcgacgtcgacacgtcgacgcggcgtcggacgtacggcgacgatacg

SEQ ID NO: 250501 - DNA, 623 bp, Homo sapiens
  misc_feature: GYAE6OF02IZ5SO.16.37.D04.1.454.CMB.1.raw
  modified_base (473)..(473): a, c, t, g, unknown or other
  misc_feature (473)..(473): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgagacacggccatatattactgtgcgtaagcgggtaatttgggtggcggtgtaactgctattcgactacggtgggccacgggaaccctggtccaccggtctccctacgacgcctacccgaccgaacggcccacgtcggttcccttcccccgtcggaccctacccctcctccaacgacnccgaaccctcggtcggggcacgacgccgggcccgtcgggtccgtacgcccgttacggtaccgtaacgggtaccttaccgttccggtaacggtaacgttaaccgtaccgtggacggcgggtccgtcgggaccgtaggacgtacgagtacgg

SEQ ID NO: 250502 - DNA, 547 bp, Homo sapiens
  misc_feature: GYAE6OF02HMK1N.16.37.D04.1.454.CMB.1.raw
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (547)..(547): a, c, t, g, unknown or other
  misc_feature (547)..(547): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcagttattggtggtagtggttataccacatactacgcagactccgtgaagggccgttcaccatctccagagacaattccaagaacacactatatctgcaaatgaacagcctgagagccgaggacacggccgtatattactgtncgaaaggccagggtanagcagtggctggtaccaagtcgggcagggaaccctgggtcaccgtcncctcncgcctccaccagggccacgtcgtcttccccctgcctacctcctccgaagcgacacctcgtcgggccacgcgccggccgtcggctcgcttggtctaacgactacgttccgagttacgtacagtggacggcgggcgtaggcgaacggcgacgaactgntnagn

SEQ ID NO: 250503 - DNA, 871 bp, Homo sapiens
  misc_feature: GYAE6OF02H52L2.16.37.D04.1.454.CMB.1.raw
  modified_base (206)..(206): a, c, t, g, unknown or other
  misc_feature (206)..(206): n is a, c, g, or t
  modified_base (348)..(348): a, c, t, g, unknown or other
  misc_feature (348)..(348): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggggaaggggctagaatgggtctcaagtatcaacaagcagtagtagtaccgnatggtacacagactccgtgaagggtcctttcaccatctccagagacaattcaagaacacgctgttatttgacaaatgaacagtctagagagtacgaggaccacggaccaatatattactgtgacgaaggcgggaatttgggnggcggtgacgttgaccttattgaactacggtcggggaccgtaacggggaaccccttgggtaccctacccggttccttcccgtacgtaccgtaccccgttacccgaaacccgaaaccgggtacccccgtaacggtttaccccgggtttacccccgttttcccccccggttacccgggtacccccttaaacccccccgtttacccccgtttaaccccgaaaaccggtaacccggtaccccgtaaacccccgttacccggggtacccggggggggtacccaaacccgggaacccgggtacccccgggggtacccccgggtttccgggggtaccccgttccgggttccccgggtttaacgggtaacccgggtaaaccggggttaaccccgtttaacccggttttaccccgggtaaacgggtttaaccggttaaacccgttaaccggttaacgggttaacggggcccgggggtaccggttaccgggggtaaccggaacgggggacccggtaccggtaacggttaacgg

SEQ ID NO: 250504 - DNA, 664 bp, Homo sapiens
  misc_feature: GYAE6OF02G8QO4.16.37.D04.1.454.CMB.1.raw
  modified_base (307)..(307): a, c, t, g, unknown or other
  misc_feature (307)..(307): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaagtgggtcctacaagtatcacaagcagtagtagtaccgcatggtacgcagacctccggtgaaggggtcccgttttcaccctatcctaccagacgacaattccaaagaacacgctgtattgacaaatgaacagtctganagtcgaggacacggccatatattactgtgacgaaggcgggtaattgggtaggcggtagactgctattcgaacgtaccggtggggaccaacggggtaacccctggtaccctaccgtccgtaccgtcgacgccctacccgaaccgaacgggtcccctacggttcccggttcccttccccccgtcggtacccctacccctcccttacccgaacgaccgcccgtacccgtccgggtcggggaaccaccggacggcccggtacccggtcgggccgtcgtccgtacggtacgacggttaccgtacgttccggtaagtacgtacctggtacgacggcggtacgtcggaccgaacggctacatcg

SEQ ID NO: 250505 - DNA, 708 bp, Homo sapiens
  misc_feature: GYAE6OF02I4I8Q.16.37.D04.1.454.CMB.1.raw
  modified_base (107)..(107): a, c, t, g, unknown or other
  misc_feature (107)..(107): n is a, c, g, or t
  modified_base (218)..(218): a, c, t, g, unknown or other
  misc_feature (218)..(218): n is a, c, g, or t
  modified_base (701)..(701): a, c, t, g, unknown or other
  misc_feature (701)..(701): n is a, c, g, or t
tcagtgtactactccacgaccggtgctcgatttagtagcatactgtgggtttgggggagtacgttagtacagccgggggggtccctgagactctcctgtgcagcctntggattcacctttagtgcctatgccatgagctgggtccgccaggctccgaggggaagggctagatgggtctacgaagtatcacaagcagtagtagtaccgcagtggtacgngaggactccggtggaaggggtccctttcaccgtatcctccgaaggacgacaagttcccaaagtaacgacgctgtattcgactaaagtcgaacagtctaggagacgtacggaggaccgacggctagtatattcgagcgacggaagcgggtaattcgggaggacggtgaactcgtactagtcgacctacggtacggggaccgaacgggtaacccgtggttcccacccggttcctccgtacgaccgtaccgtacccgtaaacggaaccgggaccctacggttccgttcccgtcccgtaccggacctacccgtacccgtaaccgaacgtccggaccgttacgtccggtaggggacctacgaccggtccggtaccctaggggtctcggacccggttaggtacgtaccgggtaacttcccggttacggaacggttaccggtaacgtacggtacggcggtccggtcgaccgggtacgaaccggtcaccgnggtaccg

SEQ ID NO: 250506 - DNA, 648 bp, Homo sapiens
  misc_feature: GYAE6OF02IF9KG.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaagggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgccgagggagtttactatgatatactggttacaaaaaggtactactttgactacgtgggcgaggaacccgtggtcaaccgtcctctccgagccctcccaaccgaacgggcccaagtccggttcctcccccgtcggccgtcccctggcccttccgaacggtacgaccctacccgtccgaaacgtaacccaaccggacgtccccggggtccccggtggggtacccgtcggtcccgttgggtacctaaacgggtacccttaacgttacccggacggttacgtaaccgtaccgtcggaggtcccgggacgttacggaccggtaacggcccgg

SEQ ID NO: 250507 - DNA, 752 bp, Homo sapiens
  misc_feature: GYAE6OF02JTMAP.16.37.D04.1.454.CMB.1.raw
  modified_base (421)..(421): a, c, t, g, unknown or other
  misc_feature (421)..(421): n is a, c, g, or t
  modified_base (709)..(709): a, c, t, g, unknown or other
  misc_feature (709)..(709): n is a, c, g, or t
  modified_base (749)..(749): a, c, t, g, unknown or other
  misc_feature (749)..(749): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgagggaaggggctagaatgggtctcaagtatcacaagcagtagtataccgcagtggtacgcagactccgtgaacgggccgtttcaccatcctccaagagaccaacttacccgaagaaaccacgtccgttagttaagttttcgaacctaaaattacgaaaccgtgttaccgttgaagtacggtcggacgggaacctaactcgaaccgtattaattacgttaccgttggcgtacgaacggtacgggtaagttggggtacggccgggttanacgttgtaccgtagttcgacgtaacggtcgggaccgtaacgggtaccctcggtaccgtacgtcccgtactacgaccgtacccctacgaaccccgaaggcccctaccggttaccgtttccccgttacccgtccggtacccctaccccttaccgttacccgaggtaccgaccctcccgtaaccgggtcggggtacccacgtccgggtcccggacccgggttcggaccttccggtccgtacgggttacaaccggtaccttacccggttaccggaaggttaccgtaacccgnggtaccggcggtaccggagtaccgcggtaacggccgttanacg

SEQ ID NO: 250508 - DNA, 651 bp, Homo sapiens
  misc_feature: GYAE6OF02JSRLN.16.37.D04.1.454.CMB.1.raw
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
  modified_base (314)..(314): a, c, t, g, unknown or other
  misc_feature (314)..(314): n is a, c, g, or t
  modified_base (459)..(459): a, c, t, g, unknown or other
  misc_feature (459)..(459): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggcctttcaccatctccagagacatcaagaacncgctgtattgacaaatgaacagtcngagagtacgagacacggccagtatagttacngtagacgaaggcgggtaattgggaggcgtgactgcttagtgacctaggtcgggctaacgggaccctggtccctaaccggtcctacgtcgacgtcccgtaccgaaccgaaccgggccccgtaacgtccggttaccctttcccccgngggtacccctacccgtcccttaacccgaaacgacgtacccgtaacccgtcgtacggggaccacgtaccggcccggtaccgtcggtaccgtcgtccgtcggtaccgtaacggtaccgttaccgttacggtaacgtaccggtactaacggtcggtacggccggtacgtacgggaccgacggcgtacgaagtcgg

SEQ ID NO: 250509 - DNA, 635 bp, Homo sapiens
  misc_feature: GYAE6OF02I1NLU.16.37.D04.1.454.CMB.1.raw
  modified_base (281)..(281): a, c, t, g, unknown or other
  misc_feature (281)..(281): n is a, c, g, or t
  modified_base (344)..(344): a, c, t, g, unknown or other
  misc_feature (344)..(344): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggggaaggggctagaatgggtctcaagtatcacaagcagtagtagtaccgcatggtacgcagactccgtgaagggccgtttcaccatctccagagacaagttccaagaacacgctgtatttgcaaangaacagtctgagagtcgagacacggccatatatactgtgcgaagcgggaattgggtggcggtnacgtgcttattgactacgtggggccagggaccctggtccaccggtctaccgtcacgtccctccgaaccaacgggcccagtccggtcctttcccccgtggccctacccgtcccgtacccaacggaccgtacccaacccgtccggtcgggggaccctacgaccgggtcccggtccccggtgggcccttccggccttcgggtaccgaaggtcccttaccgtttccggaacggttaccggtacccgtacgttagaccggcgggtacgtacgggaccgaagggccgacgtagtacg

SEQ ID NO: 250510 - DNA, 607 bp, Homo sapiens
  misc_feature: GYAE6OF02FS1GZ.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattactgtgcgaagcgggtaattgggtggcggtgactggacttagttgactacggtggggaccgaacggggaaccctgggtcacccgtctccctcacgccctccaccgaacgggacccacgtccggtcccttcccccgtcgcccaccctccctccaacgacgccacccgtcgtcggggacacgacgccggcccgtcgggcctcgcccgtaggtaccgaacggtacctaccgttaccgacggtacgtaaccgacgtacggacggccgggacgtcggacgaacgggcgacgagtacg

SEQ ID NO: 250511 - DNA, 737 bp, Homo sapiens
  misc_feature: GYAE6OF02I3GBO.16.37.D04.1.454.CMB.1.raw
  modified_base (563)..(563): a, c, t, g, unknown or other
  misc_feature (563)..(563): n is a, c, g, or t
tcagtgtactactccacgaccggtgctcgatttagtagcatactgtgggtttgggggagacttggtacagccgggggggtccctgagactctcctgtgcagcctctggattcacctttagtgcctatgccatgagcgtgggtccgccaggctccaggggaaggggctagaatgggtctcaagtatcacaagcagtagtagtaccgcatggtacgcagactccgtaggaacgggtccgtttcaccatcctccagaacgactaacttaccaaagaaccacgtctaggttaattttcggaccaaaattacgaaacaggttcctggaagtaggtcgaaggacgaccggcctaataattagttactggtacggacgaaggccgggtaagttgggtagggcggtgacgttgacttagttcgacctacggtcggggaccaacggggtaaccccgtggtccgtaaccggttcctccctacgaccgtcccctacccgaacccgaaccgggccctaacgttcccggttcccttcccccgtcggacccctaccccttcccgtaccaacggaccnccgtacccgtccgggtcggggtaccaaccggtaccggcccggtcccggtacgggtccgtaccggtccgtaccggtaccgtaaacggtaccttaccgttaccggtaaggtaccgttaaccgtacgtacggacggtaccgggtcgtacgggtaccgaaggtccggtacgagtacgg

SEQ ID NO: 250512 - DNA, 599 bp, Homo sapiens
  misc_feature: GYAE6OF02IXAMR.16.37.D04.1.454.CMB.1.raw
  modified_base (288)..(288): a, c, t, g, unknown or other
  misc_feature (288)..(288): n is a, c, g, or t
  modified_base (343)..(343): a, c, t, g, unknown or other
  misc_feature (343)..(343): n is a, c, g, or t
  modified_base (409)..(409): a, c, t, g, unknown or other
  misc_feature (409)..(409): n is a, c, g, or t
  modified_base (591)..(591): a, c, t, g, unknown or other
  misc_feature (591)..(591): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtacgccaggctccgagggaaggggctagaatgggtctcaagtatcacaagcagtagtagtaccgcatggtacgcagactccgtgaacggtccgtttcaccatctcagagacaataccaagaacacgctgtatttgacaaaatgaaacngtactgagagcgaggacacggcagtatattacgtgtgacgagtcgggaattgggnggtcggtgactgtactattgaactacgtggggaccaagggtaccctcggactaccgtcttccctanacgtccctacccaaccgtaacggcccacgttccgtccttccccgtcggcccacccctcctaccgaacgtacgcctaaccgtccgtacggggcaaccgcgccggccgtcggctacgccgtacgacgaacgaactacgttaccgtagtacgtacacgtcgtacggcggcgtggaccgacggacncgagtacg

SEQ ID NO: 250513 - DNA, 779 bp, Homo sapiens
  misc_feature: GYAE6OF02H6NSW.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctcccgagggaaggggctagaagtgggtctcaagtatcacaagcagtagtagtaccgcatggtacgcagactccgtgaagggtccgtttcaccatctccagagacaattacaagaacacgctagttattgacaaatgaacagtcagagagtcgagacacggccatatattactgtagacgaaggcgggaagttgggaggtcggtcgtacgtgtacttagtttcgacgttacgtcggggaccgaacggggtaccccgtggtacccgtacccggttccgtccgttaccgacgtcccctacccgtaaccccggaaaccgggtaccccgtaacggttcccggtttcccgtttacccccccggtcgggtcccgtacccccgttaccggcccgttacccgaacgggaccgtacccgtaaccccgtaacccggaacgtaaacccgaaccgacccggtccccgggtaccccggttacggggtcccgttaccgggtcccggttacgggttaaccgtaaaccgggttaccctttaacccggtttacccggtaacggttaacggttaaccgtaacccggttacggtaaccgggtccggggtaccgtacggggtaaccggaacgggttaccgaccgtaacgg

SEQ ID NO: 250514 - DNA, 247 bp, Homo sapiens
  misc_feature: GYAE6OF02JWWJP.16.37.D04.1.454.CMB.1.raw
  modified_base (247)..(247): a, c, t, g, unknown or other
  misc_feature (247)..(247): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagcgtgggtccgccgaggctccgagggaaggggctagaagtgggtctacaagtatcacaagcagtagtagtaccgcatggtacgcagactccgtgaacgggtccgttcaccactn

SEQ ID NO: 250515 - DNA, 750 bp, Homo sapiens
  misc_feature: GYAE6OF02HFUNF.16.37.D04.1.454.CMB.1.raw
  modified_base (265)..(265): a, c, t, g, unknown or other
  misc_feature (265)..(265): n is a, c, g, or t
  modified_base (623)..(623): a, c, t, g, unknown or other
  misc_feature (623)..(623): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccgagggaaggggctagaatgggtctcaagtatcacaagcagtagtagtaccgcatggtacgcagactccgaggaagggtccgtttcaccatctccagagacatccaagacacgntgtatttgacaatagaacagtctagagaggtacgaggacgacggcctattatattactgtccccccggagaagggacggggtaagttgggtggggtccgggtagtaccgttaggtccttatttacgaccgttaccgggtacgggggacccggaacggggtaaccccgttcggtacccgtacccggttcctacccgtccgtaccgtccccgtacccgtaaccccggaaccgggaccccctaaccggttcccggttccccgtttacccccgtccggaccccgtacccccgtccctacccgaacgaccgaccctacccgtccggcggggccaccgtaccggcccggtcccgtcggggcccncggtacccgttcgggtaccgaacggtacccgttacccgttaccggtaacgggtaaccgttaccgtaccggtacggtaccgggtcggggaccgttaccgggaccggtaacgggcccgtagacgtacgg

SEQ ID NO: 250516 - DNA, 782 bp, Homo sapiens
  misc_feature: GYAE6OF02FLFCI.16.37.D04.1.454.CMB.1.raw
  modified_base (581)..(581): a, c, t, g, unknown or other
  misc_feature (581)..(581): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaacgggtccgtttcaccatcctccgagacgactaacttaccaagaaccaccgtctagttatttgacaaatcggaaactagtctgaggagtacggacggtaaccgaccggaccattatagttacgtgtgacggaaggtcgggtaagttgggtcgggcggtagacctgtacttattgggaaccttacggcggggtacgaacggggtaacccgtggtaccctacccggttaccttcccgtaccgtaccgtccccgttacccgaacccgggaaccgggcccctaaccggtttcccgggttccccctttacccccccggtaggtaccccccgtacccccttaccgacccgtaaacgggtaccncccgttaacccgggttccgggtaccggggaccctaacccgggaccggttaccccggggtcccggtacggggtcctaccgggtcccgtacggttacgaacccgggtaccctttacccggttaccgtaaggttaccggtaaccggtacgcggggtaccggtccgggacgtcggggaaacccgtagggcccgtacgtaagtacg

SEQ ID NO: 250517 - DNA, 548 bp, Homo sapiens
  misc_feature: GYAE6OF02IYSZJ.16.37.D04.1.454.CMB.1.raw
  modified_base (461)..(461): a, c, t, g, unknown or other
  misc_feature (461)..(461): n is a, c, g, or t
  modified_base (545)..(546): a, c, t, g, unknown or other
  misc_feature (545)..(546): n is a, c, g, or t
  modified_base (548)..(548): a, c, t, g, unknown or other
  misc_feature (548)..(548): n is a, c, g, or t
tcagtgtactactccacgaccggtgctcgatttagtagcatactgtgggtttgggggagacttagtacagccgggggggtccctgagactctcctgtgcagcctctggattcatctttagcagctatgtcatgacctgggtccgccaggctccaggggaaggggctggagtgggtctcagttattggtggtagtggttataccacatactacgcagactccgtgaagggccggttcaccatctccagagacaattccaagaacacactatatctgcaaatgaacagcctgagagccgaggacacggccgtatattactgtgacgaaggccagggtatagcagtggctggtaccaagtcggggccagggaaccctggtcaccgtctcctcagcctcacgaacggcccagtccgtccttccccgtgccaccctcctcccaagcgcaccctcgtcggggcaccngccggcccgtgggctcgccgtgtcgaacggtctacgtccgagtcgtacgactggacgcgggctcgggagacggcgacgatagtnntn

SEQ ID NO: 250518 - DNA, 596 bp, Homo sapiens
  misc_feature: GYAE6OF02FHRBM.16.37.D04.1.454.CMB.1.raw
  modified_base (335)..(335): a, c, t, g, unknown or other
  misc_feature (335)..(335): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggnggcggtgactgctatgactcgtgggccagggaaccctggtccaccgtctcctcacgcctccaccaacgggcccacgtcggtccttcccccgtggcccacccctcctaccaacgacgaccaccgtcgtcggggccaccgacggccggcccgtcgggccttcggcccgtgggtccgaacggtaccttaccgttccggaacgttacggtaccgaccgttcggaacgtccgggcgttcgggaccgacgggccgaccgagtaacgg

SEQ ID NO: 250519 - DNA, 580 bp, Homo sapiens
  misc_feature: GYAE6OF02GQVL5.16.37.D04.1.454.CMB.1.raw
  modified_base (321)..(321): a, c, t, g, unknown or other
  misc_feature (321)..(321): n is a, c, g, or t
  modified_base (441)..(441): a, c, t, g, unknown or other
  misc_feature (441)..(441): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccaatatattacgngtgacgaagcgggtaattgggtggcggtgactgactattcgactacgtgggacaggggaaccctggtcaccgtctcctcacgcctaccaccgaacgggcccacgtccggtccttccccgngccgaccctcctaccacgacgcacctcgtcggggcacgcggccgcccgtgggctcgccgtggtacgaacgtccgtaccgttccgaagtaacggtaccacgtacggtacggcgggctacgggacgaacggcgacagtacg

SEQ ID NO: 250520 - DNA, 651 bp, Homo sapiens
  misc_feature: GYAE6OF02FSPLD.16.37.D04.1.454.CMB.1.raw
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
tcagtgtactactccacgaccggtgctcgatttagtagcatactgtgggtttggggggagacttagtacagccgggggggtccctgagactctcctgtgcagcctctggattcacctttagtgcctatgccatgagctgggtccgccaggctccaggggaaggggctagaatgggtctacaagtatcacaagcaagttagtagtaccgcatggtacgcagactccgtgaagggtcctttcaccatctccaganacaattccaagaacncgctagtatttagacaaaatgaaacagttctagagagtcgaggaacnccggacatatattacgtgtgacgaaggcgggtaattgggnggacggtancgttgacttagtttggacgtaccggtggggacccgaacggggaaacccttgggcccaacccggttcctacccgtcgaccgccctacccgaacccgaacgggccctacggttccggttccctttccccgccggtccctacccctccctaccgaacgacgccgaaccgtccggtacgggggccacgacggccggcccgtcgggtctcgtccgtggtacgaacggtaccttacgttacggagtacgtaccgtacgacgtacggcggacgtcggaccgacggcgcgtagag

SEQ ID NO: 250521 - DNA, 678 bp, Homo sapiens
  misc_feature: GYAE6OF02IG6ZS.16.37.D04.1.454.CMB.1.raw
  modified_base (107)..(107): a, c, t, g, unknown or other
  misc_feature (107)..(107): n is a, c, g, or t
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
  modified_base (281)..(282): a, c, t, g, unknown or other
  misc_feature (281)..(282): n is a, c, g, or t
  modified_base (670)..(670): a, c, t, g, unknown or other
  misc_feature (670)..(670): n is a, c, g, or t
tcagtgtactactccacgaccggtgctcgatttagtagcatactgtgggtttgggggagacttagtacaggccgggggggtccctgagactctcctgtgcagccctntggattcaccttttagtgcctatgccatgagctgggtccgccaggtctccgaggggaagggtctagaatgggtctcaaagtntcaacgaagcaaggttgtagtacccgntagtcggtaacgcaagcctccgtaggaacgggtcctttcaccntctcagagactaattcaagacnnctgtattgacaaatgaactagtcgtaagacgtagtacgaggacacggcctaagttactaattcgtgtaggacgaaggcgggtaagtttgggacggtcggttagacgtagtcttaagtaggactacgggtcggggaccgaacgggtacctgggtaacctacccggttctccgtaacgccgtcccgtaccaaccggaccggtaccctaacggttccggttcccttaccccgtcgtaaccctccccgtaccttaccgaaacgtcgacctaccgttaccgggaccgggtactaacccgtcggcccggtcccggtaggtccgtcgtacccgtggtaaccgacgtaccgttacgtaccgtagtaacgtacagtcgacgcggtacgtggacgcgngtcagtcg

SEQ ID NO: 250522 - DNA, 717 bp, Homo sapiens
  misc_feature: GYAE6OF02G6FCS.16.37.D04.1.454.CMB.1.raw
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (299)..(299): a, c, t, g, unknown or other
  misc_feature (299)..(299): n is a, c, g, or t
tcagtgtactactccacgaccggtgctcgatttagtagcatactgtgggtttgggggagacttggtacagccgggggggtccctgagactctcctgtgcagcctctggattcacctttagtgcctatgccatgagctgggtccgccaggctccgagggaagggctagaatgggtctcaagtatcacaagcagtagtacgtaccgcagtggtacncaagacctccggngaacggggcctttcaccatcctaccagagacaattaccaagtaacacgctagttacttagactaatcgaacngtcctgagcgtcgaggaccacggaccatatacttacgtgtgcgaacggcggtaagttgggaggcggtagtactgacgttaagtcgtaacgtacggtcgggaccgtacgggtaaccccgttcggtaccctacccggttacctccccgtaccgaccggtaccccgttaccccgaacccggaaaccggggttccccctaacggtttccccggtcccgttacccccgtcgggtaccccctaccccttcccgtacccgtaaagacccgcccgtaacccgtccgggtaccggggaacctaccgggaaccggcccgggtacccggtcgggtcctcggtccgtcggtaccgacgttactaccgtacgtacggtacgtaacgtacggtcgacggccggtacgtcgggacgtaacggccgatagtacg

SEQ ID NO: 250523 - DNA, 817 bp, Homo sapiens
  misc_feature: GYAE6OF02HTRGG.16.37.D04.1.454.CMB.1.raw
tcagtgtactactccacgaccggtgctcgatttagtagcatactgtgggtttgggggagacttagtacagccgggggggtccctgagactctcctgtgcagcctctggattcatctttagcagctatgtcatgacctgggtccgccaggctccgagggaaggggctggagtggtctcgagttagttggtggtagttggttactaccacatacgtacgcagaccgtccgtaggaacggggtccgttacaccattcctccgaagacgtaacctaattacccaaaagaactaaccaacgttaattaacttcctaggaactaaaagttacgaaaccacgtcccgtaggaacggacgacccgggtaaggaacccgaaccggccgttaaagttactttaacgtggtacgacggaaaacggtccgtaaagggtataggtacgtaggttacggcgttaaccggttacccaaacggggtccgggggaacccggaaccggggttaaaccccgttcgggttacccgtaccggttccttacccgtcgtaccccgtccgtacccccgaaaccggacccggtacccgtacccgttaccccgggtttcccctttcccccggtccggtacccctacccctccccgtaaaccgaccgaccggtaccctacccggtccgggtaccgggaccaccggaccggtcccggtcccggtcggtccgtccggtaccgtacgggtacgtaaccggtacgtaccgtaccgtaagttaccgtacgtaccgtacggacggccgggtccgtacggaccggaacggccggaacgtagacgtgacgtg

SEQ ID NO: 250524 - DNA, 972 bp, Homo sapiens
  misc_feature: GYAE6OF02GCINE.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccaggggaaggggctagaagtgggtctcaagtatcacaagcagtagtacgtaccgcatggtacgcaaggaccttccgtaggaaacgggtcccgtttcaacccattccctaccgaaggaacgaaccgtaaacgtttacccaaaacggaaaaccgaccgtaccgttaggtttatttttacggacctaaaaacgttcgaaaaaccgtaaggttccttaaggaacgggtaacggtaccgggaaacgggtaaccggaacccggggtaccctaaagttaacttaaccgttttaaccgtaggtacggacgggtaaacggaccgggggttaagtttcggggtacgggtccgggtagtacgttcggtactttaagttcggaaccgtttacgggtaccgggggtaaccgaccgggggtaaacccccgtttggggtacccccgtaacccgggtttcccttacccccgtaaccgttcccggtacccccgtaaccccgaaaccccggtaaacccgggggaaccccgttaaccggttccccgggttacccccgttttccccccgtcccggttacccccgtacccccccttaccccgtttaaccccggaaaccgggtacccgttaccccgtacccgttcccgggttacccgggggtacccgacccggtaacggggtccccgggtccccggtcgggttcccggtcccggttacccgttccggtaaacccgaacgggtaacccgttaccgttaccgggtaacggttaacggttaaccgtacggtaacgggtacggaccggggtcgtcgggaaccggtacgggaccgtacgtaggtacg

SEQ ID NO: 250525 - DNA, 614 bp, Homo sapiens
  misc_feature: GYAE6OF02HV5LI.16.37.D04.1.454.CMB.1.raw
  modified_base (264)..(264): a, c, t, g, unknown or other
  misc_feature (264)..(264): n is a, c, g, or t
  modified_base (282)..(282): a, c, t, g, unknown or other
  misc_feature (282)..(282): n is a, c, g, or t
  modified_base (312)..(312): a, c, t, g, unknown or other
  misc_feature (312)..(312): n is a, c, g, or t
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
tcagtgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaagggctagaatgggtctcaagtatcacaagcagtagtagtaccgcatggtacgcagactccgtgaaggtccgtttcaccatcctccagagacaattccaagacacgntgtattgactaatgaacngtctaggagagtcgaggaccacggctaatntattcctgtcgacgaaggcgggtaattgggtggcggttgactggcctattgactacgtgggaccaggacctgtcaccgtctctcncgctaccacgacgggccctagtccgtccttccccgnggtcccaccctccgtaccacgtacgccaccgtccggtacggggtccaaccgaccggcccgggtcccgtgggtcctacggtcccgtacggtaccgaaccggtaccgttacccgttaccggaacgtacgtaaccgtacgtcggaccggtcgggtaccgtcgggaccgacggaccgctacgtag

SEQ ID NO: 250526 - DNA, 612 bp, Homo sapiens
  misc_feature: GYAE6OF02IJ3UA.16.37.D04.1.454.CMB.1.raw
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaaggtccgtttcaccatctaccagagacaattcaagaacacgctagtatttnacgaaatgaacagtctgaagngtcgaaggacacggccaatatattactgtgacgaagacgggaattggtggcggtgactgctattgactacgtgggccaagggaaccctggtaccaccgtcctacctcacgcctccaacccgaacgggccccagtcggttcccttccccgtcggcctacccctccttacccaaacgacgaccctacccgtcgtacgggggccaacgacggcccggtcccgtcgggcctcgtccgttcgaccgaaggtaccttcgttacggtacgtaaggttaccacgtaggacggccggtgtacgggaccgaacggcgacaagtacg

SEQ ID NO: 250527 - DNA, 667 bp, Homo sapiens
  misc_feature: GYAE6OF02HT8EY.16.37.D04.1.454.CMB.1.raw
  modified_base (283)..(283): a, c, t, g, unknown or other
  misc_feature (283)..(283): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctcagagacaattccaagaacacgctgtatttgacaatgaacngtctagagtcgagacgacgcgatatatactgtgcgagcggagttagtgggtcggtgtacgtgcgtagttgtacgtacgtggggtaccgacgggaacccgtacggtcgtacccgtaccgtcccttccgtacgtcccgtacccaacccgaaacgggaccccgtacgtcccggttccgtttcccccgtaccggcccgtaccccttcccctacccgtaaacgacggaccctacccgtcccggtcggggaccgaccgacggacccgggtccccgtggggtcctcggcccggttcggtacggaacgttaaccgtaccgttacccggtagtacggtaccgtacctacggacggtccgggcgttacggcggaaccgtccggactagtagacg

SEQ ID NO: 250528 - DNA, 635 bp, Homo sapiens
  misc_feature: GYAE6OF02IFB6D.16.37.D04.1.454.CMB.1.raw
  modified_base (180)..(180): a, c, t, g, unknown or other
  misc_feature (180)..(180): n is a, c, g, or t
  modified_base (202)..(202): a, c, t, g, unknown or other
  misc_feature (202)..(202): n is a, c, g, or t
  modified_base (343)..(343): a, c, t, g, unknown or other
  misc_feature (343)..(343): n is a, c, g, or t
tcagtgtactactccacgaccggtgctcgatttagtagcatactgtgggtttgggggagacttagtacagccggggggtcctgagactctcctgtgcagcctctggattcacctttagtgcctatgccatgagctgggtccgccaggctccaggggaagggctagaatgggtctcaagtntcacaagcagtagtagtaccgnagtggtacgcagactccgtgaacggcttcacctatctcagagactacttcgaagacacgtctagtattgactaatgaacagccgtagacgacgccgacgacacggactatagtattacgtgtcgacgaaacgcgaacggtntagttacgtcaccgtattacgtacttgacttacgcgggaccaacgggacctagtcgaccgtctaccgtcgtacgcctaccgaccgaacgggccctagtccggttcccttacccgtcgaccgtaccctaccggaccaacggtcgaccgttacctacgggccgggaaccacggacggtccggacccgttggtccgtcgttcccgtaggttacgaacgggtaccgttacgttaccggacggtaacgtaccgtacgtaacggcggacggtcgtacggacgtacgtacggcctaagc

SEQ ID NO: 250529 - DNA, 647 bp, Homo sapiens
  misc_feature: GYAE6OF02FI6RV.16.37.D04.1.454.CMB.1.raw
  modified_base (251)..(251): a, c, t, g, unknown or other
  misc_feature (251)..(251): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaacgggtccgtttcaccatcctccaganacaattcccaagaaccacgctggttatttgcctaaatcgaacagttcgtagaggacgtccgaaggaccacggtccattatattactgtacggacggtaagcgggtaattgggtcggggcgtgactgcgttactgaacttacggtggggcctacgggaaccctggtccncccgttctccncgacnccctccgaccgacggccctacgttcccgtccttccccgcgaccctacccctcctaccgaacgacgccctaaccgtccggtacggggacctaccgacggtcccggtcccgtcgggtctccggcccgttggtacctaacggtaccttaccgttccgaggttaacgtaccacggtacgtacggccgggtacgtcggaacgacgcgaccgatacgg

SEQ ID NO: 250530 - DNA, 758 bp, Homo sapiens
  misc_feature: GYAE6OF02FMYX4.16.37.D04.1.454.CMB.1.raw
  modified_base (213)..(213): a, c, t, g, unknown or other
  misc_feature (213)..(213): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaagtgggtctcaagtatcacaagcagtagtagtaccgcatggtacncagactccgtggaacgggccgtttcacctatcctcagacgaacaattaccaagaacacgctgttatttagactaaatcgaatacgtactagaagtaggtcgaggaccaccggaccataacttatttaaccgtggtacgacggaaaggtcggggtaagtttggggtacggggcgggtacgaccgttggactttaagtcgtacgtacggtcggggaccggtaaccgggtaccttacgggtaccaccgttccttcccgtccgaacgaccccgttacccaacccgggtaaccgggacccccgtacgttaccccggttccccgtttacccccgtaccgggtaccccctaccccgtaccccttaaccgaacccgtacgtacccgtaccgtcccgggtacggggtaccacgtaccgggcccgggtacccgggtcgggccgttcggtcccgtaggtaccggtaaccggactttaccggttacgtaaccggtaacgttaccggtcgggtaacggtacggtcggtacggaccggaacggcgtaccgacgtgtacg

SEQ ID NO: 250531 - DNA, 813 bp, Homo sapiens
  misc_feature: GYAE6OF02FVU03.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatcgccatgagtcgtcggggtcccgcccagggcctccgaaggggaagggggtactagaagttggggtactcaaagtatacaacaagccagttagtacgtaccgctatggtacgcaagtacctccggtgaaacgggtcctttcaccatcgtccagagacaattaccaaagaaccacgcttaggttatttacgacaaattcgaaacacgtctaggaggtacgtcggaagtaccgaccggactaagtaactattacgtggtacgtacgaacgggtcggtaattagggtcggtacggtacgacgttgtacgttagttacgacgtttaacggtgggacccgaacgggtaacccgtcgggtacctaacccggttcccttacccgacgtaccgtaccctaccccggaaccgtaacgggcccctaacggttccgttacccccgttccccgtaccggccccctaaccccgtacccttaaccgaaccgtacccgaccgtaacccgtaccggtacccggggtaccaaccgggtaccggcccccggtaccgggttcgggcccgttcccgggtaccccgttaggggtaaccgttaaaccggttacccgttaccgtaacccggaccggtttaaccgaaccgtttaccggacggtacgggccggtacggccggggttaacgacggggactaccgtaggtaacc

SEQ ID NO: 250532 - DNA, 600 bp, Homo sapiens
  misc_feature: GYAE6OF02G2ZS9.16.37.D04.1.454.CMB.1.raw
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
  modified_base (326)..(326): a, c, t, g, unknown or other
  misc_feature (326)..(326): n is a, c, g, or t
  modified_base (382)..(382): a, c, t, g, unknown or other
  misc_feature (382)..(382): n is a, c, g, or t
tcagtgtactactccacgaccggtgctcgatttagtagcatactgtggggtttgggggagacttagtacagccggggggggtccctgagactctcctgtgcagcctctggattcacctttagtgcctatgccatgagctggggtccgcccaggctccaggggaaggggctagaatgggtctcaagtatcaacaagcagtagtagtaccgcatggtacnagctcgtgaaggtccttcaccatctccaganacaattccaagaacncgcttgtattgacaaatcgaacngtctggagagtacgaggacaccggacattatacgttacnggtcgacggaagcgggtaattgggtggcggtagactgtcttaagtcgacttacggngggaccacgggtaccctcggtcaccgttctccacgactccctacccgaaccgtacgggccctacgtcccgttccctacccgcgaccctccctcgtaccaacgacgtccacgtccggcgggacacgcggccgtcgtcggctcgtccgaggtaccgacgtaccttacgtcgtacgtcgactacgtggacggtggtcgtacggaccgacggtcgatagtcg

SEQ ID NO: 250533 - DNA, 581 bp, Homo sapiens
  misc_feature: GYAE6OF02IXBMX.16.37.D04.1.454.CMB.1.raw
  modified_base (182)..(182): a, c, t, g, unknown or other
  misc_feature (182)..(182): n is a, c, g, or t
  modified_base (244)..(244): a, c, t, g, unknown or other
  misc_feature (244)..(244): n is a, c, g, or t
  modified_base (328)..(328): a, c, t, g, unknown or other
  misc_feature (328)..(328): n is a, c, g, or t
  modified_base (348)..(348): a, c, t, g, unknown or other
  misc_feature (348)..(348): n is a, c, g, or t
  modified_base (372)..(372): a, c, t, g, unknown or other
  misc_feature (372)..(372): n is a, c, g, or t
  modified_base (402)..(403): a, c, t, g, unknown or other
  misc_feature (402)..(403): n is a, c, g, or t
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
  modified_base (457)..(457): a, c, t, g, unknown or other
  misc_feature (457)..(457): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtntcacaagcagtagtagtaccgcatggtacgcagactccggtgaagggccgtttcaccatccnccagacgacaattcccaaagaaccacgctgtatttgacaaatgaacagtctagagagtcgacggacaccggcatatattactgngacgaagcgggtaattgggnggcggtgctgctagttgactacgngggaccagggaccctggtccaccgtctccnncncctccaccgacggcccncgtcgtcctcccgtcgccaccctcctcagacgccnccgtcgtcgggcacgacggccggccgtcggtctcgtccgtcggtagacccccccggtataccgttaccgtacgtacgtacctacgtcggacggtcggcgtcggtaccggacggcgtcgagtacg

SEQ ID NO: 250534 - DNA, 774 bp, Homo sapiens
  misc_feature: GYAE6OF02HRNGV.16.37.D04.1.454.CMB.1.raw
  modified_base (122)..(122): a, c, t, g, unknown or other
  misc_feature (122)..(122): n is a, c, g, or t
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
  modified_base (382)..(382): a, c, t, g, unknown or other
  misc_feature (382)..(382): n is a, c, g, or t
tcagtgtactactccacgaccggtgctcgatttagtagcatactgtgggtttgggggagacttagtacagccgggggggtccctgagactctcctgtgcagcctctggattcacctttagtncctatcgccatgagcgtgggtccgccaggctccgagggaagggctagaatgggtctcaagtactcanaagcagtagtacgtaccnatggtacncaggacctccgtagaagggtccgtttacaccgatcctaccanacgtacaattccaaagaactacgcttagtatttgacaaagtgaactagtcngaacgagtcgaaggaccacggacctagttactattcagtcgacgtaaggacggtaagttgggtacgtcgggtanccgtaggtccttaagttggaaccttacggtcggggaccgtaagggtaccccgttggtacctacccgttcgtacccgtccacgtacccgtacccgtaaccggaaccgggacccctacggttacccgggtttcccttaacccccgtcgggtaccccgttaaccccgttacccgtaccggtaaacgaacccggtacctaacccggttaccgggtaccgggggtacctaaacccggtcggtacccgggtcccgtaccgggtaccgtaccgttcccggttacggttaaccgtaaccggttaccgttacccgttaccgggtaacggtaacccgtacggtaacgttacggtaccggggtcgaccggtccggtaacgaaccgggtctaccgtaaggtacg

SEQ ID NO: 250535 - DNA, 621 bp, Homo sapiens
  misc_feature: GYAE6OF02I7328.16.37.D04.1.454.CMB.1.raw
  modified_base (210)..(210): a, c, t, g, unknown or other
  misc_feature (210)..(210): n is a, c, g, or t
  modified_base (576)..(576): a, c, t, g, unknown or other
  misc_feature (576)..(576): n is a, c, g, or t
  modified_base (598)..(598): a, c, t, g, unknown or other
  misc_feature (598)..(598): n is a, c, g, or t
  modified_base (611)..(611): a, c, t, g, unknown or other
  misc_feature (611)..(611): n is a, c, g, or t
  modified_base (616)..(616): a, c, t, g, unknown or other
  misc_feature (616)..(616): n is a, c, g, or t
  modified_base (619)..(621): a, c, t, g, unknown or other
  misc_feature (619)..(621): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaagggctagatgggtctcaagtatcacaagcagtagtagtaccgcatggtacnccgactccgtgaaggcattcaccatctcagagacaattccaagaacgacggtagaactcttcaaatagaacacgcctaggaagaaaccgacggaccacgggaccgtatactttagttgtaagttaacggttagtggttaggtaaacgtttcccggggccccgttggggacccgaacggggtaaccgtcggttacacccggtcctacccgttccgacgcccctaccgacccgaacgggccccagttcccgggtcccttccccccgtaggcccgtccctcgcctccgacggacgccgacctccgagacgcccacagccgcccgtcggctcgcctaggacgacgactacttccgtacgtagtacgtcgngcgcggcgtggacgacggtccncgtaagtagacgncgagngcnnn

SEQ ID NO: 250536 - DNA, 763 bp, Homo sapiens
  misc_feature: GYAE6OF02J0TNQ.16.37.D04.1.454.CMB.1.raw
  modified_base (213)..(213): a, c, t, g, unknown or other
  misc_feature (213)..(213): n is a, c, g, or t
tcagtgtactactccacgaccggtgctcgatttagtagcatactgtgggtttgggggaggacttagtacagccgggggggtcccgtggagactctcctgtgcagcctctggattcacctttagtgcctatgccatgagctgggtccgccaggctccagggaaggggctagaatggggtctcgaagtatcaccgaagtcaagtagtagtaccgnacgtggtacgcagacctccgtgaacgggtccgtttcacctatctaccagacgacaattccgaaagtacacgctgtattgacaatgaacagtcgtacgaggtagtccgaaggacctacgggcctaagttaagtactttacgtgtacggacggtaacggtacccgggtaaagtttcggggtacgggtcgggtttaccgaaccggttgtaccgtttaaacgttgtaaccgttaccgggtccggggaccgtaacgggtaaccccggttaggtacccgtaccccggttacgtcccgtaccgtacgtcccgtaccgaccggtaaaccggggtacccctacgggttccggtaccccgtttcccggtccggtaccctaccccgtccttacccggaacacggtccctacggtcggaccggggtcacgtaccggccgtcccggtacggtccgtcggtaccgtacggtacgtaacggtaccttaccgccggttacggtaacgtaccgtcgtaacggtacgggtaccggtcgtacgggaccggacgttaccgacgtatacgg

SEQ ID NO: 250537 - DNA, 832 bp, Homo sapiens
  misc_feature: GYAE6OF02HX21X.16.37.D04.1.454.CMB.1.raw
tcagtgtactactccacgaccggtgctcgatttagtagcatactgtgggtttgggggagacttagtacaggccgggggggtccctgagactctcctgtgcagcctctggattccacctttagtgcctatcgccatgagcgtgggtcccgccgaggcctccgaagggggaaggggctaagtaatgggtctacaagtatcacaagcagtagtacgtaccgcagtgggtacgcgagaccttcggtggtaaggggcccttttcaacatctccagagacaattccaagaacacggtctagttatttcgaactaaattacgaactagttactagacggtaggtaccggaggaaccgaccggaacctattaaacttacgttaccgtgtacggacggaaagggtacggggttaaagtttgggtacgggggtaccggtaggtacctacggtcttaagtttacggtaacgttaaccgggtcgggggacccgtaaccgggggtaaaccccgttcgggttacccacccggtttcccgttacccgtccgacccgtacccgtccccgaaacccggtaaccggggtaccctaccggttcccggttaccccgtttacccccgtcgggtaccccctaccccgttaccctaccggtaaaccgacggtaccctaacccgtccggggtacggggacacccggacggtccccggtaccgtcggggccttccgggcgttacgggtaaaccgtaaccgggttaccgttacccgttacggtaacggttaacgaccgttaacggcggtaccgggcgggtaccggtcggaacccggaggtacccgtacgtaaggtcgg

SEQ ID NO: 250538 - DNA, 864 bp, Homo sapiens
  misc_feature: GYAE6OF02JFVVN.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaagggtctagaatgggtctcaagtatcacgaagtcagtagtacgtacgcatggtacgcaagaccttccggtagaagggcccttttcaacctatctaccgaagacgtaactaatttcccgaaaaggtaaaccaccggtacttgttaattttacggactaaaacgtaggaaacctagttcctaggtaacgaaggtaccgaaggtaccaaccggtcccaagttaacctatttaacgtgtacggacgaaaggcgggtaaattgggtcggccggtgtaacctggtaccttaaggtttagaaccggttaacgtgggggaccccgaacgggggtaaaccccccttgggggtaccctaaccccggttcgtttacccgaaccgtacgtcccgtaacccgaacccgtaaacgggaccccgtacgttaccggttccgttcccccgttagggaccctacccccgtccctacccgtaaaggaccgacccgttaacccgtccggttaccgggggcctaaccgaacccgggcccggtacccgggtaccgggtacccgttccgggtacccgttaccgggttaaccgtaaccgggtaaccgttaccgttttaaccccggaacgggtttaacccggttaaaccgtacccggttaaccgggtaaccgggaaccggggttacccgtaacgggtacccggaacgggcccggtaaccgtaggtaaccgg

SEQ ID NO: 250539 - DNA, 766 bp, Homo sapiens
  misc_feature: GYAE6OF02H7WB5.16.37.D04.1.454.CMB.1.raw
tcagtgtactactccacgaccggtgctcgatttagtagcatactgtgggtttgggggagacttagtacaggcccgggggggtccctgagactctcctgtgcagccctctggattccaccttttagtgcctatgccatgagcgtgggtcccgccaggcctccgaggggaaggggctagaagtgggtctacaagtatcaacaagcagtaagtagtaccgcagtcggtacgcaagacctccgtaggaacgggtccgtttaccaacctatcctaccgaaggaacgaactaacttaccaaacgtaaacaccgtcgttagttaatttacggaactaaaagtacgaaaccgtaagttacgtaggaacgtacggtaccggaaggaacccgaaccggtacctaaaagtttaacgttaattttaccgtaggtaccggaacggtaaagggtacgggtaagttggggtcgggtacggtagtacgtgacgtttattacggaacttacgggacgggtaccgaacgggtacccctggtaccctaccgttcctccgtaccgacgaccccgtacgaacccggtaacggaccctacgttccggttccttacccccgccgacctaccctacccgtacaacgcgaccctacgtcggaacgggccaacggaccggcccgtccgcgggtctaccggtccgtacgaacgaaccgtaccttaccggttacggtagtaccgtaacgcgtacggtacggccggacgtacggaccggaaggtccaagtgtacg

SEQ ID NO: 250540 - DNA, 676 bp, Homo sapiens
  misc_feature: GYAE6OF02IFJXA.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccgaggggaaggggctagaatgggtctcaagtatcacaagcagtagtagtaccgcatggtacgcagacctccgtggaacgggtccgttttcaccattcctaccaagagaactaacttaccaaacgaacaccgcttagttattttgactaaatagaacagtctgaagagtcgaggaccacggaccaattatattactgtgacggaaggtacgggagttgggtggtcggtgacgtgacgttattgacgtagcgggaccaacgggtacccgtggtcctaccgtctcctcgtacgtcccgtccaaccgaacgggccctacgttccggttccctccccgtgccctacccctccgtaccgaacgacgtcccaccgtcggtcgggaccgaccgtacgggcccgcccgtcgggtccttcgggccttacgggtacccgaaggttaccgttaccgttcccggtaacggttacgtaacccgtcggtaccggcggaccgggtacgcgggtaaccggacgggtaccgtacgagtacgg

SEQ ID NO: 250541 - DNA, 688 bp, Homo sapiens
  misc_feature: GYAE6OF02FSXA9.16.37.D04.1.454.CMB.1.raw
  modified_base (338)..(338): a, c, t, g, unknown or other
  misc_feature (338)..(338): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtattttgcaaatgaacagtctgagagtacgaggacacggccaatatatactgtgcgaagcgggaattggnggcggtgactgctatgatactgggccagggaaccctggtcaaccgtctcctcgacgccctaccgaccgaacgggaccccacgttccggttccctttaccccctcggcccgaccccttcccgttacccgaaacggtacgacccgaacccttccggtcgggggtcccaccgtaacggcccgggtacccccgttggggcccgttcgggcccgttacggtacccgtaaaccgggtaacccgtttacccgtttcccggttaacggttaacggttaacccgttaaccggtacgggaccgggttccgggggtaccgttaccggggaccggtaacgggcccggtacgtacgttaacgg

SEQ ID NO: 250542 - DNA, 754 bp, Homo sapiens
  misc_feature: GYAE6OF02G5CGR.16.37.D04.1.454.CMB.1.raw
  modified_base (146)..(146): a, c, t, g, unknown or other
  misc_feature (146)..(146): n is a, c, g, or t
tcagtgtactactccacgaccggtgctcgatttagtagcatactgtgggtttgagggagacttagtacagccggggggggtccctgagactctcctgtgcagcctctggattcacctttagtgcctatgccatgagctgggtcccnccaggctccaggggaagggctagaagtgggtctcaagtatcaacaagcaagtagtagtaccgcagtggtacgcagacctccggtgaacgggtcctttacaccatctccagagactaattccgaaagaacacgctagttaatttgaacaaattcgaaactagtctagaagtagtacggaagaccacggaccaagttataattactggacgtacgaaaggtcgggtaatttgggacgggcggtgacgtcgctttaagtcgaacttacggtggggaccctaaggggtaaccctgggttacccaccggttctccgtacgaccgtaccctaccgaaacccgtaacgggtcccctaacggttccggttcccttacccccggtcggtacccctaccccgttccctaacccgaacgtaccggtaccctaccggtcgggttacgggggaccaaccggtacgggtacccgggtcccggtcgggtaccgtccggttaccggtacggtaaccgaaccgggttacccttaaccggttaccggtaacggttaacggtaccctaaccgtacgggtaccggtacggggtccggttacgggacggaaacgggtccgacgtaacgg

SEQ ID NO: 250543 - DNA, 923 bp, Homo sapiens
  misc_feature: GYAE6OF02JKNF1.16.37.D04.1.454.CMB.1.raw
  modified_base (185)..(185): a, c, t, g, unknown or other
  misc_feature (185)..(185): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggctccgaagggaaggggctagaatgggtctcaagtntcacaagcagtagtagtaccgcagtcggtacgcagactccggtagaacgggtcctttccacctactctccaagacgtacaacttaccaaagaaccacgacttggttaatttcggactaaaatcgaacgacgttcgtaggaaggacgtcggaaggtaccgaccggtacctaattaacgtactttacgtacggttacggaccggtaaagggacccggggttaatttcggggggttacggggtacggggttacggtaacccgtggttaacccgttttaaggttttacggtaaaccgttaaccgggggttaccggggggaacccgggtaaaccggggtaaaccccccggttttacgggggtacccccgttaacccccggtttccccggtttacccgttaacccgtacccggaacccccgtaaacccccggaaaccccgggtaaacccggggtacccccgtaaccggtttccccgggtttaccccgtttcccccgttccgggtacccctacccccgttaccctaacccggaaacggtaccgtaccccgtacccgttccgggtccgggggtaaccacccggtacggtccccgggtcccgggtacgggtcggtcccgtccgggtacggtaaccggaaccggttaccgttacccgttaccggaacggtttaaccgtacgttaaccggtcgggaccgggtacgggtaccggttacgggtccggaacgggccggtacgacgttaacgg

SEQ ID NO: 250544 - DNA, 764 bp, Homo sapiens
  misc_feature: GYAE6OF02GOLC1.16.37.D04.1.454.CMB.1.raw
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
tcagtgtactactccacgaccggtgctcgatttagtagcatactgtgggtttgggggagacttagtacagccgggggggtccctgagactctcctgtgcagcctctggattcacctttagtgcctatcgccatgagcgtgggtcccgccgaggcctccgagggaagggctagaagtgggtctcaagtactacanaancgagtaagtacggtaccgctagtcggtaacgcagaccgtcgtaggaacggtccgtttacaccatcctaccaggaacgtacaacgttaccgaaacgtaaaccgaccgacgtttacgttattttaccgaacgtaaaaggtacgaaacgttacgtcctaggaacgggtaacgtacgggaacgtaaccgaaccggtaacctaagtaactttacgtaacgttgtacgtaacggaagggtacgggtaagttcgggtagggtccgtagaccgtacggtctaagttacggacttacgggtcgggacaacgggtacctggtccctaccgtctacccacgacgtccctacccgaccgaaccgggtaccctacggttacccgttcccgttccccgtaccgtaccccgtaccctccgttaaccgaccgccgacccgtacccgtaccgggtcgggaccgaccgtccggacgtccgggtcgtcggtccgtacggtacgaccgtaacgtccgtacgttaccgtaagtcggtaaccgtaacggtcggtacggcggtcgtagggtaccggcggtacgactgagg

SEQ ID NO: 250545 - DNA, 801 bp, Homo sapiens
  misc_feature: GYAE6OF02GTRTS.16.37.D04.1.454.CMB.1.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (446)..(446): a, c, t, g, unknown or other
  misc_feature (446)..(446): n is a, c, g, or t
tcagtgtactactccacgaccggtgctcgatttagtagcatactgtgggtttgggggagacttagtacagccggggggggtccctgagactctcctgtgcagcctctggattctacctttagtgcctatgccatgagctgggtccgccaggctccgaaggggaaggggtctaaggaagtggggtcctacaaaggttatcaacgaaagctaaggtagtagtacccgntaatggtaaccganacgtaccgtccggtaggaacgggtcctttacgaacctctcgtaccgagaacgtaactaaccttaccgaaaagtaaaccaccgtgttaagttagtttaggaacctaaaagttgaaactacgtacgtagagggtacgtacggtaacggacgtaccggtactaattacttagttaaccgtgtacggacgtaggtaacggtagttcgggnggtaggttcgattacgtagtagtacgtacgtacggtacgggactaacgggtaacccgttcggtaaccaccccggttccttaccggaacaccgtacccggtacctaaaccggtaaccggtacccgtaccgttacccgtcccgttaccccggtacggtacccctcccgtaaccgtaccgtaacgtacctaccgtaccgtcggtaccgggtacgaacgtaccggtaccgtccggtggtccgtaccgttcgtaaccggtacgtaaccggttacttacccgttacggtaaccgtaacgtacggtacgtaccggtacggtaccgggtacgtacgggtaccggaacggtcgtacgtagtacg

SEQ ID NO: 250546 - DNA, 867 bp, Homo sapiens
  misc_feature: GYAE6OF02HSTMX.16.37.D04.1.454.CMB.1.raw
tcagtgtactactccacgaccggtgctcgatttagtagcatactgtgggtttgggggagacttagtacagccggggggtccctgagactctcctgtgcagcctctggattcacctttagtgcctatgccatgagctgggtccgccgaggctccgagggaacgggctagaagtgggtctacgaagtatcacaagcagtagtacgtacgcagtcggtaccgcagtaccttccggtaggaacgggtccctttcaccattccctaccgaaggtaacgtaactaacgttacccgaaacgtaaccgaccggtaccgttagttaagttttacgaaccgtaaaagttacggaaaccgtaggttaccttaggaagtacggtacggaaacgggaccgaaccgggaccctaagttaacgttaacgtttaccgttaggtaccggaacggaaacgggtaccggggttaaaggtttcggggttcgggtcgggttacggtacgttacggttcttaacgtttacgtaccggttaccgggtaccggggtaaccgtaaccggggtacccgttacgggttacccgtaacccggttcccctttaccgtaccgtccgaccccttaccccggaaaccgaacccgggtaccctaccggttcccggttcccttacccccggtcgtaccccgttacccctacccgtacccgtaaacggccgttacccgtaccgtccgggtaccggggtacccacgggaccggccccgggtccggtacggtccgtccggttaaccggtcggaaccgtaacgtccttaccgttccggtaacgtcgtacgtacggtaccggaccgggtacggtcggtacggaccgtaccgggacttacgagtacg

SEQ ID NO: 250547 - DNA, 865 bp, Homo sapiens
  misc_feature: GYAE6OF02GJY85.16.37.D04.1.454.CMB.1.raw
  modified_base (365)..(365): a, c, t, g, unknown or other
  misc_feature (365)..(365): n is a, c, g, or t
  modified_base (688)..(688): a, c, t, g, unknown or other
  misc_feature (688)..(688): n is a, c, g, or t
  modified_base (858)..(858): a, c, t, g, unknown or other
  misc_feature (858)..(858): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccaccaggcctccgaggggaaggggctagaagtgggtctcaagtatcaacaagcagtagtacgtaccgcagtggtacgcgaagacctccgtaggaacgggtcctttcaaccatcctaccgaagacgaactaactccgaaagaacctacgcttagttacttgactaaatgaaccagtcctgaaggacgtacggaggaccacggcctaaattagttaactttacgnggttccggaacggtaaacgggacgggttaagttcgggggtcggtacggttccggaacttgggtaccctttaagttacggtacccttacgggggtaccggggacccggtaaacgggggttaaccccttcggggtaccctaacccgggttccttacccggttacccaccggtcccctacccggaaaccccggaaccgggtaccccgtacggtttccccgggttacccctttccccccgggttacgacccccgttacccccgtcccgttaaacccgaaacggtaccgtacccttaacccgggtccggggtacccgggggtaacccncccgggaaccggtccccgggttacccgtcggggcttaccccgggttaaccggtcgggttaaaccgtaaccgggtaccttaacccggttaccgggttaacgtaaccgggttaacctaccgggtagggaaccggtccggggtatacccggggaccggaacggtccggaacgnggtaacg

SEQ ID NO: 250548 - DNA, 683 bp, Homo sapiens
  misc_feature: GYAE6OF02FTXUD.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagctgggtccgcaaggctccagggaaggggctagaatgggtctcaagtatcacaagcagtagtagtaccgcatggtacgcagactccgtggaacgggtccgtttcaccatcctccaagagacaattccaaagaacacgctgtatttgacaaaatgaacagtctgagagtcgagacacggccagtatattactgtgacgaagcgggaagtttggtgggcggtgacgttgcttagttgactacgtggggaccaaggggaaccctggtcctaacccgtcttcccacgacgtccctacccgaaccggaaccgggcccctaacgttcccgggttaccctttccccccggtaggcccctacccccgttccctaacccgtaacgaccgaccctacccgttcgggtcgggggaccaccggacggaccccgggtcccgtcgggccgtccggtcccgttacggtaccgaaccggtaccttacccgttaccgggtacgttaaccggaacaccggttcggacgggccggtccggtagggaccgaagggcccacgagtaaccg

SEQ ID NO: 250549 - DNA, 878 bp, Homo sapiens
  misc_feature: GYAE6OF02IEI8Z.16.37.D04.1.454.CMB.1.raw
  modified_base (139)..(139): a, c, t, g, unknown or other
  misc_feature (139)..(139): n is a, c, g, or t
  modified_base (186)..(186): a, c, t, g, unknown or other
  misc_feature (186)..(186): n is a, c, g, or t
tcagtgtactactccacgaccggtgctcgatttagtagcatactgttgggttttgggggagacttagtacagccgggggggtccctgagactctcctgtgcagcctctggattcacctttagtgcctaatcgccatgancgtgggtccgcaggctccgaagggagggctagaatgggtctcaagtntacgacgaagcagtagtaagtaacgcagtggtacgcagacctcgagaggtcctttcaccatccacgagagacaacttaccaaagaccgtacgtcttagttatttacgaactaaattacgaactgtcgtaggacgtacggtacggaacggaaccgaccggactaagttacgttacgttacgtaggtacggaacggtaaggtacggggtaagttcggggtacggtcggtacgtacgtcgttacgttacgttacgaccgttacggggtacgggaccggtaaaccggggtaccgttccgggtaacccgtacccgttcccgtacccgtacggtaccccggttacccgtaaccccggtaaacccggtaaccccgggtaccccgttaacccggtttccccggtttacccccgtttcccccggttacccgtaccccgttaaccccctttacccgtaacccggtaaacccggaaccccggttaccccggttaacccgggtacccggggtacccgggggacccgtaacccggtccgggtacccccgggtcccgggtacgggttcccggtacccgttacccgggttacggttaaacccgtaacgggttacccgttaccggttacccgtaacggtaaccgttaccggtacggtacgggtacggtcgggtacggtacgggtaccggaacgggtctacggtacgac

SEQ ID NO: 250550 - DNA, 617 bp, Homo sapiens
  misc_feature: GYAE6OF02H3US8.16.37.D04.1.454.CMB.1.raw
  modified_base (412)..(412): a, c, t, g, unknown or other
  misc_feature (412)..(412): n is a, c, g, or t
  modified_base (468)..(468): a, c, t, g, unknown or other
  misc_feature (468)..(468): n is a, c, g, or t
  modified_base (494)..(494): a, c, t, g, unknown or other
  misc_feature (494)..(494): n is a, c, g, or t
  modified_base (608)..(617): a, c, t, g, unknown or other
  misc_feature (608)..(617): n is a, c, g, or t
tcagtgtactactccacgaccggtgctcgatttagtagcatactgtgggtttgggggagacttagtacagccgggggggtccctgagactctcctgtgcagcctctggattcagcgtcagtaacaaccacgtgatgtgggtccgccagccctccgagggaaggggctggaatgggtctcagttattgaaaatgatggtgacacaatctacgccgactccgtggaacgggccgattcaccatcctccagagacaattccaagacacggtagaactcttacaaatcgaacacgcctagacgaaaccggaggacaccggaccgttatattaagttgtaagttaggtacttaggtggtagttaccggtcccggtccgggcggacggtacggacggtcgaccgtacctcctcctacnctcccaccgaccgaccgcctacgttacccgttccctcccgcgcccctcgtcgtccncgacggacacccgtacgtaccggacncgacgaacgccggtcccggtcgcggtccgtccgtacggtacgtaagtaccgtacgttaccgtacgtagttaccgagtacgaggacgtcgggacgtcgacggtcgactagagcgnnnnnnnnnn

SEQ ID NO: 250551 - DNA, 812 bp, Homo sapiens
  misc_feature: GYAE6OF02JQRQW.16.37.D04.1.454.CMB.1.raw
  modified_base (147)..(147): a, c, t, g, unknown or other
  misc_feature (147)..(147): n is a, c, g, or t
  modified_base (797)..(797): a, c, t, g, unknown or other
  misc_feature (797)..(797): n is a, c, g, or t
  modified_base (806)..(806): a, c, t, g, unknown or other
  misc_feature (806)..(806): n is a, c, g, or t
tcagtgtactactccacgaccggtgctcgatttagtagcatactgtgggtttgggggagacttagtacgaggccgggggggtccctgagactctcctgtgcagcctctggattcacctttagtgcctatgccatgagcgtgggtccnccgaggctccgaggggaacggggtctaaggaatggggtctacgaagtatcaacgaagctaaggtagtaacgtaccgctagtacggtacgacacggtaccgtccggtaggaacgggttccctttaccgaaccctattacccgtaccgaagacgtaacctaacgttacccgaaaagaccgtaacgtccgtttgttaacttttcggaacctaaaaggttagaaaccgtggttctaaggaaggttacggtacggaacggaactaccgggacctaaagttactacgtttacgacggtacgaccgggtaaaagggtccgggttaaagttttcgggggtaggttaccggtacgtacgttcgtacgttaacgtacggtaccgttaagggtcgggacccaacggggttacctcggtcctaacccgtgttcccaaggtcccgtaccgtacccgtaacccggtaccgggtaccccgacgtttcccgggtaacccttccccgtacgggtacccctacccgttcccgaacgtaacgaccggtccgtaacctcgggtaccgggaccaacggttccggcccggtcggtccggtacgtcgaccggtactaccgggaacgttccgtacgtacggtacgttacgaagcccgtaggacgcggtcaccgnggtacgcgngtagcg

SEQ ID NO: 250552 - DNA, 606 bp, Homo sapiens
  misc_feature: GYAE6OF02FMJE5.16.37.D04.1.454.CMB.1.raw
  modified_base (316)..(316): a, c, t, g, unknown or other
  misc_feature (316)..(316): n is a, c, g, or t
  modified_base (600)..(600): a, c, t, g, unknown or other
  misc_feature (600)..(600): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaacgggccgtttcaccatctccagagacaattccaagacacgctgtatttgcaaatgaacagtctgagagtcgaggacacggcatatattacngtgcgaagcgggtaattggtggcggtgactgctattggactagtggggaccacgggaaccctggtacctacccgtccgtccctcacgccctaccgaccaacgggaccccacgtccgtccttcccccgtcggccctacccctcctacccaagacgcctacccgtcgtcgggggacacgacggcccggacccgtgggccttcgcccgtggtaccgaacgggaccttaccgtccgtaaggtacgtaccacgtacggacgcggggcgtacggaccgaacggaccgtanagtacg

SEQ ID NO: 250553 - DNA, 785 bp, Homo sapiens
  misc_feature: GYAE6OF02I6M58.16.37.D04.1.454.CMB.1.raw
  modified_base (122)..(122): a, c, t, g, unknown or other
  misc_feature (122)..(122): n is a, c, g, or t
  modified_base (187)..(187): a, c, t, g, unknown or other
  misc_feature (187)..(187): n is a, c, g, or t
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
tcagtgtactactccacgaccggtgctcgatttagtagcatactgtgggttgggggagacttagtacagccgggggggtccctgagactctcctgtgcagcctctggattctacctttagtncctagtgccatgacgcgtgggtccgccaggctccgagggagggctagaacgtggtcacaagtacncaacgagactagtagtacgtaccgntagtcggtacgcacggtaccgtaccggtaggaacgggttcctttacaacctattccgaccagaagaacctaactaccgaaagaaccncgtactgttaattcgaactaaagtagtaacgtacgtgaggacgacgacccgacgtacgacgacctaagacttaagtcgtggtacgaaccgaacgaccgtaccgtacgtaacggttaacctccctaaccacgtttacgttacttacggtaacgtaccggtacggggcctaaacgggtcccgtacgtacccgtccttaccccggtcctagtaccccgtaccctaaccgtacccggaaccgtaccccgtaccgttcccgtacccgtttccccgccgtacccctacccgtcctaccgaaccgtactcccgttaccgaccgggtccggaacccggcgtacccgggcccggtacccggtcgggtaccgtaaccgtccgggtaacggtaaaccgtcccgttaccgttaccggaacggttaccggtacgtaaccgtacggggccggttaccggacggtacccggaccggttaacggccgtacgttagacgtacg

SEQ ID NO: 250554 - DNA, 832 bp, Homo sapiens
  misc_feature: GYAE6OF02GB93J.16.37.D04.1.454.CMB.1.raw
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggctccaggggaaggggctagaatgggtctcaagtatcacaagcagtagtacgtaccgcagtggtacgcagacctccggtaggaacgggtccgtttccaacctatcctaccaaggtacgaacctaacttaccgaaagaaccacgtcttgttattcgacaaaatacgaaactagtcgtaggaagtacggtaccggaacggaaccgaccggtacctaaattactttaacgtttaccgtggtacggaacgggaaacggggtaccggggttaaagtttgggggtacggggtaccgggtagtaaccgttggtaccttaagtttcgaaccgttacggtcggggacccgaacgggtaacccctgggtacccctaaccggttcctcccgcgtaccgtccccgtacccgaacccggaaccgggccccgtacgttccccgggttaccccctttcccccggtaccggtaccccgtaacccccgttacccgtaacccgaaacgacccggtacccgtaacccgttccggggtacggggaccctaccggacgggtccccgggtacccgtgggtcccgttaccggtcccgtacgggtaaccgaaccgtaccgttaccgttaccggaacggttaacgtaccgtaacggtcggaccggtacgggtccgtacggtaaccggacggtcccgaacgtagtaccg

SEQ ID NO: 250555 - DNA, 823 bp, Homo sapiens
  misc_feature: GYAE6OF02I81VZ.16.37.D04.1.454.CMB.1.raw
tcagtgtactactccacgaccggtgctcgattttagtagcatactggtgggtttggggggagactttagtacaggccggggggggtcccctgagactctcctgtgcagcctctggatttcacctttagtgcctatgccatgagctgggtccgccaggctccgaggggaaggggctagaagtgggtctacaagtatcacaagcaaggtacgtagtaccgcgatcggtacgcacgtaccgtccgtaggaagggtcccgtttacaaccagttccaccgaagtacgaactaacttaccaaacgaacacgtctagttagtttgacaaaagtgaaacagtctaaggaagaggtacggaacggaaccgaccggacctaattaagttattacgtaggtgacggtaaaggacgggtaaggtttcgggagggtcgtacgacgttgacttagtacggaacttacgggacgggacccgtaacgggggtaaccctgggtacccgaaccggttcccgtacgtaccgaacgtacccgtaacccgaacccgggaaaccggaccccgtaccgttacccggttaccccgtttacccccggtacccggaccccgtaccccgttacccgttaacccgaaaccgaaccgtacccgtacccgttccgggaccgggggtacccaaccggacccgggcccggtaccccgggtaccggtaccgttccggtaccgttacggtaaccgtaaacggtaaccgttaccgttaacccggtaaggttaacggtaaccgtacggtaacggacgggaccgggtaccggacgggaacgaacggacgacggaagtacg

SEQ ID NO: 250556 - DNA, 821 bp, Homo sapiens
  misc_feature: GYAE6OF02IRG0Q.16.37.D04.1.454.CMB.1.raw
  modified_base (184)..(184): a, c, t, g, unknown or other
  misc_feature (184)..(184): n is a, c, g, or t
  modified_base (377)..(377): a, c, t, g, unknown or other
  misc_feature (377)..(377): n is a, c, g, or t
  modified_base (817)..(817): a, c, t, g, unknown or other
  misc_feature (817)..(817): n is a, c, g, or t
tcagtgtactactccacgaccggtgctcgatttagtagcatactgtgggtttgggggagacttagtacagccgggggggtccctgagactctcctgtgcagcctctggattcacctttagtgcctatgccatgagcgtgggtccgccaggcctccgaaggggaaggggctagaagtgggtctanaagtatcaacgaagcagtagtagtaccgcagtggtacgcagaccttccggtaggaagggtcccgtttcaacccattctccagaacgtaactaacttaccaaagaaccacgtctaggttatttgactaaatgaaacctaggtctaggagtacggtacggaaggaactaccggaccaagttaattaactttacgnggtacgacggaaaggacggggttaacgttggggtacgggcgggtttagacgtagtactttaagttacggaccttacgggtcgggggaccctaacggggtaaccccgtcggtccttaacccgtcccgttaccgtccgtacgtccccgtacccgaaaccggaacccgggccccgtacgttccccgggtttccccgttaccccccggtacggtacccctaccccgttacccttaacccgaacggaccgccccgtaacccgttccgggtaccggggtaccgaccggtaccggacccggggtccccggttcggggtcccgttaccgtcccggttacgggaccgtaacgggttaacccgttaccggtacggttaacgttaacggtaccctacggtaaccggaccgggtcgggaccggttcggtaaccggacgggtaccgacggtanacgg

SEQ ID NO: 250557 - DNA, 211 bp, Homo sapiens
  misc_feature: GYAE6OF01DV56A.44.65.F10.1.454.CMB.1.raw
  modified_base (210)..(211): a, c, t, g, unknown or other
  misc_feature (210)..(211): n is a, c, g, or t
tcagacagtatatacacgaccggtgctcgatttagctacgctctaaggggaggaactgctcagttaggacccagacggaaccatggaagccccagcgcagcttctcttcctcctgctactctggctcccaggaactgtggctgcaccatctgtcttcatcttcccgccatctgatatatactgtctgagcgggctggcaaggcgcatagnn

SEQ ID NO: 250558 - DNA, 510 bp, Homo sapiens
  misc_feature: GYAE6OF01CHRV6.44.65.F10.1.454.CMB.1.raw
  modified_base (196)..(196): a, c, t, g, unknown or other
  misc_feature (196)..(196): n is a, c, g, or t
  modified_base (347)..(347): a, c, t, g, unknown or other
  misc_feature (347)..(347): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctttctgtgtctccaggggaaanagccaccctctcctgcagggccagtcagagtgttaccagcaacttagcctggtaccaccagaaacctgggcaggctcccaggctcctcatctatggaacatccacagggccactggtatcccacccaggttcagtggcagtgggtccgganagagttcactctcaccatcagcggcctgcagtctgagtatttgctagtttattactgtcagcagtataataactggctctcacgtttcgggcggggaccaagggtggagatcgaaacgactgtgctgcaccgatctgtcttcacttcttcccgccatctgtaa

SEQ ID NO: 250559 - DNA, 491 bp, Homo sapiens
  misc_feature: GYAE6OF01CIWZ6.44.65.F10.1.454.CMB.1.raw
  modified_base (196)..(196): a, c, t, g, unknown or other
  misc_feature (196)..(196): n is a, c, g, or t
  modified_base (455)..(455): a, c, t, g, unknown or other
  misc_feature (455)..(455): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttggcagcagcgtagcctggtccagcagaaacctggccagactcccaggctcctcatctataccacatccaccagggccactggtatcccagccagattcagtggcacgtgggtctgggacagagttcactctcaccatcagcagcctgcagtctgaagtattttgctagtttattactgtcagctagtatagtgactggccttcgttcactttcggcctggaccacngtcgtattacaaacgtactgtgctgacacatctgtc

SEQ ID NO: 250560 - DNA, 518 bp, Homo sapiens
  misc_feature: GYAE6OF01BVIFS.44.65.F10.1.454.CMB.1.raw
  modified_base (197)..(197): a, c, t, g, unknown or other
  misc_feature (197)..(197): n is a, c, g, or t
  modified_base (511)..(511): a, c, t, g, unknown or other
  misc_feature (511)..(511): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttaccagcaacttagcctggtaccaccagaaacctgggcaggcctcccaggctcctcatctatggaacatccaccagggccactggtactcccaccaggttcagtggcaggtgggtccggacagagttcactctcacatcagcggcctgcagtctgaggtatttgctagtttattactgtcagcagtataatacgtgtcctctctacgttcgggcggggacctagggtggagagtacaaacgtacgtgtggctgcacatctcgtcttctactccttcccgctntcgtacg

SEQ ID NO: 250561 - DNA, 603 bp, Homo sapiens
  misc_feature: GYAE6OF01BN2L1.44.65.F10.1.454.CMB.1.raw
  modified_base (376)..(376): a, c, t, g, unknown or other
  misc_feature (376)..(376): n is a, c, g, or t
  modified_base (424)..(424): a, c, t, g, unknown or other
  misc_feature (424)..(424): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaattagtgatgacgcagtctccagccaccctgtctgtgtctccgaggggaaagcgccacctctcctgcagggccagtcagagtgttaccagcaacttagcctggtaccacagaaacctgggcaggctcccaggcctcctcactctaatcggaaacacgtcccaaccgacgggccacgtcggtaactccccgaccgtagggttccaggtcggcctagggtcgggtaccgganaggtagttccaactcgtacactagtcacgcggcctgcagtctggagtntttgactagtttatcgtgtagagtctagtaactaagtaacgtcgccttactacgtacgtttacgggcggggaacctaagggtggaacgtacgtacgaaacgtagtcggtacggtacgttacgacctacgtacttcgttacgtcttaccgtacttacccgtacccgcctacgtcgttacg

SEQ ID NO: 250562 - DNA, 546 bp, Homo sapiens
  misc_feature: GYAE6OF01EF5D9.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaagcgcccaccctctcctgcagggccagtcagagtgttggcagcagcgtagcctggttccagcagaacctggccagactcccaggcctcctcatctataccacactccaccagggccacgtggtactcccagccagacttcagtgcacgtgggtctgggacagtagttcactctcaccatcagcacgcctgcagtctagaagtatttgcttagtttattactgtctagctagtatagtcgacgttcggtccttcgttcctacgtttccgggcccgttcgggtaccctacgtacggtccgtaagtttaccaaacggtactcggtcggtactcgtacctacctgttccgttacg

SEQ ID NO: 250563 - DNA, 513 bp, Homo sapiens
  misc_feature: GYAE6OF01DD5PG.44.65.F10.1.454.CMB.1.raw
  modified_base (196)..(196): a, c, t, g, unknown or other
  misc_feature (196)..(196): n is a, c, g, or t
  modified_base (508)..(508): a, c, t, g, unknown or other
  misc_feature (508)..(508): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaccagcaacttagcctggtaccacagaaacctgggcaggctcccaggctcctcatctatggaacatccaccagggccactggtactcccaccaggttcagtggcagtggggtccggacagagttcactctcacatcagcggcctgcagtctgaggtatttgctagtttattactgtcagctagtataataactgcctctctacgtttcgggcggggtacctagggtggagatacgaaacgactgtggctgcaccatctgtcttctacttcttcccgctntctag

SEQ ID NO: 250564 - DNA, 212 bp, Homo sapiens
  misc_feature: GYAE6OF01BILQP.44.65.F10.1.454.CMB.1.raw
  modified_base (211)..(212): a, c, t, g, unknown or other
  misc_feature (211)..(212): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccaggaactgtggctgcaccatctgtcttcatcttcccgccatctgatatatactgtctgagcgggctggcaaggcgcatagnn

SEQ ID NO: 250565 - DNA, 522 bp, Homo sapiens
  misc_feature: GYAE6OF01CNPKH.44.65.F10.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (350)..(350): a, c, t, g, unknown or other
  misc_feature (350)..(350): n is a, c, g, or t
  modified_base (480)..(480): a, c, t, g, unknown or other
  misc_feature (480)..(480): n is a, c, g, or t
  modified_base (516)..(516): a, c, t, g, unknown or other
  misc_feature (516)..(516): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccagggggaaanacgccaccctntcctgcagggccagtcagagtgttaccagcaacttagcctggtaccaccagaaacctgggcaggctccaggctcctcatctatcggaacactccaccaggccactggtactccaccaggttcagtggcaggtcgggtcgganagagtcactctcaccatcacgcggcctgcagtctgaggtatttgactagtttattactgtcagcagtaataatactcggctctctacgtttcgggacggggacctagggtggagatacgaaacgactggngtctgcacactctgtcttcacttccttacccgcctntctacg

SEQ ID NO: 250566 - DNA, 495 bp, Homo sapiens
  misc_feature: GYAE6OF01C00DR.44.65.F10.1.454.CMB.1.raw
  modified_base (196)..(196): a, c, t, g, unknown or other
  misc_feature (196)..(196): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcagaaatctggccaggctccaggctctcatctatggtgcatcccaccgagggccactggtactccccagccaggttcagtggcaggtgggtctggggacaggcgtttcacttctccaccatcagcagcctgcagtctagaagtattttgactagttttattactatcagctagtataatgactcgcctccttcgcaggacncgangganagtaacgatgngctgcactntctgtcttntac

SEQ ID NO: 250567 - DNA, 525 bp, Homo sapiens
  misc_feature: GYAE6OF01EBKEV.44.65.F10.1.454.CMB.1.raw
  modified_base (353)..(353): a, c, t, g, unknown or other
  misc_feature (353)..(353): n is a, c, g, or t
  modified_base (520)..(520): a, c, t, g, unknown or other
  misc_feature (520)..(520): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaagggggaaagagcccaccctctcctgcagggccagtcagagtgtaccagcaacttgcctggtaccacagaacctgggcaggctcccaggctcctcatctatggaacatccaccgagggccactggtactccccaccaggttcagtggcaggtcggggtccgganaggagttcactctcaccatcagcggcctgcagtctgaggtatttgctagtttattactgtcagctagtataatactgtcctctctacgtttcgggacgggggacgtaagggtggagatacgaaacgacgtggtggctgcaccatctgtcttctactccttcccgctntctag

SEQ ID NO: 250568 - DNA, 563 bp, Homo sapiens
  misc_feature: GYAE6OF01COZKZ.44.65.F10.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagacaccactggagaaatagtgatgacgcagtctccagccaccctgtctctgtcctccgagggggaaangccaccctctcctgcagggccagtcagngtgttggcagcagcgtagcctggttccagcagaaacctggccagactccaggctcctcatctataccacactcccaccgagggccactggtactcccagccagattcagtgcacgtgggtctgggacagtacgttcactctcacatcagcagcctgcagtctagaagtatttgacttagtttatacttgtctagtactagttaatagttacgtacgttcggtcccttcccggtttactaccgtttccgggacccgttacgggaccctacgtacggttaccgtaatttacccgaaaacggtacgttggtacgtctacgacctaacctgttcgttacg

SEQ ID NO: 250569 - DNA, 528 bp, Homo sapiens
  misc_feature: GYAE6OF01DDROC.44.65.F10.1.454.CMB.1.raw
  modified_base (328)..(328): a, c, t, g, unknown or other
  misc_feature (328)..(328): n is a, c, g, or t
  modified_base (383)..(383): a, c, t, g, unknown or other
  misc_feature (383)..(383): n is a, c, g, or t
  modified_base (523)..(523): a, c, t, g, unknown or other
  misc_feature (523)..(523): n is a, c, g, or t
tcagacagtatatacacgaccggtgctcgatttagctacgctctaagggggaggaactactcagttaggacccagacggaaccatggaagccccagcgcagcttctcttcctcctgctactctggctcccagataccaccggagaaaattgtgttgacacaatctccagccaccctgtctttgtctccgggggaacgagccaccctctcttgcagggccggccagactgttgacgacgacttagcctggtaccaacagaagcctggccaggcctcccagactcctcatctatgatacttctagtagggcctctggcatcccagcccgnttcagtggcaggtgggtctgggacagacttcactctcaccatcaccagcctagancctagaagtattttgctagtttattactgtctactaaccgtaagagtggcctacaattattcactttcggcctgggaaccaaagtggatatacaaacgtactgtggctgcaccatctgttctctatccttcccgcattcngtata

SEQ ID NO: 250570 - DNA, 528 bp, Homo sapiens
  misc_feature: GYAE6OF01DOYTJ.44.65.F10.1.454.CMB.1.raw
  modified_base (519)..(519): a, c, t, g, unknown or other
  misc_feature (519)..(519): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagagccaccctctcctgcagggccagtcagagtgttagcagcaacttagcctcgtaccagcaagaaatctggccagactccaggctcctcatctactaccacactcccaccgacgggccacgtggtactcccagccagattcagtggcacgtgggtctgggacagagtcactctcaccatcagcagcctgctagtctaggtaatattttgacttagttttatactgtacagtctagtatagtgactcggtcccttcgttctaccgtttcggcccttgggacccacgtagtcgtatttaccgaaacgtctggtgctacgcacctnttctgttcc

SEQ ID NO: 250571 - DNA, 512 bp, Homo sapiens
  misc_feature: GYAE6OF01B5HDM.44.65.F10.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
  modified_base (348)..(348): a, c, t, g, unknown or other
  misc_feature (348)..(348): n is a, c, g, or t
  modified_base (386)..(386): a, c, t, g, unknown or other
  misc_feature (386)..(386): n is a, c, g, or t
  modified_base (485)..(485): a, c, t, g, unknown or other
  misc_feature (485)..(485): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaccagcaacttagcctggtaccaccagaaacctgggcaggctcccaggctcctcatctatggaacntccaccagggccactggtactcccaccaggttcagtggcagtgggtccgganagagttcactctcacatcagcggcctgcagtctgagtntttgctagtttattactgtcagctagtataatactggcctctctacgtttcggcgtggggacctagggtgagtatacaaacgtactgtggctgacactntcgtgtcttcacttccgtcccnctntc

SEQ ID NO: 250572 - DNA, 486 bp, Homo sapiens
  misc_feature: GYAE6OF01A94WZ.44.65.F10.1.454.CMB.1.raw
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (482)..(483): a, c, t, g, unknown or other
  misc_feature (482)..(483): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccacagggccactgtatcccagccaggttcagtggcagtgggtctgggacagagttcactctcaccatcagcagcctgcagtctgaagtatttgctagtttatactgtcagtaagtataatgactggcctccgttcgcaagggacacgatggagaattaacgactgaggctgcacntctntcttnntcc

SEQ ID NO: 250573 - DNA, 539 bp, Homo sapiens
  misc_feature: GYAE6OF01DY2UL.44.65.F10.1.454.CMB.1.raw
  modified_base (196)..(196): a, c, t, g, unknown or other
  misc_feature (196)..(196): n is a, c, g, or t
  modified_base (533)..(533): a, c, t, g, unknown or other
  misc_feature (533)..(533): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaccagcaacttagcctggtaccacagaacctggcaggctcccaggctctcatctatggaacatccaccagggccactggtactcccacctaggttcagtggcaggtgggtccggacagagttcactctcaccatcgagcggcctgcagtctgagtatttgctagtttattactgtcagcaagtataataactcggtccttctctacgttttcgggcggggggtaaccgtaagggttaggaggtaatacgaaacgtaacgtggtggacgtggccacattctgtcttcctattccttcccgcctntctacg

SEQ ID NO: 250574 - DNA, 580 bp, Homo sapiens
  misc_feature: GYAE6OF01CGJVG.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaagggggaggaactgctcagttaggacccagacggaaccatggaagccccagcgcagccttctcttcctcctgctactctggctcccagacaccactggagaaatagtgatgacgcagtctccagccaccctgtctctgtctccgaggggaaanacgccaccctctcctgcagggccagtcagagtgttagcagcaacttagcctacgtaccagcaagaaatctggccaggcctcccgaggcctcctcatctatggtgcatccaccgagggccacgtggtactcccagcccaggttccaggtggctaggtgggtctggggacctaggtagttccacgttctccaaccatccgagccagcctgcagtctaggaacgtattttgacttagtttacttacgtgtacagtactaagttaataatcgtacgttcggtacccttcccgttacggaccgaacgggtacacggtacgtaggaagtaacgttaaacggaacgttggtacggtactcgacctacccgtattccgtgttccttaccg

SEQ ID NO: 250575 - DNA, 502 bp, Homo sapiens
  misc_feature: GYAE6OF01BZWHF.44.65.F10.1.454.CMB.1.raw
tcagacagtatatacacgaccggtgctcgatttagctacgctctaagggggctctggggaggaactgctcagttaggacccagacggaaccatggaagccccagcgcagcttctcttcctcctgctactctggctcccagataccactggagaaatagtgatgacgcagtctccagccaccctgtctctgtctccaggggaaagagccaccctctcctgcagggccagtcagagtgttggcagcagcgtagcctggttccagcagaaacctggccagactcccaggctcctcatctataccacatccaccagggccactggtactcccagccagattcagtggcacgtgggtctgggacagagttcactctcaccatcagcagcctgcagtctgaagtatttgctagtttatactgtcagcagtatagtgactgcctcgttctacgttcggccctgggacctacgagtccgatttacaaacgtactggtaggctgcctaccg

SEQ ID NO: 250576 - DNA, 528 bp, Homo sapiens
  misc_feature: GYAE6OF01AQ63F.44.65.F10.1.454.CMB.1.raw
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttggcagcagcgtagcctggttccagcagaacctggccagactcccaggctcctcatctataccacactccaccagggccactggtatcccagccagattcagtggcacgtgggtctgggacaggagttcacttctcacctatcagcagcctggctagtctagaagtattttgctagtttatacgtntcagctagtataggtnactggtccttcgttcacgtttccggccgtcgggacctacgtagtccgtatttaccgaaacggtacttggtcggtctacgcctaacctgtccgttacg

SEQ ID NO: 250577 - DNA, 511 bp, Homo sapiens
  misc_feature: GYAE6OF01A1WZJ.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaccagcaacttgcctggtaccaccagaaacctgggcaggctcccaggctcctcatctatggaacatccaccagggccactggtactccccacccaggttcagtggcaggtgggtccggacaggagttccactctcaccatcgagcggcctgcagtctgaggtatttgctagtttattactgtcagcagtataatactgctctctcgttcgggcggggactaggtgagagtacaacgtactgtggctgcacatcgtgtcttctactccttcccgctgtctacg

SEQ ID NO: 250578 - DNA, 554 bp, Homo sapiens
  misc_feature: GYAE6OF01D95PT.44.65.F10.1.454.CMB.1.raw
  modified_base (396)..(396): a, c, t, g, unknown or other
  misc_feature (396)..(396): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagagccaccctctcctgcagggccagtcagagtgttagcagcaacttagcctcgtaccagcagaaatctggccaggctccaggctcctcattctatggtgcatcccaccgagggccactggtactcccagccaggttcagtggcaggtgggtctgggacagagttcactctcaccatcagcagcctgctagtctagaagtntttgcttagtttacttactgtactacgaccgtaagtacgtcggtacctactaattattcctacgtttccggacccgttagggaacctaaaggtggtaattacgtaccgaaaacgtacgttggtacggtctacgtacctaacctattctgttccttacg

SEQ ID NO: 250579 - DNA, 491 bp, Homo sapiens
  misc_feature: GYAE6OF01CHFO3.44.65.F10.1.454.CMB.1.raw
  modified_base (196)..(196): a, c, t, g, unknown or other
  misc_feature (196)..(196): n is a, c, g, or t
  modified_base (488)..(488): a, c, t, g, unknown or other
  misc_feature (488)..(488): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttagcctgtaccagcagaaatctggccaggctcccaggctcctcatctatggtgcatccaccagggccactggtatcccagccaggttcagtggcagtgggtctgggacagagttcactctcaccatcagcagcctgcagtctgaagtattttgctagtttattactgtcagctagtataatgactcggcctcccttcggccaggacacgactggaagagttaaacgatggtgctgcaccatctgtcttntac

SEQ ID NO: 250580 - DNA, 833 bp, Homo sapiens
  misc_feature: GYAE6OF01APPB3.44.65.F10.1.454.CMB.1.raw
tcagacagtatatacacgaccggtgctcgatttagctacgctctaaggggaggactgctcagttaggacccagacggaaccatggaagccccagcgcagcttctcttcctcctgctactctggctcccagataccactggagaaatagtcgatcgacgcagtcctccagccaccctgtcctgtgtctccgaggggaaacagccaccctctcctgccagggccagtcagtagtgtaccagtctaacgttagcctaggtacctaccgaagtaaacctgggacacggcctaccccgagggcctccctacacttctatcggaacctactcccgaccgacgggccctacgttcggtaacctcccccgaacccgtagggtttccacggttcggacgtacgggttccgggggtacccgggactagggtacggtttcccaacccgtttccgtacccgaacccgtaacgttacccgaacgggtccccgggtacccttcgggacccgtaacggttccgttacgggtaacgggttaccgtttttcggaccgtttaaggtttttaacgtttaaccgttggttaccgaacggtaccgttaaaggtttaactttaaacgttaaccggttacggtaccccgtttaccgtttaccggttaacccgggttttacccggggggaccgggggggtaacccgttaagggggttacgggtaacggtaaccggtaaccggtaaaaccggtacgttacgggttacgggtccgttaccggtacccgtaaccgtacgttcccgttacgttacccttccgtacccgttccccgttaccccgccttaccgttccgttacg

SEQ ID NO: 250581 - DNA, 593 bp, Homo sapiens
  misc_feature: GYAE6OF01CTCGN.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagcccaccctgtctgtgtctccgaggggaaangcccaccctctcctgcagggccagtcagagtgtagcagcaacttagcctcgtaccagcagaaatcgtggccaggcctcccaggcctcctcattctagtgtcgcactcccacgagggccacgttggtacctcccgagccgtaggttcagtggcgtagggtgggtcgtgggacagtacgttccaactctaccgactatcgagcacgtcctgacgtagtctagaagttatttcgactttaagttttatacgttgtacagtactaagttataagtgtaccgttcggtcccttacccgtacgggaccgaagggtcctaccggtacgtaggaagtaaacgttaaacggaacgttggacggtctacgaccgaaccttagtctttcgtccttaccgttacccg

SEQ ID NO: 250582 - DNA, 721 bp, Homo sapiens
  misc_feature: GYAE6OF01D9E5I.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcaagaaatctggccaggctcccaggctcctcatctatcggaacactccaccgagggccacgtcggtactccccaccgtaggttcaggtcggcgtaggtcggggtaccgggacaggtacggttccacgttcctacaccctatccgaacggccggtcctgccgtaggttccgtaggtacgggttacgtttttcgacgtttaagtttttaacttaccgttggttaccgtaagtaccgtaaagtttaacttaaactttaaccggttcggtaccccttaccgttaccggttacccgggttttaccggggggaacccggggggttaaccgtaaggggttacggggaacgtaacggtaaccgtaaaaccgggtacgttagggttacgggtccgttaggacccgtaacccgtacgttcccgttacggtttccctttacccgtaaccgttttcccccgttccccgtacccttaacg

SEQ ID NO: 250583 - DNA, 582 bp, Homo sapiens
  misc_feature: GYAE6OF01DC9GO.44.65.F10.1.454.CMB.1.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgccaccctctcctgcagggccagtcagagtgttaccagcaacttagcctggtaccacagaaacctgggcaggctccaggctcctcatctatcgtaacntccgaccagggccacgtggtactcccaccgtaggttcagtggcaggtgggtccgganagagttcactctacaccatcagcggcctgctagtctgaggtatttgctagtttattacgtgtcagctagtataatacgtcgtctctacgtacgtttacgggacgggggtaaccgtaagggtacggtaagtacgtacgaaacggtaacgtggtacggtacgtacggtaccgtaaccgtagttccgttcggtcctttacgacttcccttaccccgacctacgtcgttacg

SEQ ID NO: 250584 - DNA, 517 bp, Homo sapiens
  misc_feature: GYAE6OF01D5X4M.44.65.F10.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (472)..(472): a, c, t, g, unknown or other
  misc_feature (472)..(472): n is a, c, g, or t
  modified_base (504)..(504): a, c, t, g, unknown or other
  misc_feature (504)..(504): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagngcccaccctctcctgcagggccagtcagagtgttagcagcaacttagcctcgtaccagcagaaatctggccaggctcccaggcctcctcnttctatggtgcatccaccagggccacgtggtactcccgagcctaggttcagtggcaggtgggtctgggacagtagttcactctcaccatcagcagcctgcagtctagaagtattttgacttagtttattactgtacagctatataatgaccttggcccttccgtcggaccaggacacgatggaanaagttaaacgagttggtcgctgacctactatnttcgtcttgtacc

SEQ ID NO: 250585 - DNA, 550 bp, Homo sapiens
  misc_feature: GYAE6OF01D9Y2U.44.65.F10.1.454.CMB.1.raw
  modified_base (196)..(196): a, c, t, g, unknown or other
  misc_feature (196)..(196): n is a, c, g, or t
  modified_base (287)..(287): a, c, t, g, unknown or other
  misc_feature (287)..(287): n is a, c, g, or t
  modified_base (359)..(359): a, c, t, g, unknown or other
  misc_feature (359)..(359): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctctcctgcagggccagtcagagtgtggcagcaacttgcctggaccacagaacctgggcaggctccagctcctcatctatggtncatccacgagggccacgtggtactcccagcctaggttcaggtggcaggtgggtctgggacagagttcactcncacatcagcagctgcagtctagtaagtattttgcttagtttattacgtgtactagctagtatagtgtacgtcggtccttccgttctaccgtttcggcccgttacgggaccctacgtacgttacgtacgtttaccgaaacggtacttgggtcggtacgtacggtacctaacctagttcttgttcctttaccg

SEQ ID NO: 250586 - DNA, 680 bp, Homo sapiens
  misc_feature: GYAE6OF01B3SDC.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagctcagcttctcttcctcctgctactctggctcccagagatcaccggagatattgtgttgacacagtctccagccaccctgtctgtgtctccgaggggaaanacgccaccctctcctgcagggccagtcagagtgttaccagcaacttagcctggtaccaccagaaaccgtgggcaggctcccgaggctcctcatctatcggaacactccaccgacgggcccactcggtactccccgacctaggttcaggtggcgtaggtcggggtaccggacgaggtagttcactctacacctatcgagcggtaccctgcgagtcctaggtacggttagttttcgacgttaagttttacgttacgtgttacgagtactaaggtaattaaacgttaacgtcgggttacccttaccgttaccgtaccggttttaccgggggaccggggggtaaaccgtaacggggtagggaacgtaccgtaacgaaaaccggttacgtaggtacgggtaccgtacgccgtaaccgtacgtttccgttacggttcctttacctaccgttttaccccgttccccggacccttaagttcccgttaacgg

SEQ ID NO: 250587 - DNA, 545 bp, Homo sapiens
  misc_feature: GYAE6OF01C7SME.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaagggggaggaactgctcagttaggacccagacggaaccatggaagccccagcgcagcttctcttcctcctgctactctggctccagataccactggagaaatagtgatgacgcagtctccagccaccctgtctgtgtctccgaagggggaaangccaccctctcctgcagggccagtcagagtgttaccagcaacttagcctcgtaccagcagaaatctggccaggctccaggctcctcatctagtggtagcactcccaccgacgggccactggtactcccagccaggttcagtgcaggtgggtctggggacaggagttcactctacacatcagctagcctgactagtctagaagttactttgacttagtttatactgtcagcagtataatgactcggacccttccgtcgacgtaggactacgtacgtaggaactaagttaaaacgacttggtacggaccgttaggacctaaccttagttcctggttcctttcgtaaccc

SEQ ID NO: 250588 - DNA, 562 bp, Homo sapiens
  misc_feature: GYAE6OF01D9C2X.44.65.F10.1.454.CMB.1.raw
  modified_base (194)..(194): a, c, t, g, unknown or other
  misc_feature (194)..(194): n is a, c, g, or t
  modified_base (350)..(350): a, c, t, g, unknown or other
  misc_feature (350)..(350): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctcaggggaaangccaccctctcctgcagggccagtcagagtgttagcagcaacttagcctcgtaccagcagaaatctggccaggctccaggctctcatctatggtgcatccacgagggccactggtactcccgagccaggttcagtggcaggtgggtctgggacagngttcactctcaccatcagcagcctgctagtctgaagtatttgacttagttttacttacgtgtacagtctagttataagtcgtacgtcgggtcccttcccgttacggaccgtaacgggtaccacggtacgtcgggtaagtaacgttaaaaccggtaattcgggttcggacgttacggacctaccgtacttcgttacgttccttcgttaacccg

SEQ ID NO: 250589 - DNA, 555 bp, Homo sapiens
  misc_feature: GYAE6OF01BUIW5.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagccaccctctcctgcagggccagtcagagtgttagcagcaacttagcctcgtaccagcagaaatctggccaggctccaggctcctcatctatggtgcatccaccgagggccactggtactcccagccaggttcagtggcaggtgggtctggggacaggtagttccacgtctcaccatcagcacgcctgctagtctagaagtattttgcttagttttattacgttgtcagtctagtataatgacttcggtcccttcccgttacgggaccgtaagggacctaccggtacgtacggaagtaacgttaaacgtaacgtggtcggacctacgacctaccgtattccttcgttccttcgtacc

SEQ ID NO: 250590 - DNA, 621 bp, Homo sapiens
  misc_feature: GYAE6OF01C0545.44.65.F10.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (298)..(298): a, c, t, g, unknown or other
  misc_feature (298)..(298): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagcccaccctgtctgtgtctccgaagggggaaanacgcccaccctctcctgccagggccagtcagagtgtaccngcaacttagcctggtaccacagaacctggcaggctccaggctcctcatctatgaacntccaccgaggccactggtactccccaccgtaggttcaggtcggctaggtcggggtccggatagacgttcacgtctccacatcgagccggctgctagtctgaggttatttgctagtttattactggtcagtctagtaataacgtacgtcggtaccttcgttccgtaccggtttacggggaccgggggtaacctaaggggtggacggtaacgtacgaaacggtacgttaggtacggtccgtacggcctaacccgtacgttccgttacgttcctttaccgtaacccgtttcccgtttacccccggtaccttacgtttccgttaacg

SEQ ID NO: 250591 - DNA, 554 bp, Homo sapiens
  misc_feature: GYAE6OF01B75X2.44.65.F10.1.454.CMB.1.raw
  modified_base (196)..(196): a, c, t, g, unknown or other
  misc_feature (196)..(196): n is a, c, g, or t
  modified_base (370)..(370): a, c, t, g, unknown or other
  misc_feature (370)..(370): n is a, c, g, or t
  modified_base (519)..(519): a, c, t, g, unknown or other
  misc_feature (519)..(519): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaccagcaacttagcctggtaccaccagaaacctgggcaggctcccaggctcctcatctatggaacactccaccagggcccacgtggtactcccaccaggttcagtggcaggtcggggtccggacagagttcactctcaccntcagcggcctgcagtctgaggtatttgctagttattactgtcagcagtcgttccctccgaggtcccgtctccgtaccgtttccggggaccgggggtaccgtaagggtcggagtacgtacgaggacgtaacgtggtcggcgtgacacctntcgttgtccttctacttccttccccgcctcgtccg

SEQ ID NO: 250592 - DNA, 568 bp, Homo sapiens
  misc_feature: GYAE6OF01CW5O2.44.65.F10.1.454.CMB.1.raw
  modified_base (199)..(199): a, c, t, g, unknown or other
  misc_feature (199)..(199): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactgggagaaatagtgatgacgcagtctccagccaccctgtctgtgtctccgagggggaaancgccaccctctcctgcagggccagtcagagtgtaccagcaacttgcctggtacccacagaacctgggacaggctccaggctcctcatcatggaacactccaccagggcccacgtggtactccccacctaggttcaggtggcgaggtcggggtccggacagtacgttcacgtctacaccatcgaggcggctgcagtcgtggagtatttgcttagtttatactgtcagctagtataatacgtcgcctctcgtacgttcggggaccggggtaactagggtaggagtacgtacgaaacggtacgttggtcggctcgacctacctagttccgtacgttccttacctacttcccgtacccgtacctgttcgtacg

SEQ ID NO: 250593 - DNA, 546 bp, Homo sapiens
  misc_feature: GYAE6OF01CNMPF.44.65.F10.1.454.CMB.1.raw
  modified_base (197)..(197): a, c, t, g, unknown or other
  misc_feature (197)..(197): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagagtgtaccagcaattgcctggtaccacagaacctgggcaggctccgaggctcctcatctagtgaacatccaccgaggccacgtgtacctccacctaggttcagtggcaggtcgggtcgganagngtcactcncacatcagcgctgctagtctgtagtatttgctagtttatactgtcagtctagtataatacgtcgtctctcgtacgtttcggggcggggtaacctagggtacgaagtacgtacgaaacggtgtggacggtactcgacgacctacgttcgttagttccttactaccttccctacccgtctacgttcgtag

SEQ ID NO: 250594 - DNA, 554 bp, Homo sapiens
  misc_feature: GYAE6OF01DF68Y.44.65.F10.1.454.CMB.1.raw
  modified_base (302)..(302): a, c, t, g, unknown or other
  misc_feature (302)..(302): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccagggggaaagagccaccctctcctgcagggccagtcagagtgttaccagcaacttagcctggtaccaaccagaaacccgtgggcaggcctcccaggcctcctcatctatggaacnctccaccgagggcccacgtggtactccccacctaggttccaggtcggcaggtcgggtccggacaggtacgttcacgtctcaccgatcgagccggctgctagtctgaggtatttgctagttttatactgtcagctagtataataacgtgcctctcgtacgtttcgggccggggactagggtgagagtacgaaacgtacgtgtaggtctgactacgattcgtacgttcttcgtacttccgtcccnctntcgtag

SEQ ID NO: 250595 - DNA, 507 bp, Homo sapiens
  misc_feature: GYAE6OF01AZ0WH.44.65.F10.1.454.CMB.1.raw
  modified_base (203)..(203): a, c, t, g, unknown or other
  misc_feature (203)..(203): n is a, c, g, or t
  modified_base (314)..(314): a, c, t, g, unknown or other
  misc_feature (314)..(314): n is a, c, g, or t
  modified_base (387)..(387): a, c, t, g, unknown or other
  misc_feature (387)..(387): n is a, c, g, or t
  modified_base (499)..(499): a, c, t, g, unknown or other
  misc_feature (499)..(499): n is a, c, g, or t
tcagacagtatatacacgaccggtgctcgatttagctacgctctaagggggctctggggaggaactgctcagttaggacccagacggaaccatggaagccccagctcagcttctcttcctcctgctactctggctcccagagatcaccggagatattgtgttgacacagtctccaggcaccctgtctttgtctccgagggganagagcccaccctctcctggtacgggccagtcggagtgttgctaagtacctagcctggtaccaacagaaacctggccaggctcccaggctcctcatctatgatgcatccaanagggtcactggcacccagacaggttcagtgcagtgggtctgggacagacttcactctcacgtcagcatgtacngcctagagtatttgctagtttatactgtactagctacgcttccgtcagtccgctctacgttcggcggggacaggtgagctcgagtacgaagtgtcggctgcacatctgtctntcgtcccg

SEQ ID NO: 250596 - DNA, 585 bp, Homo sapiens
  misc_feature: GYAE6OF01A1YJ4.44.65.F10.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttgcctcgtaccagcagaaatctggccaggcctccaggctcctcatctatggtncatcccaccgacgggccactcggtactcccgagcctaggttcaggtggcaggtggggtctggggacaggtacgttcactctcaccatcacgcggcctgcagtcngtagtntttgntagtttatgtgtcagtctaagtataagtgtactcggtcccttccccgttacgggacccgtaacgggactaaccggtacgttacgggaaacgtaaacgttaaaccggtaacgttcggttacgggtacttacgaccaacccgtactttaccgttagtttccctttcgaacttttcccccg

SEQ ID NO: 250597 - DNA, 563 bp, Homo sapiens
  misc_feature: GYAE6OF01DCU2Z.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatcgtggccaggctcccaggcctcctcatctatggtgcatcccaccgagggccacgtggtactcccagcctaggttcaggtggctaggtgggtcgtgggacagtacgttcacgtctcacatcagcagcctgcagtctgaagtatttgacttagtttatacgtgtcagactagttataagtgtactcggtcccttcccgttcggacccaagggacctacgtacgtagggtaagtaacgttaaaccggagttggtcggaccttagacccgtaacctacgttccgttacggtcctttccgtaacccg

SEQ ID NO: 250598 - DNA, 616 bp, Homo sapiens
  misc_feature: GYAE6OF01DFV7X.44.65.F10.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagccacctgtctgtgtctccgaggggaaanacgccacctctcctgcagggccagtcagagtgttaccagcaacttagcctaggtaccacagaaacctggcaggctcccgaggctccnatctatcggaacactccaccgaggcccactcggtactcccaccgtaggttcaggtcggcgaggtcggggtaccggacaggtacgtactactctccaaccatcgacggccgccttgctagtctgaggtatttgcttagtttatactgtacagtactaagtataataacgtggtctcctacgtcgtttacggggcggggtaaccgtaagggacggtaagtaactaccgaaaacggttacgtacgggtcggtccgtaggtaccctaaccgtactttccgtacgtttaccttccggttaaccttccccttaccccggcccttaagttccgttaacg

SEQ ID NO: 250599 - DNA, 656 bp, Homo sapiens
  misc_feature: GYAE6OF01C5BD0.44.65.F10.1.454.CMB.1.raw
  modified_base (197)..(197): a, c, t, g, unknown or other
  misc_feature (197)..(197): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
tcagacagtatatacacgaccggtgctcgatttagctacgctctaagggggaggaactgctcagttaggacccagagggaaccatggaagccccagctcagcttctcttcctcctgctactctggctcccagagatcaccgggagattattgtgttgacacagtctccaggcaccctgtctttgtctccgagggganagagccaccctctcctggtagggccaggtcggagtgttgctaagtacctagcctggtaaccaacacgaaacctggccaggcctcccaggcctcctcatctatgatgacatccaacagggtcacgtggcaccccagacaggttcagtggcaggtggtctgggacngacttcacgtctcaccgtnagtacaatcgtacagtcctagtaacgtattttagacttaagtttattaacgttgtacagtactacgtccgtttacctccgtacggtccgtccgttccgtaacccggtttttccgggggaccgggggggtaacccgtaaggggtacgggtaacggtacgtacggaacggtaaaccggtaaacgttcgggtacgggtacgtacggtaccgtaacccgtacgtttaccgttacgttaccctttacgtaaccttttccccgtccccggttaccttaacgg

SEQ ID NO: 250600 - DNA, 693 bp, Homo sapiens
  misc_feature: GYAE6OF01C0ZJD.44.65.F10.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctntcctgcagggccagtcagagtgtaccagcaacttagcctggtaccacagaacctggcaggctccgagcctcctcatctatggaacntcccacgaggccacgtgtactccccaccgtggttcaggtggcaggtcggggtccgganaggagttcactctaccacatcgagccggcctgcctagtccgtaggtacggttattttcggacgttaagtttttaacgttacgttcgttacgtaaggtaccgttaaaggttaactaaacgttaaccgttcgggttacccttaccgttaccgttaaccgggttttcccgggggaaccggggggtaaccctaaggggtacggtaacgtaacgtaccggaaaaaccggtacggttcggtacgggtaccgtacggacccgtaaaccgttacgtttaccgttaccggtttaccctttacccgtaacccgtttcccccgttacccccgtaccttacgttccccgttaag

SEQ ID NO: 250601 - DNA, 593 bp, Homo sapiens
  misc_feature: GYAE6OF01ER8HK.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagngccaccctctcctgcagggccagtcagagtgttggcagcagcgtagcctggttccagcagaaacctggccagacctcccaggcctcctcatctactaccacactcccaccgaggcccacgtggtactcccagccagtacttcgagtcggcaggtgggtcgtgggacaggtagttcactctacacctatcacgcacgcctgctagtctagtaagtatttgacttagtttacttacgttagtactaaccgtaccgtacgcgtacgtcggtacgtacggtacttaggtttacggaccggtacggggtaccaacggtcgtacggtacgtaccgtaacgtaaaccggtaacgttacggtacggtaccgtacggaccctaaccgtcgttccgttggttaccc

SEQ ID NO: 250602 - DNA, 797 bp, Homo sapiens
  misc_feature: GYAE6OF01BOBYC.44.65.F10.1.454.CMB.1.raw
  modified_base (301)..(301): a, c, t, g, unknown or other
  misc_feature (301)..(301): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctgtgtctccgaggggaaagacgccaccctctcctgcagggccagtcagagtgtaccagcaacttagcctaggtaccacagaacctgggacaggctccgaggcctcctcactctagtacggaacnctcccacgacgggccacgtcggtactaccccgaccgtaggttcgacggttggccgtagggtcgggggtaccggaactacggtacgttaccaccttacctccaacccagtaccgaacgggtcccgggacccttcggaccgttacggttccgttacgggtaggtttacgtttttacgggtacctttaaggtttttaacgtttaaccgttcggttacctaacggtaacgttaacggtttaaactttaaacgttaacccggttcgggtacccttacccgtttaccggttacccgggttttaccggggggacccgggggggtaaccgttaaacgggggttcggtaaacgggtaaccgtaaaccggtaaaacccggtaacggtttacggggtaccgggtaccgttaccgggtaccctaaccccggtagttacccgttcgtttacccgtttaccgtacccgtttaccccgtttacccgggcccttaagtttcccgtttaacgg

SEQ ID NO: 250603 - DNA, 541 bp, Homo sapiens
  misc_feature: GYAE6OF01EI5Y2.44.65.F10.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangcccaccctctcctgcagggccagtcagagtgttagcagcaacttgcctcgtaccagcagaaatctggccaggctccaggctcctcatctatggtncactcccacgagggccactggtactcccgacctaggttcagtggcaggtcggggtacccgganaggtacgttcaacctctccgaaccagtccaggccggcctgctagtcgtgtacggttatttcgcttagtttattactgtcagtctagtataatactcgtcctctcgtacgttcgggcggggtacaggtgagtagtacgaaacgtacgtggtggctcgcacatcgtgttcttctactccttcccgtc

SEQ ID NO: 250604 - DNA, 625 bp, Homo sapiens
  misc_feature: GYAE6OF01BFJTC.44.65.F10.1.454.CMB.1.raw
  modified_base (319)..(319): a, c, t, g, unknown or other
  misc_feature (319)..(319): n is a, c, g, or t
  modified_base (341)..(341): a, c, t, g, unknown or other
  misc_feature (341)..(341): n is a, c, g, or t
  modified_base (388)..(388): a, c, t, g, unknown or other
  misc_feature (388)..(388): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccaggcaccctgtctttgtctccgaggggaaagagccaccctctcctgcagggccagtcagagtgttgacaccaccaccagcttcttagcctggtaccagcagaagcctggccaggctcccaggctcctcatatacgatgcatccagcaagccgntggcatccagacagtcagtgcngtggctgggacagacttcgactctacagactatcgaagcggtaacgngggtacggccttaggacggtacttttcgaggtacgttacgtttttaacgttaccgttggttacgtaacgtcgtaacggtttaggttcggggtttacgttaccctacccgttcgttacggttacccggttcccgggtaaccgtaaacgggggtacccgtaaagggttcgggtaaaaacttacccggaaaaacggttacgttaacggtacggaacgtttcggacctaacccggttaacg

SEQ ID NO: 250605 - DNA, 525 bp, Homo sapiens
  misc_feature: GYAE6OF01BX8AT.44.65.F10.1.454.CMB.1.raw
  modified_base (198)..(198): a, c, t, g, unknown or other
  misc_feature (198)..(198): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaaangccaccctctcctgcagggccagtcagagtgtaccagcaacttgcctggaccaccagaaacctgggcaggcctcccaggctcctcatctatggaacatccacagggccactggtactcccacccaggttcagtggcaggtcggggtccgganagacgttcacgtctcacntcagcggcctgcagtctgagtatttgctagtttattactgtcagtcagtataatacgtcgcctctcacgtttcgggcggggtacaagggtgagagtacaaacgtacgtgtggctgactacgatctgtcttctacttcccttacccgctacgtctacg

SEQ ID NO: 250606 - DNA, 543 bp, Homo sapiens
  misc_feature: GYAE6OF01ED6DZ.44.65.F10.1.454.CMB.1.raw
  modified_base (196)..(196): a, c, t, g, unknown or other
  misc_feature (196)..(196): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaangccaccctctcctgcagggccagtcagagtgtaccagcaacttagcctggtaccacagaaacctgggcaggctcccaggctcctcatctatggaacatccaccgagggcccactggtactcccaccgaggttcagtggcaggtcggggtccggacaggtacgttcactcctacaccatcaggcggcctgcagtctgaggtattttgcttagtttattacgttgtacagtctagttaataataactgtccttctctacgtttcgggacgggggtacaagggtggagatacgaaacgacgtgtggcgtcgcacattcgtgtcttactacttccttcccnctnttcgtag

SEQ ID NO: 250607 - DNA, 574 bp, Homo sapiens
  misc_feature: GYAE6OF01DA161.44.65.F10.1.454.CMB.1.raw
  modified_base (198)..(198): a, c, t, g, unknown or other
  misc_feature (198)..(198): n is a, c, g, or t
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccatggagaaatagtgatgacgcagtctccagccaccctgtctgtgtctccgaaggggaaaancgcccaccctctcctgcagggccagtcagagtgttaccagcaacttagcctggtaaccaccagaaacctggcaggctcccaggctcctcatctatggaaacatccaccagggcctactggtactcccaccgtaggttcaggtggccaggtcgggtccggaacagtcgttcactctcaactancagcgcctgcagttcngagtntttgctagtttactactgcagctaagtaataaataacgtggccttactacgtacgtttcggggacgggggtaacctaaggggtaggacgtaactacgaaaacgtagtcggtggcttaggaccacctagtccttcgttccttactaacttccccttacccgcctattccgtaag

SEQ ID NO: 250608 - DNA, 591 bp, Homo sapiens
  misc_feature: GYAE6OF01BTKR9.44.65.F10.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (420)..(420): a, c, t, g, unknown or other
  misc_feature (420)..(420): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangcccaccctctcctgcagggccagtcagagtgtagcagcaacttagccctcgtaccagcaagaaatctggccaggcctcccaggctcctcatctatggtncactccacagggccactggtactcccgagccctaggttcaggtggcaggttgggtctggggactaggtgttccactctaccgaccacttcgacgcacgtcccgtagctagtcctagtaagttnttttcggactttagttttactacgttgtacgagtcgtaagttataagtcgtaaccgtcggtacccctttcccgttcgggacctaacgggactaacggtacgtaggtacgtaaagtaaaccggtacttggtcggtactcgaacctaccgtattcctgtttccctgttacccg

SEQ ID NO: 250609 - DNA, 636 bp, Homo sapiens
  misc_feature: GYAE6OF01BKQFM.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctctgtctccgaggggaaancgccaccctctcctgcagggccagtcagtagtgttggcagcagcgtagccgtggttacagtacgaacctggccagacctcccgaggcctcctcattcctaactacccactactacccaccgacgggcctaacgtcggtacctccccgagtcccaagtacttcgacggtcggacctacggttcggggtctaggggactaaggtacgtttccaacgtctaccaacctataccagccacggtcctagacgtacgttcgtaggtaacgtacttttgaccttaaggttttactacgtacgttcagtactaagttaatagtcgtaccgtcggtccccttaccgttcggaacccgaacgggtaccacggtacgtagggaactaaagttaaaccggagttcggtcgcgtacgaccgtacctagttccgtacgttccttacgtacccg

SEQ ID NO: 250610 - DNA, 589 bp, Homo sapiens
  misc_feature: GYAE6OF01C3VUD.44.65.F10.1.454.CMB.1.raw
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (271)..(271): a, c, t, g, unknown or other
  misc_feature (271)..(271): n is a, c, g, or t
  modified_base (337)..(337): a, c, t, g, unknown or other
  misc_feature (337)..(337): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctgtgtctccaggggaaangccacctntcctgcaggccagtcagagtgtaccagcaacttgcctggtaccacagaacctggcaggctccagctcnatctatggaacactccaccaggccagtgtactcccacctaggttcagtggcaggtcgggtccgganaggtacgttcactccgtacaccatccgacgtcggcctgctagtctaggaacgtattttacgcttaagttttatactcggtcagtcctaagttatagtgtactggtcccttcgtttcctaccgtttccggacccttcgggacctacgtaggttccgtaacgtttaccgaaaacgtaccgttaggtcggtacctacggtactacccgtatttacccgttcgttactttaccagtttccccttcccgccttaacg

SEQ ID NO: 250611 - DNA, 542 bp, Homo sapiens
  misc_feature: GYAE6OF01D1XN1.44.65.F10.1.454.CMB.1.raw
  modified_base (197)..(197): a, c, t, g, unknown or other
  misc_feature (197)..(197): n is a, c, g, or t
  modified_base (364)..(364): a, c, t, g, unknown or other
  misc_feature (364)..(364): n is a, c, g, or t
  modified_base (409)..(409): a, c, t, g, unknown or other
  misc_feature (409)..(409): n is a, c, g, or t
  modified_base (488)..(488): a, c, t, g, unknown or other
  misc_feature (488)..(488): n is a, c, g, or t
  modified_base (503)..(503): a, c, t, g, unknown or other
  misc_feature (503)..(503): n is a, c, g, or t
  modified_base (513)..(513): a, c, t, g, unknown or other
  misc_feature (513)..(513): n is a, c, g, or t
  modified_base (537)..(537): a, c, t, g, unknown or other
  misc_feature (537)..(537): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctgtgtctccgagggggaaangcccaccctctcctgcagggccagtcagagtgttaccagacaacttagcctcggtaccaccagaaaccgtgggcaggctcccaggctcctacatctatcggaacactccaccgacgggccacgtggtactccccaccgtaggttcagtggcaggtcggggtccgganagtcgtcactctacactatcgacgcggcctgacagtcgtgtagtntttgacttagtttactgtgtacagtctagttaataactacgtcgtctctacgttcggttcggggcggggactaggtganatacgaacgtagtgngactgctacntcgtctctactactcctaccgctntctag

SEQ ID NO: 250612 - DNA, 520 bp, Homo sapiens
  misc_feature: GYAE6OF01BIWHW.44.65.F10.1.454.CMB.1.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (343)..(343): a, c, t, g, unknown or other
  misc_feature (343)..(343): n is a, c, g, or t
  modified_base (514)..(514): a, c, t, g, unknown or other
  misc_feature (514)..(514): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaccagcaacttagcctggtaccacagaaacctggcaggctccaggctcctnatctatgaacatccaccaggccatggtactcccaccaggttcagtggcaggtgggtccgganagagttcactctcaccatcagcggcctgcagtctgaggtattttgactagtttatactgtcagcagtataataactggcctctcgtacgtttcgggcgggggacctaagggtggaagagtacaaacgtactgtaggctcggcaccatcgtgtcttcacttccttcccgctntcgtag

SEQ ID NO: 250613 - DNA, 587 bp, Homo sapiens
  misc_feature: GYAE6OF01A13SW.44.65.F10.1.454.CMB.1.raw
  modified_base (197)..(197): a, c, t, g, unknown or other
  misc_feature (197)..(197): n is a, c, g, or t
  modified_base (387)..(387): a, c, t, g, unknown or other
  misc_feature (387)..(387): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagccaccctctcctgcagggccagtcagagtgtagcagcaacttgcctcgtaccagcagaaatctggccaggcctccgaggcctcctcatctatggtcgcactcccgaccgagggcccacgtggtactcccgagcctaggttcaggttggcagggtgggtctggggactagtcgttacacgtcaccgacnctccgagcacgcccgtgactaggtccttaggtaacgttattttcgacttagtttacttacgtgtacgagtactaagttaataacgtgacgtcggtacccttccgtcggaccgacggtaccgacgtacggtaggtaagtaacgttaaacggagttcggtacggtcgtacgaccgtaccattcgtacgttccttcgttaccg

SEQ ID NO: 250614 - DNA, 638 bp, Homo sapiens
  misc_feature: GYAE6OF01ERB9X.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttagcctcgtaccagcagaaatctggccaggctccaggctcctcatctagtggtgcactccaccgagggccacgttggtactcccgagccaggttcagtggcaggtgggtctgggacaggtacgttcactctccaccatccagcacgcccttgcctagttcctagtaacgttagtttttgactttaggtttttattacgttcgtcgtaagtactaggttaattaacgtaggtaccgtcggttccccgttaccccgtttacgggaacccggtaacgggaccctaaccgggtaaccgttacgggaaacggttaaacgtttaaaacccgggtaaggttcgggtacgggtaccttacgggaaccctaccgtacgtttacccttcgtttcccgttccttaccccg

SEQ ID NO: 250615 - DNA, 586 bp, Homo sapiens
  misc_feature: GYAE6OF01EUFAK.44.65.F10.1.454.CMB.1.raw
  modified_base (196)..(196): a, c, t, g, unknown or other
  misc_feature (196)..(196): n is a, c, g, or t
  modified_base (352)..(352): a, c, t, g, unknown or other
  misc_feature (352)..(352): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagcccaccctctcctgcagggccagtcagagtgttaccagcaacttgcctggaccacagaacctggcaggctcccaggctcctcatctatggaacactccaccgagggcccactggtactcccaccctaggttcagtcggcaggtgggtaccgganagtagttcactctcacatcgagcggctgcagtctgaggtatttgcttagtttatactgtcagtctaagtataacgtaactcggtcctcgtacgtacgtttcggggaccgggggtaacctaagggtcggagtacgtaccgaaaacgaccgttaggtcggactcggacctaaccgtattccgtagtttaccttaccgtacgtttacccttacccccggaccttaagttccgtaacg

SEQ ID NO: 250616 - DNA, 739 bp, Homo sapiens
  misc_feature: GYAE6OF01BLZP7.44.65.F10.1.454.CMB.1.raw
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagccaccctgtctgtgtcgtccggggaacacgccaccctctcttgcgagggccggcagactgttgacgacgacttagcctggtaccaacagaagcctggccaggcctcccagtacctcctcatctatgatgacataccaacgacgggtccacgtcggaccaccccgagacgtaggttcaggtggcgtaggtcgggtcgtagggactagtaccttcacctcctaccgaccgtacaacggtacctaagttaccgtaacgtacgtaccgttaggtaaacgtttactttttaggtaacgtttaacgtttttaaacgtttaccgttacggttacctaacggtaccgtaaccggttcccgtttacccccgtacccggtacgggtccccgtacccgttccggtttacccggggtttaccggggggtaaccggggggaaccgtaacggggtacgggtaacgtacgttacggaaccgggtaacgtaacggttcgggtacgggtacgtacgggaccctacccggttacttaccggttcgtttacccgttaccttacccggtttccccgttcccccggtaccc

SEQ ID NO: 250617 - DNA, 579 bp, Homo sapiens
  misc_feature: GYAE6OF01CFEQ9.44.65.F10.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (356)..(356): a, c, t, g, unknown or other
  misc_feature (356)..(356): n is a, c, g, or t
  modified_base (387)..(387): a, c, t, g, unknown or other
  misc_feature (387)..(387): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttaccagcaacttgcctggtaccacagaacctggcaggctccgaggctcctcatctancggaacactcccacgacgggccacgtgtactccccaccgtaggttcaggtgctaggtcggggtccgganaggtagttcactctccactatcagcgctgcngtctgagtagtttgctagtttacttacgtgtacgagctagtaataactacgtcgtccttacgtcgtacggtttacgggacgggggtaccgtagggtacggagtaacgtacgaaacgtacgtggtacggtcgtacgccgtactacttcgttacgttcctttacgtacttcccgttacccgcctcgttcgtacg

SEQ ID NO: 250618 - DNA, 586 bp, Homo sapiens
  misc_feature: GYAE6OF01BQEI3.44.65.F10.1.454.CMB.1.raw
  modified_base (197)..(197): a, c, t, g, unknown or other
  misc_feature (197)..(197): n is a, c, g, or t
  modified_base (353)..(353): a, c, t, g, unknown or other
  misc_feature (353)..(353): n is a, c, g, or t
tcagacagtatatacacgaccggtgctcgatttagctacgctctaagggggaggaactgctcagttaggacccagagggaaccatggaagccccagctcagcttctcttcctcctgctactctggctcccagataccaccggagagattgtgttgacgcagtctccagcccaccctgtctttgtctccaggggaaangccaccctctcctgcagggccagtcagagtgttagcagctacttagcctggtaccaacagaaacctggccaggcctcccaggcctcctcatctatggtgcatccaacgagggccacgtggcactccccagccaggttcaggtggctaggtgggtcnggggacagtacttcactctacaccatcagcacgcctagacgcctagaagttatttgacttaagtttagtgtacgttgtacagcagtcgtaagctaacgtcggtaccgtataccgtaccgttcgggaccgaacgggaccaacggtaacgtagggaaagttaacgttaaaaccggtaacgttcggtacggaccttaggaccctaccgtacgttccgtcgtttccttccgtacccg

SEQ ID NO: 250619 - DNA, 596 bp, Homo sapiens
  misc_feature: GYAE6OF01BQMTF.44.65.F10.1.454.CMB.1.raw
  modified_base (196)..(196): a, c, t, g, unknown or other
  misc_feature (196)..(196): n is a, c, g, or t
  modified_base (454)..(454): a, c, t, g, unknown or other
  misc_feature (454)..(454): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccaccggggaaattgtgttgacacaatctccagccaccctgtctttgtctccaggggaaangccaccctctcctgcagggccagtcagagtgttaggaactacttagcctggtatcaacagacaccgtggcccaggcctcccgaggcctcctcatctatgatgcatccaaagtcggggcccgcgggcacgtcccagcccagggttcaggtggctaggtcgggtctggggacaggtacgttcactctcacctatcagcagcctgctagtctagaagttatttgacttagtttatacgttgtacagctaagtattttaagngtacgttcggcccttcccgttacggaccgtaagggacctacggacgtaggaacgtaacgttaaacgacgttgggtcgtaccgtagacctaaccgtagttccgttcgttaccttactaacctttcccgttaccccgtctaacg

SEQ ID NO: 250620 - DNA, 530 bp, Homo sapiens
  misc_feature: GYAE6OF01BA9J6.44.65.F10.1.454.CMB.1.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (346)..(346): a, c, t, g, unknown or other
  misc_feature (346)..(346): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaccagcaacttagcctggtaccacagaaacctgggcaggctcccaggctcctnatctatggaacntccacaggccatgtactcccaccaggttcagtggcaggtcggggtaccgganaggagttcactctcaccatcgagcggcctgctagtctgagtatttgactagtttatactgtcagtctagtataatacgtcggtctctctacgttcgggacggggtacctagggtaggagtagtacgaaacgtacgtgtcggcgtgctacactcgtgtcttctacttcttcccgctacgtctacg

SEQ ID NO: 250621 - DNA, 539 bp, Homo sapiens
  misc_feature: GYAE6OF01B9G7Q.44.65.F10.1.454.CMB.1.raw
  modified_base (197)..(197): a, c, t, g, unknown or other
  misc_feature (197)..(197): n is a, c, g, or t
  modified_base (349)..(349): a, c, t, g, unknown or other
  misc_feature (349)..(349): n is a, c, g, or t
  modified_base (387)..(387): a, c, t, g, unknown or other
  misc_feature (387)..(387): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccagggggaaangccaccctctcctgcagggccagtcagagtgttaccagcaacttgcctggtaccacagaaacctgggcaggctcccaggctcctcatctatggaacatccaccagggcccactggtactccccaccaggttcagtggcagtggggtccgganagagttcactctcaccatcagcgcctgcagtctgagtntttgctagtttattactgtcagtctagtataatactcggcctctctacgtttcgggcgggggtacctagggtggagtagtacgaaacgtacgtggtcggctagcctactactcgtcgttccttacgtacttccttaccccgcctgtcgtacg

SEQ ID NO: 250622 - DNA, 665 bp, Homo sapiens
  misc_feature: GYAE6OF01APFDZ.44.65.F10.1.454.CMB.1.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcggtctccagccacctgtctgtgtctccaggggaaanagccaccctctcctgcagggccagtcagagtgttagcagcaacttagcctcgtaccagacagaatctggccaggcctccaggctcctcatctagtggtnctactccgaccgagggccacgtcggtactcccagaccgtaggttcgaggtcggacgtagggtcgggtacgtacgggactactagtttaccactctaccgtaccgtcacgactaacgtgtaacgtacgtccgtagtaacggttagttttgtacgttaagtttacttacgttgttacgacgtccgtaacgtccgtttacccgtaccgaccggtcccgtacgtaccgttaccgggtttaccggggacccggggggtaaccgtaacgggtacgggtaacggtacgtaccgaacgggacgttaaaccggttgggttacggccgttacgtacccgtaccgtacttcgttacgttcctttaccgtaccgttccccgg

SEQ ID NO: 250623 - DNA, 592 bp, Homo sapiens
  misc_feature: GYAE6OF01DOPXQ.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctcgaggggaaagagccaccctctcctgcagggccagtcagagtgttagcagcaacttagcctcgtaccagcagaaatctggccaggcctccaggcctcctcatctagtggtgcactcccaccgacgggccacgtggtactcccgacgccgaggttcaggtggcgaggttgggcgtgggactagtagttcactctcaacctatcagcacgcctgctagtctagtaacgttattttgacttaggtttacttacgtgtcagtactagttaattaagtgtaccgttcggtccccttcccggttaccgggaaccgaacggggacctaaccggtacgtacgggtaagtaaacgttaaaacggacttgggtacggacttcggacctacctattccgttcgttcttccgttaaccg

SEQ ID NO: 250624 - DNA, 613 bp, Homo sapiens
  misc_feature: GYAE6OF01A06YM.44.65.F10.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
tcagacagtatatacacgaccggtgctcgatttagctacgctctaagggggtaggaactgctcagttaggacccagacggaaccatggaagccccagcgtcagcttctcttcctcctgctactctggctcccagatacccatgggagaaatgtgatgacgtcagtctcagtccacctgtctgtgtctcgagggaancgccacctntcctgcgaggccagtcagacgtgtaccngcaacttgcctggaccacgagaacctgggcaggcctccgaggtcctacctcatcctatggaacacgtcccaccggacggccacgtcggtacctacccgaccgtagggttcacggtggcgtaggtcggggtaccggacagggtacgttcgactccgtacaaccgtaatcgacggtccggcctgcgtacgtcgtagtagttctttcgtacttagtttatacgtgtacagtctaagtaattaactacgtcgtccttacctagtaccggtttcggggacggggtaacctaagggttcggaagtaacgtaccgaaacggtacgtgcggtactacgtacctactcgttcgtcgttcttacgtacttccgtaccggctagtcgtaag

SEQ ID NO: 250625 - DNA, 704 bp, Homo sapiens
  misc_feature: GYAE6OF01EA85W.44.65.F10.1.454.CMB.1.raw
  modified_base (200)..(200): a, c, t, g, unknown or other
  misc_feature (200)..(200): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagcccaccctgtctgtcgtctccgaaggggaaancgcccaccctctcctgcagggccagtcagtagtcgttaccagacctaaacttacgccttacggtaacccaaccgaaggaaacccgtgggaccacgggtccctccccgaaggtccttccctactaacttccgtaagttcggggtcacctaaccgttaccccgaacccggtaacggggcccctaacgttcgggttaacctcccccgaaggtcccgtagggtttccagggttcgggaccgtagggttcggggtcgtaggggaactaggtacgtttaccaccttcctaccacctatcgacgtccacgtcctagacctagttcgtaagtaagtttctttgactttagtttattacgtgtacagtactaagttactaatcggaacgttccgtacccttccggtacggaaccgtaagggaccacgtacggtagaacgttaaacgtaaacgtgttcggtacggtactcgacctacttacgttcgttacgttaccttctcccttcccgtaccc

SEQ ID NO: 250626 - DNA, 593 bp, Homo sapiens
  misc_feature: GYAE6OF01C6V5C.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgattacgcagtctccagccaccctgtctgtgtctccgaggggaaancgcccaccctctcctgcagggccagtcagagtgttaccagcaacttagcctggtaccaccagaaacctggcaggctcccagctcctcatctatggaacactccaccgagggccactggtactcccaccaggttcagtggcaggtgggtccggacagacgttcactctacacatcagccgcctgcagtctggagtattttgctagtttattactgtacagtctagtataatacctggtcccttacgtccgtacggtttccggggacggggggtaaccctaagggggtggaagtacgtaacgaaacgtaacgttggtacggcgtacgaccgtacctagttcttcggttcctttacgtaccgtttccccttaccccgccttaacttcccgttaagtaac

SEQ ID NO: 250627 - DNA, 810 bp, Homo sapiens
  misc_feature: GYAE6OF01B19PM.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcgagggtgttggcagcagcgtacgcctggtccagcaagaacctggaccagacctccgaggcctcctctactctactaccacactcccaccgacgggacccacgtcggtacctacccagcccgaagtactttacgacggtcggccgtacggttcggggtaccgtaggggaacctaaggtacggtttacccaccgttccttacccgaacccctaacgttcccgaacgggtccctaaccgggtaccccgttcggtaccgtaacggtttacccggtaaggttaaacggtttacgtttttacggtacgttttaacggttttttaactttaccgtttacggttaccgtaacggtacgttaaaggttttaacggtacggttaccggtaccggtttcccgggttacccccgttttacccggttttaacccgtttacccgggttttccccgggtacccccggttaccggggtacccctaaaccggttaccggtttaccggttaacgtttttaaccccggaaaacggttacccgtttacggggtaccggttacccgtacggtacccctaaacccgttctttacccgttcggtttacccc

SEQ ID NO: 250628 - DNA, 625 bp, Homo sapiens
  misc_feature: GYAE6OF01DB23Z.44.65.F10.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
tcagacagtatatacacgaccggtgctcgatttagctacgctctaagggggaggaactgctcagttaggacccagacggaaccatggaagcccagcgcagcttctcttcctcctgctactctggctcccagacaccactggagaaatagtgatgacgcagtctccagccaccctgtctctgtctccgaggggaaagngccaccctctcctgcagggccagtcagngtgttggcagcagcgtagcctggttccagcagaacctggccagactccaggctcctcatctactaccacactcccaccagggccacgtcggtactcccagccagtattcgagtcggctacgtgggtctgggacaggtacgttccactccgtacaccattcaacgtccacggtcctggacctaggttctaggtaaacgtattttcgacttaacgtttttaacttacgttcgttacaacggtacttaagttaacgttacggttacggtaccgttcggtacccgttacccgtttacgtaccggttttccgggaccccggttacgggacccgtacgtacggttaccgtaattttaccgaaacgtacgttggtcggtactacggaccctacgtcgttcgttaccg

SEQ ID NO: 250629 - DNA, 542 bp, Homo sapiens
  misc_feature: GYAE6OF01CHGZW.44.65.F10.1.454.CMB.1.raw
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctccaggctcctcatctatggtgcatccaccagggccactggtactcccgagccaggttcaggtcggcaggtgggtctgggacaggngttcactctcaccatcagcacgcctgcacgccgtggagtntttcgcgtacttagttactcgaccaaactattactttcttttacgtccgttagtcgttttcgccgtaggggacctagtcgtggacgtatacgaaagggtacttggtacggtcacgcaccgtacttcttagtccttcacgttcccg

SEQ ID NO: 250630 - DNA, 722 bp, Homo sapiens
  misc_feature: GYAE6OF01C27JP.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcggtctccagccacctgtctgtgtctccgaaggggaaancgcccaccctctcctgcagggccagtcagagtgttagcagcaacttgcctcgaccagacagaaatcgtggccaggcctcccgagcctcctacatctactaccagactcccaccgacgggccaacgtcggtacctcccgagccaaggtctcgagtcggacacgttggggtcctaggggactaggtacgtttccacgtttaccaccgaacctacgtccgacgtaccgtaacggcccgttagaccgtaacggttcttaagggtaaacgtttacgttttcggacctttaaggtttttaactttacgtcgttaacgtagtacctaaggtttaacttaacgttcggtaacccgtttccggggttacccccttacccgggtttaccggaacccggtaacggggtacctaaccgggtaacggttagggaaacgttaaacgtttaaaaccggaggtttacggtacgggtacccttaacgtacccgtaacccgtttaagttcccgtttacggttcccctttacggttaaccccg

SEQ ID NO: 250631 - DNA, 563 bp, Homo sapiens
  misc_feature: GYAE6OF01EVKZ3.44.65.F10.1.454.CMB.1.raw
  modified_base (197)..(197): a, c, t, g, unknown or other
  misc_feature (197)..(197): n is a, c, g, or t
  modified_base (367)..(367): a, c, t, g, unknown or other
  misc_feature (367)..(367): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttaccagcaacttagcctgtaccaccagaaacctgggcaggcctcccgaggcctcctcatctattcggaacatcccaaccgaggggcccacgtcggtactccccaccaggttcagttcggctaggtgggtacccgganaggtgttccactctccactatcacgcggcctgcagtctgagtatttgctagtttatactgtcagctagtataatactgtacctgtacgtacgtttcggggaccggggtactaagggttcgaagacgtacaaacgtacgtgtcggcgtgccctacgtactcgttactcttcctacttccttaccccgctatcgtacg

SEQ ID NO: 250632 - DNA, 704 bp, Homo sapiens
  misc_feature: GYAE6OF01D4NIA.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggcctcccagataccactggagaaatagtgatgacgcagtctccatcccaccctgtctgtcgtctacgaaggggaacgacgcccaccctctcctgcgacgggccagtcagtagtcgtaccgagactaacgttcgccgtacggtaacccaccgaacgaaaccgtgggacgacggcctacccgtaggcctacctactatctagtacggacacgtcccaccggtacggaccctacgtacggtacctccccgaacgtacggttcgaggtcggacgtagggttcggggaccggacgtagggtacgtttccaaccgttccacctaacccgagttaccgacgggtcccggtccgttagaccgttacgtccgttagggtaacggttagttttcgacgtttagtttaacgttacgtgtacgacgtactaagttaataacgtaccgtcgtacctcgttaccgtccgggtttccggggacgggtacgtaagggtacggaagtaaccgtacgaaacggtagtcggtacggactcgacccgtatcgttactcgttacctaccgttaccttcccgacccgtctaagttcgtaacg

SEQ ID NO: 250633 - DNA, 698 bp, Homo sapiens
  misc_feature: GYAE6OF01D3W44.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggagaacctgctcagttaggacccagacggaaccatggaagccccagcgcagcttctcttcctcctgctactctggctcccagactaccactggagaaatgtgatgacgcggtctccagccaccctgtctgtcgtctccaggggaaancgcccaccctctcctgccagggccagtcagtgtgttagccagccaaactttgccctacgtaccagacagaaactcgtggccaggcctcccaggcctacctcattctagtcggttgcactcccaccgacgggcctaacgttgtactccctagccgtaggtcaggtgcgtagtcgggtctagggactacggtacgttccgactctacgacctacgttaccgacgtaccgaacgtcccgtacgtaccgtaacgttacctaaggtaaacgttaagttttttaccggaccgttttaaggttttttaaccttaaccgttaggttacctaacgggttaccttaaacggttaattaaaaccgttgggtaaacccgtttcgggtacccccgtttacccggtttacccggaacccggtaaacgggacctaaccggtaacgtcggtaacgaaccgtttaaaccgaacgtcggtacgcctcgaccgtacctacgtctcgttccgtcttacccg

SEQ ID NO: 250634 - DNA, 913 bp, Homo sapiens
  misc_feature: GYAE6OF01CLB68.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttaccagactaacttagcctacgtaccagacaagtaaactcgtggaccaggcctacccgagggtccttcccgtactaacttaccgtaagttcggggtacgacctaacgttaccccaacccggaacgggggacccctaaccggttacgggttaacccttacccccgaacggtaccccgttaaggggttttccgaacggggttcgggaccgttaagggggttcgggggttaccgttaggggggaaccctaagggttaacggttttacccgaaccgtttacccgttaacccgaaacccgtaaacgttacccgaacgggtacccgtaaccgggtaccccttagggaccctaaagggtttcccgttaaagggtaaaacggtttaacgttttttggaaccctttaaagggtttttttaacttaaccgttacggttaccgtaaaggtccgtaaaaggtttaacttaaagttaccggtaaccgtttccgggttaccccccgtttaccccggtttaacggggaaccccggtaaaacgggggaccctaaaccggggtaaccggttaaacggggtaaaacgttaaaaccggttttaaaaacccgggaaccggttttggggtaacccgggttaccgttacggaacccgtaaaccccttagtttacccggtttcggtttaccctttaccgtaacccg

SEQ ID NO: 250635 - DNA, 717 bp, Homo sapiens
  misc_feature: GYAE6OF01CXGYV.44.65.F10.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (329)..(329): a, c, t, g, unknown or other
  misc_feature (329)..(329): n is a, c, g, or t
  modified_base (447)..(447): a, c, t, g, unknown or other
  misc_feature (447)..(447): n is a, c, g, or t
  modified_base (633)..(633): a, c, t, g, unknown or other
  misc_feature (633)..(633): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggaagaaatagtgatgacgcagtctccagcccaccctgtctgtgtcgtccggagggaaacncgcccaccctntccgtgacgacggcctagtccgagtacgttcgtaaccagacctaacgttacgccttacggaacccacgaaacggaaaccgtcggggacaacggtcctacccgaggtccctaccgttnaactcgtaagtacggaaacctctacccgacgacggcctaacgtgtacctaccccgacgtaggtcaggtcggacgacgggtcgggtaccggaatacggtagtccacgtctaccgacgtntccgacggccgtctggctagtcgtaggagttactttcgactagtttactacgtgtacgtagtactaagttaagtaactaccgttcggtcttaccgttaccgggttaacggttccgggggaacgggtacctaaaggggttacggtaagtaaccgttaacgaaaccgggttagtcggacggttaaccnccggaaccttaccgttaagtttccggttcccgtttaccgttacccgtcctaaccccgttttccgaaacctttcgttacgtaacg

SEQ ID NO: 250636 - DNA, 696 bp, Homo sapiens
  misc_feature: GYAE6OF01EHLGQ.44.65.F10.1.454.CMB.1.raw
  modified_base (281)..(281): a, c, t, g, unknown or other
  misc_feature (281)..(281): n is a, c, g, or t
  modified_base (366)..(366): a, c, t, g, unknown or other
  misc_feature (366)..(366): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagagccaccctctcctgcagggccagtcagagtgttagcagcaacttagcctggtaccacagaacctggcaggctccgagctcctnatctatggaacactaccaccgacgggcctacgtcggtactcccacccgtaggttccgagtcggctacggtcggggtacccggganaggtacgttaccacttctaccaccatccgacggtccggcctggcctacggttccgtaggtaagggttacttttacggactttaagttttaacttacgttagtacctacggtactaaaggttaacttaaagttaaccgttcggtacccttaccgttacgtaccggttttaccgggggaccggggggtaaccgtaaggggtggtaacggtaacgtaaccgtaaaacggtacgttagggttacggaccgttacggacctaccgtacgttccgttacgtttacccgttaccgtaaccgtttccccgttaccccggcccttaagtccgttaacgg

SEQ ID NO: 250637 - DNA, 681 bp, Homo sapiens
  misc_feature: GYAE6OF01CP4FG.44.65.F10.1.454.CMB.1.raw
  modified_base (199)..(199): a, c, t, g, unknown or other
  misc_feature (199)..(199): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaaatagtgatgacgcagtctccagcccaccctgtctgtgtctccgaggggaaancgccaccctctcctgcagggccagtcagagtgtaccagcaacttgcctggtaccacaagaaccgtggcaggcctcccgaggctcctcatctatggaacatcccacgacgggcccactcggtactccccaccgtaggttcaggtcggacgagggtcggggtccggaacaggtacgttccacttctaccaccgtatcgaggccggacctggactagtcgtaggtaggttatttttgacttagttttattacgtagtcgagtactaagttaataaacgtaacgtcggtacccttacgtcgttaaccggtttccgggggaccgggggtaaccgtaaggggtacggtaacgtaacgttaccgaaaaccggtacgttagggtaccggtacgtacggacccgtaaacccgtacgtttccgttacggtttacctttacccgtaacgtttaccccggtttaccccccggtaccttacgtttccgttaaacg

SEQ ID NO: 250638 - DNA, 717 bp, Homo sapiens
  misc_feature: GYAE6OF01CUG9P.44.65.F10.1.454.CMB.1.raw
  modified_base (198)..(198): a, c, t, g, unknown or other
  misc_feature (198)..(198): n is a, c, g, or t
  modified_base (274)..(274): a, c, t, g, unknown or other
  misc_feature (274)..(274): n is a, c, g, or t
  modified_base (314)..(314): a, c, t, g, unknown or other
  misc_feature (314)..(314): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctaccgaaggggaaanacgcccaccctctcctgcagggccagtcagtagtgtagcagctaacgttagcctacgtaccagacaagaaactcgnggaccaggcctaccgaggtcctccgtcattctagtggtcncctactacccgaccggacggccctacgtcggtaccacccgacgtaccgtacggttcgacggtcggacgtacggggttcgggtacgttacggggaactaggttaccgtttaccgtaacccttcctaaccaaaccgtacgttaccgaacgtcccgaacggtcccgtacggtaaccgttacggttaccgttaaggttaaacgtttaacgtttttcggaaccgttttaaagttttacgttaccgttagtacctagtacgttaagttaagttacgtcggttacgttccgggtcccttacgttccgttaaccggtttccggcccgtacgacccgtacgtagttaccgtaactttaacgaaacgtacgttgggtacgtacgtcgaacctaccgtacttcgttccgttacc

SEQ ID NO: 250639 - DNA, 748 bp, Homo sapiens
  misc_feature: GYAE6OF01BL19D.44.65.F10.1.454.CMB.1.raw
  modified_base (198)..(198): a, c, t, g, unknown or other
  misc_feature (198)..(198): n is a, c, g, or t
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcggtctccagccaccctgtctgtgtctcgaaggggaaangccaccctctcctgcgagggccagtcagagtgttagcagcaacttgcctcgtaccagcaagaaatcgnggccaggcctcccgaggtcctcctcattctagtggtnccactcccaccgacgggccacgtcggtactccccgagtacccgtagggttcaggtggacgtaggggttcgggtacgtaggggactacggtacgtttccgaaccttccggtacctaacccgtactccgaaggcccgtaacggtccccgttaaggcccgttaagggttaccccgtttaagggaaccgttttacggtttttaccggaacttttaaacggttttttaactttacccggtttagttacgtaacgggttactaagggtttaaacttaacgttaccggttaacggtcccgggttaccccctttaccccggggttaacggaacccggtaaaccggggtaaccctaccgggtaacgttagggtaaaccgtaaacggttaaaacggtagtcgggttacggtacgtacggaacctacggtactttcgtcgttaaccttcgtaaccc

SEQ ID NO: 250640 - DNA, 867 bp, Homo sapiens
  misc_feature: GYAE6OF01C1GY4.44.65.F10.1.454.CMB.1.raw
  modified_base (199)..(199): a, c, t, g, unknown or other
  misc_feature (199)..(199): n is a, c, g, or t
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
  modified_base (365)..(365): a, c, t, g, unknown or other
  misc_feature (365)..(365): n is a, c, g, or t
tcagacagtatatacacgaccggtgctcgatttagctacgctctaaggggggaggaactgctcagttaggacccagacggaaccatggaagccccagcgcagcttctcttcctcctgcctactctggctcccagataccactggagaaatagtgatgacgcggtctccagccaccctgtctgtgtctccgaggggaaanagccaccctctcctgcagggccagtcagagttgttagcagcaacttagcctggtaccacaagaaaccngggcaggcctcccgaggcctccncatctatggaacactccaccgagggccactggtacnccccaacctggttcaggtcggcagggtcgggtccggganaggtacgtttccacttcctccaacctatccgaagggcccgggtacccttggacctacggttccgttagggtaacggggtttaacttttttacggaccgtttaaacggttttttaactttaaccgtttacgggttacctaacgggttacccgttaaaaggtttaaacttaaaacggtttaaacccggtttccgggtacccccgttttacccgttaaccggttttaaccccggggtttttacccggggggggaaccccgggggggggtaaacccggttaaacggggggtttacgggggtaaacgttaaacccggttaacccggtaaaaaaaccggttaacccggtttaggggttaacccggggtaccgttaaacccgggtaaccccgtaaaccccgtttaaggtttccccggttttaacggtttccccttttaaccgttaaacccgtttttccccccggtttaaccccccggttaccccttaaacggtttccgtttaaaccggg

SEQ ID NO: 250641 - DNA, 672 bp, Homo sapiens
  misc_feature: GYAE6OF01CD31G.44.65.F10.1.454.CMB.1.raw
  modified_base (205)..(205): a, c, t, g, unknown or other
  misc_feature (205)..(205): n is a, c, g, or t
tcagacagtatatacacgaccggtgctcgatttagctacgctctaagggggctctggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaangcccaccctctcctgcagggccagtcagagtgttaccagcaacttgcctggtaccacagaaaccgtgggacacggcctcccgaggtcctcctcattctagtacggaacacgtcccaccgagggccacgtcggtacctccccgaccgtacggttcaaggtcggcgtagggtcggggtaccccgggaactaggtacgttccacgttcctaccgaaccctatccgacggcccggtcccgtgaccgtacggtcgtaggtacggttagttttcgcttaagttttacttacgttgtacgagtactaagtaattaataaccgtggtacccttacgtaccgtaccggtttcggggaccggggtaacgtaagggtacggaacgtacgtaacgtaaaccggtaacgttcggtcggtacgtacggaccgtaccgtattccgttacgttaccttacaccgtttcccgtccccgtacccg

SEQ ID NO: 250642 - DNA, 629 bp, Homo sapiens
  misc_feature: GYAE6OF01ANSJ7.44.65.F10.1.454.CMB.1.raw
  modified_base (205)..(205): a, c, t, g, unknown or other
  misc_feature (205)..(205): n is a, c, g, or t
tcagacagtatatacacgaccggtgctcgatttagctacgctctaagggggctctggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttaccagcaacttagcctggtacccaccagaaacctgggcacggctcccaggcctcctcatctatggaacactcccaccgacgggccacgtcggtactccccacccgtaggttccaggtcggcctagggtcggggtacccgggactaggacgttccacgtcctaccacctatccaggccggcctgccaggtctaggtaggtattttggacttaagttttacttacgtgtcagtacagttaataatacgtcggcccttctacgtaccgtttcggggaccgggggtactaaggggtcggaagtacgtaccgtaaaacggaccgttgggtcggtacctacggacccaccgtacgttaccgttcgttaccttacctactttcccgttccccgtacc

SEQ ID NO: 250643 - DNA, 576 bp, Homo sapiens
  misc_feature: GYAE6OF01A27YA.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagctcagcttctcttcctcctgctactctggctcccagataccaccggggaaattgtgttgacacaatctccagcccaccctgtctttgtctccaggggaaangcccaccctctcctgcagggccagtcagagtgttaggaactacttagcctggtatcaacagacaccgtggccaggctcccaggctcctcatctatgatgcatccaagtcggggccgcgggcatcccagccaggttcagtgcaggtgggtctgagacagtacttcactctcaccatcagccggacctagacgaccggaagtagtttgcttagtttattactagtacaacgtaccgtagccgacgtcggaccgttaggtacgtagtttcggaccgaggggaccaaggtctagggacgtctacgaaacgacgtggtacggccgtgacctacctcgttccgttacgttcctttaccacttcccgttccccgcctacgttaccg

SEQ ID NO: 250644 - DNA, 778 bp, Homo sapiens
  misc_feature: GYAE6OF01EPLKE.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagagtcgtaccagcaacttgcctaggaccaccgagaaaccgtgggcacggcctcccgaggtcctcctcactctagtcggaaccactacccaccgacgggcctacgtcggtactccccaccgtaggttcaggttcggcgtacgggtcggggtaccggactaggtacgttccaacttccgtaccaacccgtagttaccgacgggtcccggtcctcggaccgttacgggttccgtagggttaacgggtttacgtttttacggtaccgtttaagtttttaacgttaccgttggttacctaggttaccttaaggttaaactttaaacgttaaccggttcggttacccctttacgttaaccggttaccgggttttaccggggggaccggggggttaaccgtaaagggggttacggtaacggtaaccgttaaccgtaaaacgggtacggttcggttccgggtaccgttaccggaccgtacccgttacgtttccgttaccgtttacccgtttaccgttaacctttccccgttacccccggtacttaccgttcgtttaaccgg

SEQ ID NO: 250645 - DNA, 691 bp, Homo sapiens
  misc_feature: GYAE6OF01B1G0Q.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagcccaccctgtctgtgtctccagggggaaancgcccaccctctcctgcagggccagtcagagtgttaccagcaacttgcctggtaccaccagaaaccgtgggcacggcctcccgaggtcctcctcatcctaagtcggaactactcccaaccgacgggccccaacgttcgggtaacctcccccgaaccccgtaggttccgaaggtcggaccgtagggtccgggggtacccgggaacgaggtagttcccaactttcccgtaccaaccctatccgaacggccggtccctagccgtaagttccgtagggtacggttagttttcgacgtttagttttaactttacgttcgtacgtagtacgtaagttaataacgtaacgttcggtacccttcccgtttctaccgtttccggcccgttcgggtaacccacgtacgttaccgtacgtttaccgaaaccgtacgttggtcggtctcggacctaccgtcgttcctcgttaccttctaccgttcccttccccgtcctcgttacg

SEQ ID NO: 250646 - DNA, 848 bp, Homo sapiens
  misc_feature: GYAE6OF01DE30Z.44.65.F10.1.454.CMB.1.raw
  modified_base (195)..(195): a, c, t, g, unknown or other
  misc_feature (195)..(195): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagacaccactggagaaatgtgatgacgcagtctccagtcaccctgtctctgtctacgaggggaanacgcccacccctctcctgacgacgggcctagtcaggtagtcgttaccgagcctaacttcgccgtacggtaaccaccaacggaaaccgtgggaccgacggacctcccgtacggtcctcctacacttcgtaacgtacggaaacctacctacccgaaccgaacgggtaccctaacgttcggttaaccctacccccgtaacccgttaagggtttccgaacggtcgggtaccgtaaggggttcccgggggtacccggggaacgtacggggttaccctttacccgtaaccgtttcccgaccctaaccgtacgttaccgtaccgggccggtacctccggtacgttaacggtccgtaaggttaaacggtttcgtttacgtaccgggtttaaatttttaacttaccgtaggttacctaagggtacgtacggtttaagttcggtacgttaccggttccgggtacccctttacggtttacccggtttaacccgtttcccggggaccccgttacgggtaacccgtaccgttaacgggttcccttaaacgtttaacccggtaaaacggttaccggtccggttacggttaccgtaccggacccttacgttaaccgttcccgtttacgtacctttccctaacccgttcccgtttacccgcgtttaacg

SEQ ID NO: 250647 - DNA, 776 bp, Homo sapiens
  misc_feature: GYAE6OF01AFX1A.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaancgcccaccctctcctgccgagggccagtcagtagtcgttaccagctaacttagcctaggtacccaccgaagaaacccgtgggacacggcctcccgaggtcctcctacacttcctaactacccactactcccaccgacgggccctacgtacggtacctcccgagcccaagtacttcgaggtcggacctacggttcggggtacgtaggggaactacgggtacgtttccacgttcctaccgaacctacgtccgacgccgtacggtcccttaggacctacggttaccgttaacggtaaacgttttacgtttttacggacgttttaaacggtttttacttacgttcggtaccgtacggtaccgtaaggtttaacgtacggttacggtaccggtttccggttcccctttacccggtttccgttaacccggttttcccgggaccccgttaccgggtaaccctacggttaccggttaccgttaaccgtttaacccggtaaaccggttaccggttcgggttccgggtacccgttacggaccccttaccgttacgtttcccgtttacgtttccctttaccgttaccccg

SEQ ID NO: 250648 - DNA, 630 bp, Homo sapiens
  misc_feature: GYAE6OF01DNID0.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccaggcaccctgtctttgtctccgaaggggaaancgcccacccctctcctgccgagggccagtcagagtgtgaccaccaccacagtccttctagcctggtaccagcagaagccctggccaggcctcccgaggcctctcatctatgatgcatccaaagtcgggccgcgggacactcccagccgtaggttcaggtggcgaggttgggtctaggagactacgtacttccaacgttctaccaacctataccgacggtccgggtactttaacggacggtaaccggtaagtttagttttcgaccgtttaagttttaacttaccgtgtaccgtaagccgtaacgttccgttacccgtccgacggccctcgtaccgttacggtttccgggggaccggggtaccgagggttcggaagtacgtacgacggaaccgtaacggttgtaccggtcgtacgacctaactgttccgttacg

SEQ ID NO: 250649 - DNA, 874 bp, Homo sapiens
  misc_feature: GYAE6OF01DGB4S.44.65.F10.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagacagtatatacacgaccggtgctcgatttagctacgctctaagggggaggaactgctcagttacggacccagacggaaccatggaagcccagcgcagcttctcttcctcctgctactctggctcccagataccacgtggaagaaatagtgatgacgcagtcctccagccaccctgtctgtcgtctccgagggaaancgcctacctctcngcagggccagtcagtagtcgttaccagacctaacttacgccgtaggtaaccccaaccgaaggtaaaaccccgtgggggaccgaacgggtaccttacccccgaacgggtcccttccctaactaacgttacctttaaagtaccgggtaaaacccaccttaccccgaaacccggtaacggggacccctaacggtttaccgggtaaaccctaccccggtaacccccgtaagggttttcccgaagggttcggggaccgttaaggggttccggggggtacccgggtaaaccaggggttaaacccggtttcctaacccggttccttaacccgaacctaacgtacccggaagggttccggaccccctagggtaccgttacggttaccgtaagggtacggtttaacgttttagacgttaaggtttttactaccgttagtacgtaacggtacttaaaggtaaattaaacgttaacgtcccgggtctttacccggtacggtttccggttaccggggggaccgggtaacgttaggggacggtaagtaaccgttaagaaaacccggttgttacgggtacggttacccgtggtaaccctacgttagtaccccgttttagtacctttacctaccggttttacccccaccccggttacttacggtctttaaaccggg

SEQ ID NO: 250650 - DNA, 709 bp, Homo sapiens
  misc_feature: GYAE6OF01C0GPB.44.65.F10.1.454.CMB.1.raw
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
  modified_base (348)..(348): a, c, t, g, unknown or other
  misc_feature (348)..(348): n is a, c, g, or t
  modified_base (404)..(404): a, c, t, g, unknown or other
  misc_feature (404)..(404): n is a, c, g, or t
  modified_base (701)..(701): a, c, t, g, unknown or other
  misc_feature (701)..(701): n is a, c, g, or t
tcagacagtatatacacgaccggtgctcgatttagctacgctctaaggggggaggaactgctcagttaggacccagagggaaccatggaagccccagctcagcttctcttcctcctgctactctggctccagattccaccggcgtaaattttgtgacacaatctccagccacctgttctttgtccgtccgggggaacgacgcctaccctntctgcgacgggccgcagtctgtacgacgacgtactagcctacgtaccanagacgcgtcggaccgaggcctaccgagtacctcctatacttcgtagtcggtcacactccccgacgtaccgggcctaacggtcggtaccncccggacggcgttacggtcagggtcgacggtagggtaccgggtcgtagggaaaccnggttacgtacctacgttaccacaacctagtccgacgcacgccgtgactcggtacgtagttacgttagtttacgtaagtttacgttacgttacgtagttaccgaagtaccgttaagttaaacttaacggttaccgtaccggttaccccgggttacccgtttccccgggtaacgggaacccggtaaacgggacccgtaacggggtaacgtacgggtaaacgttaaacggtacgtacggtaggtacgtccgtaacgtacctcgtattcgtcttactctaccgttcctaccctataccgtntacgtaac

SEQ ID NO: 250651 - DNA, 733 bp, Homo sapiens
  misc_feature: GYAE6OF01C8VL7.44.65.F10.1.454.CMB.1.raw
  modified_base (207)..(207): a, c, t, g, unknown or other
  misc_feature (207)..(207): n is a, c, g, or t
tcagacagtatatacacgaccggtgctcgatttagctacgctctaagggggctctgggggaggaactgctcagttaggacccagacggaaccatggaagcccagcgcagcttctcttcctctgctactctggctccagactaccacgtggagaaatagtgatggacgcagtctccagccacctgtctgtgtccgtcgaaggggaaancgccacctctcctgcagggccagtcaggtagtcgttaaccagacctaagttcgccgtacggtaacccaacgacgaaaccgtgggacacggcctaccgacggtcctctacacttctacgtacggaaccacgtacccgaccggaacggtcccacgtcgtaacctccccgaaccgtacggttcaacgggtcggtaccgtagggtccggggtacggaacacgggttacttccgaaccttccgtaccgaacctacgtacggaccggtccggtaccgtgaccgtaggttccgtagggtacggttagtttacgtaccgtttaagtttacgttacgtacgtacgtaacgtactaacgtttaactaacgtaaccgttcgtacccgttacgttacggttaccgggtttccgggggaaccgggtaaccgtaagggtacgggtaacgtaacgtaccgtaaaaacgggtcttagggacgtccgtacggtcctacggtactttcgtacggttctacccttacgttccccgtacgttaccg

SEQ ID NO: 250652 - DNA, 1003 bp, Homo sapiens
  misc_feature: GYAE6OF01D668O.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaancgcccacctctcctgcgagggccagtcagagtgtagcagactaacttacgcctacgtaccaggacaagtaaacttcgtcgggccaacgggtccctcccgacggtccttaccctactactttacccgttaggtcgggtaccgtacctaccgtacccccgaaccgggaccgggtacccgtaaccggttacggttaacccgtaccccgtaaccggtacccgtacgggttttacccggacgggttaccgggtaccgggttaagggggttcgggggttccggtaacgggggtaaccttaacggggttaaccggttttaaccctaaacccggtttcccttaaacccgtaaacccgttacgttaaccccgaacgggtacccgtaccgggtaccccgtttacgaccgggtttaacggttaaccgtttaagggtaaaaccggtttttgttttacccgggtaactttttaaacggttttttccgttaaccggtttaccgtttaacccgttaaacccgggttaaaccgggttaaagggttaacccggtttcccgggttaacccctttaaacccttaaacggttttaccctttacccgggtttaacccccggttttaccccggggaccccggggtttaaaccgggtaaaacccggtttaaacggggtttaacccgttaaaggtttaaaaccccggttaaaccgggttaaaaaacccggtttaccggtttacgggggttacccgggttaaccgtaccccggttaccctaaacccggtttaccttttacccgggttttacgtttaccccctttaaccccgg

SEQ ID NO: 250653 - DNA, 638 bp, Homo sapiens
  misc_feature: GYAE6OF01DYQ39.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctccgaggggaaancgccaccctctcctgcagggccagtcagagtgttagcagcaacttagcctcgtaccagacagaaatcgtcggccaggcctccgaggcctcctcattctagtggtcgcacgtcccaccgacgggcctacgtcggtactcccgacgccgtaggtccaggtcggcgtagggtgggtcgtagggactaggtcgttacacgttctaccaaccgtatacgacgtacgacgtcctagtcgtaacgttctaggtaacgttagttttcgactttagttttacttacgttcgtacgacgtactaagttaactaagtcggtaaccgttcggtcccctttcccggttacggaccgaacgggtaccaacggtacgtagggaaattaacggttaaaacgtaggttggtacggccgttacgacctaccgttacgtcgttacgttcttacgtaacccg

SEQ ID NO: 250654 - DNA, 587 bp, Homo sapiens
  misc_feature: GYAE6OF01CGB5P.44.65.F10.1.454.CMB.1.raw
  modified_base (295)..(295): a, c, t, g, unknown or other
  misc_feature (295)..(295): n is a, c, g, or t
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
  modified_base (430)..(430): a, c, t, g, unknown or other
  misc_feature (430)..(430): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggaagaaatagtgatgacgcagtctccagcccaccctgtcctgtgtcctacccgaagggggaaagacgcccacccctctccgtgcacgggccagtcaagagtgttaccagcaacttagcctggtaccacgagaactggcagctccaggctcgtcntctatacggaacatccacgacggaccactcggtactccccaccgtaggttcaggtggcaggtcggggtaccgganagtacgtcactcncacatcgagcgctgcagtctgagtactttgacttagtttatcgtgtnagtcaagtaataacacgtcgtctactacgtaccggttcgggggcggggtaaccagggttggaactaacgtacgaaaccgtagtggtacgtacgacgacctacccgtattccgtacgttcccttacgaccctttccgtacccccgtacacttccgtag

SEQ ID NO: 250655 - DNA, 644 bp, Homo sapiens
  misc_feature: GYAE6OF01CAVL9.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaangcccaccctctcctgccagggccagtcagagtgttaccagctaacttagcctggtaccacagaaacctgggcaggcctcccaggctcctcatctagtcggaacactcccgaccgagggaccctacgtcggtaactcccccaaccgtaggtttccaaggtggccgtagggtcggggtccgggacaggtacgttccacttcctacaccgatccgagccggccttgctagtctgtaggtatttgacttagtttattacgtgtacgagtactaagtaattaaagtaacgttcggtacccttactaccttaaccggttttcggggaccggggggtaacctaaggggtcggtaagtaacgtacgaaaacggtacgtggtaggtcctacggctacctagttccgtacgttaccttaccgtaacttcccgttaccccgacctcgttcgtaacgg

SEQ ID NO: 250656 - DNA, 772 bp, Homo sapiens
  misc_feature: GYAE6OF01D1WBG.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgcccaccctctcctgcgagggccagtcagagtgttaccagcctaacttgcctggtacccaccaggaacctgggcacggcctcccgagtctccctcatcgtatacggaactactcccgaccgacgggcccacgttcggtacctcccctaacccgtagggtttccacggttcggccgtaggggtacggggtcccgggaactggtacggtttaccaccgtttcctaccaccgtacgtccgacggtccccgggtacttacggaccgtacggttaccgtaggtacggttacgttttacggtacgtttaaggtttttacgtaaccgtttggttaccgaacggtacgtttaaacgttaaatttaaccgtttaaccgtcgggttaccctttaccgttccggttaaccgggtttccgggggaaccggggggtaacccgtaggggttacgggaaacggtaacgtaacccggtaaacgtaaccggttcgggtaccggacgttacggacccttacgtacgttccgttacgttacccttaccgttaccgtttccccgttacccgtacccgttaagtttccgtaacg

SEQ ID NO: 250657 - DNA, 953 bp, Homo sapiens
  misc_feature: GYAE6OF01BK2L0.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaancgcccaccctctccgtgccgacggggtcccagtcaacggtagttcgttaaccaggtacctaaccgtttaggccctacgggtaaccccaaccgaacggtaaaacccgtgggggaccaaccggggtcccttaccccggaacgggtcccttacccttactacgttaccccgttaagttaccggggaaaaccctaccgtaaccccgaacccggtaaccgggggtacccctaaccggtttaccggggttaaaccctccccccgtaaacccccgggttagggtttacccggtaacgggttcgggtaccggtaacgggggttaccgggggtacccggggtaaacgacggtttaccggttacccgtaacctttcccggtacctaacccgttacgtaccgggtaacgggtaccgggtcccttgggacccgggtaacgtttccggttacgggttacgggttttaaccgttttacggtacgtttaacggtttttaaacgttaaccgtttcgggtaacgtaaccggttaacgttaaacggtttaaacgttaaaccgtttaaccggttccgtacccgttaccggtttaccggttaaccggggttttacccggggggaacccgggggtaaccgttaacggggttacggtaaacggtaaccgtaaacgtaaacccgggtattcggggtacgtaccgtaggacccttacgttacgttcgttccgtaaccgtttccgtaaccgttccccgtacccgtactagttcccgttaacg

SEQ ID NO: 250658 - DNA, 880 bp, Homo sapiens
  misc_feature: GYAE6OF01CLO0A.44.65.F10.1.454.CMB.1.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (308)..(308): a, c, t, g, unknown or other
  misc_feature (308)..(308): n is a, c, g, or t
tcagacagtatatacacgaccggtgctcgatttagctacgctctaagggggaggaactgctcagttaggacccagacggaaccatggaagcccagcgcagcttctcttcctcctgctactcgtggcctcccagataccatggaagaaatagtgatggacgcggtctccagcccacctgtctgtgtcacgaaggggaancgccacctctctggcgagggccagtacagngttgtagcagactaacgttacgccttacgaccagaccaagtaaactcgtacggaccgaaggccctaccgcggccttcctntaatccgtagtcggtcacacttacccgaacggtacggcctacgtacggtacctacccgtacgtacgtaacggttcgtacggttacggcgtaaggggttcgggttaacgttacggggaaccgttacggttaacgttccgtaaccgtttacgtaacccgtaaccttacgtaacccggtacggtacccggacgttaaccggtcccgggtaacggtaacgtttacggtaaacggttaaacggttttccgttttaacggttaaccgttttaaacgttttttaagttaacccggtttagttaacccggtaaacgtttaaggtaaacgttttaaaacgttaccggtttacccggttaaccgggtccccggggttaacccccgttaccccgggttaaacccggaaccggggtaaaaccggggttacccctaaacggggtaaccggttaaacggggtaaaacgtttaaaaccggggttaaaacccgttggggttaaccgttaccggggtaccgtttaaccgggaaccttacccggtaactttttccccgggtactttacccgggttacttttacccccccg

SEQ ID NO: 250659 - DNA, 613 bp, Homo sapiens
  misc_feature: GYAE6OF01ECD3V.44.65.F10.1.454.CMB.1.raw
  modified_base (304)..(304): a, c, t, g, unknown or other
  misc_feature (304)..(304): n is a, c, g, or t
  modified_base (404)..(404): a, c, t, g, unknown or other
  misc_feature (404)..(404): n is a, c, g, or t
  modified_base (609)..(609): a, c, t, g, unknown or other
  misc_feature (609)..(609): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagagatcaccggagattattgtgttgacacagtctccaggcacctgtctttgctccgaggggagagacgccaccctctccgtggtacgggccaggtcggagtgttcgactaagtacctagccgtaggtaaccaaacgacgaaacctggacccaggcctcccgaggtcctcctanactctatgatcgcactccgaagtcggtcacgtcgccaccagactaggtcaggtggcgaggtcggtcgtagggactacgtactttcaccttctacaccgtnagactaagtcgtacgacgtccgtagtaacgttgtttagtacttagtttacgttacgtagtacagtacgtacgtccgttaccgtcgtacggccgtctacgttacggttaccggggacggggtacgtagggtcgacgtacgtacgacggtacgtacgtcggtcgtacgtacgacctacgtagttctcgttctactactcccttccgntacg

SEQ ID NO: 250660 - DNA, 615 bp, Homo sapiens
  misc_feature: GYAE6OF01EPH91.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagagccaccctctcctgcagggccagtcagagtgttagcagcaacttagcctcgtaccagcaagaaactcgtcggaccaggactcccaggtcctcctcatctatggtgccactccaccgacgggcccacgtcggtactcccacgccgtaggttcgagtcggcgtaggtggggtcgtggggacaggtagttcacgtctaccaccatccagtccagcccgtgactagttcgtaggtaaagttcgttttagactttacgttttaacttacgtcgttacagtactaagttaataagtcggtacgtcggttcccctacggttcccggaacgtaacgggcaacggacgttacgggaacttaaacggttaaacggtacgttgggtcgtacctacgacctacctacttcgttagttccttccgtaccg

SEQ ID NO: 250661 - DNA, 669 bp, Homo sapiens
  misc_feature: GYAE6OF01B7LM6.44.65.F10.1.454.CMB.1.raw
  modified_base (197)..(197): a, c, t, g, unknown or other
  misc_feature (197)..(197): n is a, c, g, or t
  modified_base (342)..(342): a, c, t, g, unknown or other
  misc_feature (342)..(342): n is a, c, g, or t
  modified_base (462)..(462): a, c, t, g, unknown or other
  misc_feature (462)..(462): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaancgccaccctctcctgcagggccagtcagagtgtagcagctaacttcgcctcgtaccagcaagaaactcgtcggcccacggcctcccgaggtcctcctctacttctagtggtcgcactcccgaccgacgggccctacgtcggtacnccccgagccgtaggttcaggtggaccgtaggtcggggtcgtggggactaggtacgttcctactcctaccgacctagtcgacgccgtacgcccgtagcgtacgttcgtaaggtaacgtttnttttacggacgtttaagtttaacgtttacgtgttacgtagtacgttaagttaacgttaatacggtaccgttccgggttacccttaccccggttacgaccggtaacgggacctaaccggtaaggtacggtaaagtaacgttaaaaacggtcgttagggtcggtcgtacgtcccgtaaccgtattcccggttattcccgtcttaacccg

SEQ ID NO: 250662 - DNA, 573 bp, Homo sapiens
  misc_feature: GYAE6OF01ESNI5.44.65.F10.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (542)..(542): a, c, t, g, unknown or other
  misc_feature (542)..(542): n is a, c, g, or t
  modified_base (555)..(555): a, c, t, g, unknown or other
  misc_feature (555)..(555): n is a, c, g, or t
  modified_base (567)..(567): a, c, t, g, unknown or other
  misc_feature (567)..(567): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctgtgtctccagggggaangccaccctctcctgcagggccagtcagngtgtaccagcaacttagcctggtaccaccagaaacctgggcaggcctccgaggcctcctcatctatggaacatcccacgacgggccacgtcggtactccccaccgtaggttcaggtcggcgtaggtcggggtcccggataggtacgttccgacttcctacgaaccattccgaggtccggccttggacctacgttcgtaggtaggttattttggacttaagttttacttacgtgtctagctaagtataatactggctcgtctacgtttcgggaccggggtacaagggtgagatacgaaacgacgtgtcggactcgctacnttctcgtcttctnttccctccgctntctacg

SEQ ID NO: 250663 - DNA, 716 bp, Homo sapiens
  misc_feature: GYAE6OF01BW31P.44.65.F10.1.454.CMB.1.raw
  modified_base (200)..(200): a, c, t, g, unknown or other
  misc_feature (200)..(200): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtcgtctaccgaaggggaaancgtcccaccctctcctgcgaggccagtcagagtcgttaccagactaacttcgccgtacggtaccaacgaacgtaaaccgtcgggacacggtcctacccgacggcctaccgtactacttctaacgtacggaaccacgtacccgaaccgacgggaccctacggtcggttaaccctacccgaacccgtaggttaccgaaggttcggacggtacgggttcggggaccggaacgacggttacggttaccacgtttaccaccgtaactactccgacggccggtcctaggtacgtcgttacgaggttaggttacgttttcgactttaacggtttacttacgtagtacgtacgtacgtaagtttaactaacgtacgtcgtacttttccgacgtttacgggttacggggaccggggtaaccgtagggtacggtaacgtaacgtaacgtaaacgtacgttcggacggtacctacggacctagtacttcgtgttacctctacgttccctaccggtctgtcgttaacg

SEQ ID NO: 250664 - DNA, 725 bp, Homo sapiens
  misc_feature: GYAE6OF01EODQ9.44.65.F10.1.454.CMB.1.raw
  modified_base (195)..(195): a, c, t, g, unknown or other
  misc_feature (195)..(195): n is a, c, g, or t
  modified_base (301)..(301): a, c, t, g, unknown or other
  misc_feature (301)..(301): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctcgaggggaanagcccaccctctcctgcagggccagtcagagtgttagcagctaacttgcctcgacagcaagaactcgtggccgaggcctccgaggtcctcctacattctagtggtnccacgtcccaccgacggccacgtggtaacctcccgagtccgaggttccaggtcggacgtagggttcgggtcgtaggggactaggtacgttcgactcgtaccaacccgatccgacgaccgaacggtccctaggacctaggttaccgaaggttaaacgttagtttttacggaacctttagtttttacttacgtgttacgtacggtacttaacgttaaacgttacgttacggtaacccgttccgggtccccgtttaccccgttaccggggaacccgtaaaccggggtacctaccgggtaaacggttacgggtaaaaccggttaaaacgtttaaaaccgggtaaccgttagggttaccggtacccgttacgtaaccccgtaacgttaacgtttacccgggtttactttccgtttaccgttaaccccgg

SEQ ID NO: 250665 - DNA, 716 bp, Homo sapiens
  misc_feature: GYAE6OF01BOIOS.44.65.F10.1.454.CMB.1.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
  modified_base (355)..(355): a, c, t, g, unknown or other
  misc_feature (355)..(355): n is a, c, g, or t
  modified_base (449)..(449): a, c, t, g, unknown or other
  misc_feature (449)..(449): n is a, c, g, or t
tcagacagtatatacacgaccggtgctcgatttagctacgctctaagggggctctgggggaggaactgctcagttaggacccagacggaaccatggaacgccccagcgcagcttctcttcctcctgctactctcggcctcccgagactaccacgtggaagaaatggtgatcggacgctagtcctccgacgcccacctgtctgtcgtcctacggaaggggaaacncgtcccaccctctccgnggaccgacgggcctaggtcaaggtacgtcgtaccagacctaacgttcgccgtacggtaacccaacaacggaaccgtgggacctacgcctcccgagtcctctcatctagcgaacncgtaccacgcggcctagtcgtaacccccgtacgtggtcaggtcgacgtagggtcgggacccgataggtcttccacgtaccgtacaaacccgttncccggacggtcccgtccgtacgccgtacgtccgtaggtacggtttacgtttacgtacgggggttaatttaccggttagttacggttacgtacgtaacgttaacgtaattaaccgttaacgttacgtcccgttacggttaccggttacggggttaccggggaacggggtaacggtagggtacgtaacgtaacgtaacggaaacgtacggtcgtacggtaccgtacgtcctacgtactccgttagtcttaccgtaccttccgtcctacg

SEQ ID NO: 250666 - DNA, 803 bp, Homo sapiens
  misc_feature: GYAE6OF01DDGI0.44.65.F10.1.454.CMB.1.raw
  modified_base (194)..(194): a, c, t, g, unknown or other
  misc_feature (194)..(194): n is a, c, g, or t
tcagacagtatatacacgaccggtgctcgatttagctacgctctaagggggaggaactgctcagttaggacccagacggaaccatggaagcccagcgcagcttctcttcctcctgctactctggctccagataccactggagaaatagtgatgacgcagtctccagccacctgtctgtgtctcgaaggggaacncgccaccctctccgtgcgaggccaagtcagtagtgtagacacgactaacttacgcctacgtaaccagacaaacgtaacgtcgtacggccgaacggcctacccgacggtccttacctactaacgttaccgttagttagggtacgtacctaaccgttaccccgaaaccggaccggggtacctaacccggtttagggtaaccctaccccgaaacggtcccgtaaggtttcaacgggttcggacggttaacggggttcggggtaccggtaggggtaaccgtacggttaacggttttaccacttaccgtaccgaaacccgtaacttacgaaccggactaccggtccgttgaacgttacgttacgtaaggtaaagtttcgttttacgacgttttaagtttaacgtacgttacgtacacgtaacgtaaggttaacgttaacttacgggtaacccgttcggtaccccgtttacccgggttaccgggacccggtaaacgggtaacctaaccggtaaccggttaagggaaacgtttaaacgtaaaacggttacgttaacgggttacggactttaaccggaccttaacttaccgtttcgtttaaccgtcttttaacccgg

SEQ ID NO: 250667 - DNA, 695 bp, Homo sapiens
  misc_feature: GYAE6OF01ET7M1.44.65.F10.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (290)..(290): a, c, t, g, unknown or other
  misc_feature (290)..(290): n is a, c, g, or t
  modified_base (493)..(493): a, c, t, g, unknown or other
  misc_feature (493)..(493): n is a, c, g, or t
  modified_base (517)..(517): a, c, t, g, unknown or other
  misc_feature (517)..(517): n is a, c, g, or t
tcagacagtatatacacgaccggtgctcgatttagctacgctctaagggggagggaactgctcagttaggacccagacggaaccatggaagccccagcgcacgcttctcttcctcctgctactctggctccagataccactggagaaatagtgatgacgcagtctcagccaccctgtctgtgtctaccgaggggaanagcccaccctntccgtgcagggccagtcaaagttcgtacagcaacgttgctggtaccacagaacctggacaggcctccgagactcacatactntacggaacagtccgacgaacgggcctacgtagggtacctaccccgaaccgtaggtttccgaagttggaccgtagggttcgggacccggggaatagggtaacttccgaactcggtacaaccctagccgaggtccgtacctggacacggttcgtaggtaagggttactttcgaccttaagtttgtacgtaggttacaaccggtanaacggtttaaacacgtttaaaccncgggttaacccttcccgtacgttacggttttaccggggaccggggggtaaccctaggggtacggtaagtacctaacgtaaaccggtaagtaccgggttcggactttaacggcctaaccgtaggttccgtacgttcccgtttacgaacgtttccccgtaccgtacctagttcgagtacg

SEQ ID NO: 250668 - DNA, 911 bp, Homo sapiens
  misc_feature: GYAE6OF01AORAL.44.65.F10.1.454.CMB.1.raw
  modified_base (270)..(270): a, c, t, g, unknown or other
  misc_feature (270)..(270): n is a, c, g, or t
tcagacagtatatacacgaccggtgctcgatttagctacgctctaagggggaggaacggtgctcgagttaggacccagacggaaccagtggaagccccagcgcagcttctcttcctcctgctactctcgctcccagataccgactggagaaatagtgatgacgcggtctccagcccaccctgtctgtgtctccgaggggtaaacgcgcccaccctcgtcctgcacgggccagtcagagtgtagcacgctaaccttaggcctcggtaccgnggtactaaggtaaacttccgtcggacccgtaacgggaccctaccccgtaacgggcccttacccgttacccgaaccgttacccgtagtttcggggtaacacctaacgttccccggaaccgtacggggtaccctaacgttccggggttaaccctccccggaacggccccgttaggggttaccaagggttcggacgttagggttcggggttccgtaaggggaaccttaagggtaccggtttaccaacccttaccgtacccgtaaccctacgtttacccggaacgtcccgtaaccggttcccgttcggggacctaccgggttaccgtaaggggttaaacgtttacgttttacggaacggtttaacggttttttaagttaccccgtttaagttaccgttacggtactaacgggtttaaactttaaccgtcgggttaaccggtttcccgggtacccctttaccccggttacccgggaacccgggtaaaccggtccggttaaaccgggtacgggtttaaacggtaacgggttaaaacccgggtttaaaccgggaccgggtttaacgggtcgggttacccccgttacggggtaacccttaccccggttaagttacccgggtttacctttaccggttacccttaccccgg

SEQ ID NO: 250669 - DNA, 768 bp, Homo sapiens
  misc_feature: GYAE6OF01DTGJ3.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaancgccacctctcctgcagggccagtcagagtgttagcagcaacttagcctacgtaccagacagaaatcgtggccaggcctccaggcctctcatctagtggtagctactcccaccgacgggacctacgtcgggtaactccccgacggccagggtttccgaggttcggaccgtagggttcggggtcgttcgggggaactaaggtacggtttaccaacgttcctaccgaccgtaacgttaccgaacggtccaaccggtacccgttaggacctaacgggtttccttaagggtaaacggttttagtttttacggaccgttttaaggtttttaaaccttacggtttaccgttacgaacggttaacgttaagttaaacgttaacgttaccggtaaccgttccgggttaccccctttaccccgggttacgggtaaccccgtaacgggggtaaccctaacccgggtaacggttacgggtaaacgttaaaacggtttaaaaccgggtaaggtttcgggtaccgttaccgtacgggtaaccctaccggtaacgtttcttaacggttcctttacccgttaacccg

SEQ ID NO: 250670 - DNA, 704 bp, Homo sapiens
  misc_feature: GYAE6OF01DKZKJ.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggcctcccagataccactggaagaaatagtgatgacgcagtcctccagcccacccttgtctttgtctaccgaaggggaaagacgcccacccgtctccgtgcgacgggcagtcagagtgtagaactacgttagcctaggtactacaaacacgaaaccgtggaccacggtcctaccgaggcctcctcatctatgatcgacactaccgaacgtcggtcacgtcggccaaccccgagtacgtaggtcaaggtcgacggtaggtcgggtcgtagggaccaagtacttcctacttccgtaccgaccgcgtaagactaacgtacgtacgacgtacgttagtaagtttacgttttagaaacgttttacgtttaacttgtacgttacacgtaccgtaccgttccgtttacccacgtaccgggtcccctacgttccggttacccgggtttccgggggggaacgggggtaaccaacggggttggaaacggtcgtaacgggaaccgtacggaccggttaggttaccggccgtaggtccccaaaccgttcgtttccgttacgttccctagttaaccctttcccgtacccggttc

SEQ ID NO: 250671 - DNA, 867 bp, Homo sapiens
  misc_feature: GYAE6OF01CAHSA.44.65.F10.1.454.CMB.1.raw
tcagacagtatatacacgaccggtgctcgatttagctacgctctaagggggctctggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaagagccaccctctcctgcacgggccagtcgagagtacgttaaccagacaacttacgccgtacggtaaccaaccgaacggaaaccgtgggaccaacgggtcctacccgaaggtccttaccctacgtaacttactaaagtaccgggtaaacctaaccgttaccccgaaccggtaacggggacccctaacgttacgggttaaccctacccccgaaccccggttaaggtttacccaagggttccggaacgtacggggttacgggggtaccccggggaactaaacggtaccggtttaccaccttaccctaaccgaacccgtaaaggttccccgaaacgggtcccgggtacccgttacggaccgtttaaccgggtaggttaaccggtaaggggtttaacttttcgggtaaccgttttaaaggttttacgtttaccgtaacggttactaaacggttaccgtaaaggttaaactttaaacgggtaacccttcgggtaccctttaccgtaacggtttaacccggggttttacgggggaaccgggggtaaacccgtaagggggtacggaaacggtaacgtaaacggaaaaccggtagtcggttacgggtacacggactaaccgttcgtacgtttccggttaacttcccggtactttaccccgtcccggtaacc

SEQ ID NO: 250672 - DNA, 787 bp, Homo sapiens
  misc_feature: GYAE6OF01EWNN4.44.65.F10.1.454.CMB.1.raw
  modified_base (201)..(201): a, c, t, g, unknown or other
  misc_feature (201)..(201): n is a, c, g, or t
tcagacagtatatacacgaccggtgctcgatttagctacgctctaagggggaggaactgctcagttaggacccagacggaaccatggaagccccagcgcagcttctcttcctcctgctactctgtctcccagagatcaccggagatattgtgttgacacacgtctccgaggcctaccctgttcttgtcctccgaggggtanaggacgcccaccctctccgtaggtacggcctagtcggagtgttagacttaacgtacctacgccgttaggtaaccaacgtaacggtaaaccgtcggacccgtaagggcccttaccccgaaggtacccttacccctacgtaacttacgttaacgttcgggtaaccttcgggaccctaacgttaacccgtaaaagggttacccgggggcccgtaccggggaacctaacccgttccccgaaggtaccccgttaggggttacccaagggttcggaccgtaaggggttcggtacgtaacgggaaccgtaaccgaaggttccctttaaccgaccttctacccgaacctacgtccgacgggtaccgacgttaggaccggtaccggtaagttacgtttacggacgttaagtttacgttacgtacgtaacgtaacgaccgttagaccgtagtcgtacgtacgtacgttaggttacggacgtaacgggtacctaaggcgttaacggacgtaacctaacggtaaaccgttacggtaggtacggtacgtacgactaacgtacttcgtacgttcctactacccttccgtccccgtgtacg

SEQ ID NO: 250673 - DNA, 671 bp, Homo sapiens
  misc_feature: GYAE6OF01EGRUD.44.65.F10.1.454.CMB.1.raw
  modified_base (211)..(211): a, c, t, g, unknown or other
  misc_feature (211)..(211): n is a, c, g, or t
  modified_base (446)..(446): a, c, t, g, unknown or other
  misc_feature (446)..(446): n is a, c, g, or t
tcagacagtatatacacgaccggtgctcgatttagctacgctctaagggggaggaactgctcagttaggacccagacggaaccatggaagccccagcgcagcttctcttcctcctgctactctggcctcccagactaccacgtggaagaaatagtgatgacgtcggtctccacgcccacccttgtctgtcgtccgtaccggaagggaaacncgccctacccttcctcctcggccgacggccagtcgagtagtgttaacgcgaacgactaacgttcgcctaccgaccagacagtaatcgacgcgacgcctccgagtcctctctacttcgtacgtgtcacctacgtacccgaccggtccggacctacggtcgtaccctccgacgtaccgtggtacgaggtcgacgtgggtcgtacggtaggacgtacggtctactacctactacctanagtaccgacgtacgacgtactcgcttacggtcttaagtaactttgtttacgtacgtttagtttagtactagttaccgtagttaacgtaagtactttagaccggttaccgtcccgtccgttaaccggacgtaccggaacgccgtaacggtaggtaaccggtaaattaaacggtacggtacgttcggtcgacgtacgactaccctattcgttccgtcttacccgtcg

SEQ ID NO: 250674 - DNA, 635 bp, Homo sapiens
  misc_feature: GYAE6OF01CCAPQ.44.65.F10.1.454.CMB.1.raw
  modified_base (201)..(201): a, c, t, g, unknown or other
  misc_feature (201)..(201): n is a, c, g, or t
  modified_base (396)..(396): a, c, t, g, unknown or other
  misc_feature (396)..(396): n is a, c, g, or t
tcagacagtatatacacgaccggtgctcgatttagctacgctctaagggggaggaactgctcagttaggacccagacggaaccatggaagccccagcgcagccttctcttcctcctgctactctggctcccagataccactggagaaatagtgatgacgcagtctccagcccacctgtctgtcgtctccgaagggggaaanacgcccaccctctcctgccagggccagtcagagtgtgacgacgacttagcctaggtaccaacagaagcctggccaggctcccagacctcctacatctaatgacttacttctaaggtaggcccttcgtggcctactccccagccccgtcttccgaggttcggctagggtcgggtacgtggggaacacggtaccttnaaccttcgtacaccttagccaccgagcccgtagacgtcctagtaacgtatttgacttaagtttacttacgttacgtactaactaccggttaaagacgtggtaccctactaagttaacttcctaacgtttccggaccccgttagggaacccgtaagtaggtaacttactaaaccgaaacgtaacgtggtaggtactcgacctacccgtattcgtacgttacttctacttccgttaccccg

SEQ ID NO: 250675 - DNA, 548 bp, Homo sapiens
  misc_feature: GYAE6OF01EETLK.44.65.F10.1.454.CMB.1.raw
  modified_base (163)..(163): a, c, t, g, unknown or other
  misc_feature (163)..(163): n is a, c, g, or t
  modified_base (196)..(196): a, c, t, g, unknown or other
  misc_feature (196)..(196): n is a, c, g, or t
  modified_base (331)..(331): a, c, t, g, unknown or other
  misc_feature (331)..(331): n is a, c, g, or t
  modified_base (423)..(423): a, c, t, g, unknown or other
  misc_feature (423)..(423): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtntccagccaccctgtctgtgtctccaggggaaangccaccctctcctgcagggccagtcagagtgttagcagcaacttagcctcgtaccagcagaaatctggccaggctccaggctccctcattctataccacactccaacccagggcccacttggtatccccagcccngattcagttggcacgtgggtctgggacagagttcactctacaccatcagcagcctcgcagtctagagattttgctagtttattactgtctancgtagtatagtcgtacgttgggtcccttccgttctaccgttttccggcccgttgggacccgtacacggttacgtagtttaccaaacggtacttggtacggtctcgacaccctatccgttgtaccg

SEQ ID NO: 250676 - DNA, 685 bp, Homo sapiens
  misc_feature: GYAE6OF01CM4TL.44.65.F10.1.454.CMB.1.raw
  modified_base (197)..(197): a, c, t, g, unknown or other
  misc_feature (197)..(197): n is a, c, g, or t
  modified_base (437)..(437): a, c, t, g, unknown or other
  misc_feature (437)..(437): n is a, c, g, or t
  modified_base (649)..(649): a, c, t, g, unknown or other
  misc_feature (649)..(649): n is a, c, g, or t
tcagacagtatatacacgaccggtgctcgatttagctacgctctaagggggaggaactgctcagttaggaccagacggaaccatggaagcccagcgcagcttctcttcctctgctactctggctccagactaccactggaagaaatagtgatgacgcagtctccagcctacctgtctgtgtcggtaccgggggaacncgcccacctctcgtgcgacgggccgcagactgtcgaccgtacgacttacgcctacggaaccaacgagacgccgtacggacgacggcctacccgaagtccttctcattctagttgtaacttcgttacgtaggtaccggtcctcgtcggacctacgtacccgcgtccctagttcgaggtcggacggtaggttcgggtcgtacgggaactcggttaccttaccgtactacctccaacccttanacccgtaacccgacgtcgtaacggaacgtcgttagtaacgtttagtttacgtagtttaacgtttacgtaacttacgtaccgtaactaacggtaacgtacgtaccgtaacctataactttctaccgtttaacgttccggtacccgttagggtaaacgtaagtacgtataacaaccggtaaagtccgttgacgtccgtacgacttaccacgttntaccgtttacttcctacttccccgttccgctttacg

SEQ ID NO: 250677 - DNA, 536 bp, Homo sapiens
  misc_feature: GYAE6OF01E41X5.44.65.F10.1.454.CMB.1.raw
  modified_base (198)..(198): a, c, t, g, unknown or other
  misc_feature (198)..(198): n is a, c, g, or t
  modified_base (528)..(528): a, c, t, g, unknown or other
  misc_feature (528)..(528): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagagatcaccggagatattgtgtcgacacagtctccaggcaccctgtctttgtctccgaggggaaancgcccaccctctcctgcagggccagtcagatattggcgccgactactagcctggtaccagcagagacctggccagccctccaggctcctcatctataccacactccaccgagggccctacgtcggtactccccaggcccagacttcgagtcggcacgtggggtctggggacagtacgttcactctacaccatcagcacgcctgcagtctagtaagtagtttgactagtttactactgtacagtcagtatagtgtcgtggtccttccgttctacgttccggccgtggacctacgtacgtcgtacttacaaacgtactgtgctcgacacctntcgtgttc

SEQ ID NO: 250678 - DNA, 813 bp, Homo sapiens
  misc_feature: GYAE6OF01AQOAB.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagacgccaccctctcctgcgaggccagtcagagtgttagcagcaacttagcctcgtaccagcaagaatcgtggccaggcctcccgaggcctcctcatctagtggtcgcctactcccaaccgaggggtccctacgtcggtaacctccccgaggtcccgtagggtttccgaaggtcggggaccgtagggttcgggggttcctacggggaactagggtaacgttttccgaacccgtttccacccgtaaccctagttcccgaaggtccctacggcccttaggacccgttaaaggttccgttaagggtaaacgtttacggtttttacgaacccgttttaacgttttttaacgtttaccgtttgggttaccttaacgggtactttaaacggtttaaagttaaaccgtttccgggtaaacccggtttccccgggttacccccttttacccccggggttacccggggtaaccccggtaaaaccgggggtaaccctaaccgggttaaaccggttacgggggtaaaacctttaaaccgggttaaaaacccggttacggttcggggttacggtacccgtacggtaccccttaacccgttacgttccgtttaccggttcccttttaacccg

SEQ ID NO: 250679 - DNA, 703 bp, Homo sapiens
  misc_feature: GYAE6OF01AZC0W.44.65.F10.1.454.CMB.1.raw
  modified_base (313)..(313): a, c, t, g, unknown or other
  misc_feature (313)..(313): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaagcgcccaccctctcctgcagggccagtcagagtgttggcagcagcgtagccgtggtccagcgaacgaacctggccacgacctcccgaggtcctcctcacttcctactacccactaccncccaccgacgggccctacgtacggtacctccccgagaccctagtactcgacgtcggactacggttgggtcctggggacctaggtacgttccacttccaccgacctagtcaacgtaccacgcctcggtactacgtacgtaggtaacgttagttttacgtacgtttaacgttttacgtttacgtacgtacgtagtaccgtaaggtttacttaacggtcggtaaccgttcgggttcccctttaccggttacccgttacgttttccccgggacccggtttaccgggtaacccctacggttacggttaacccgttaccgtttaaccgtaaaacccgttacgggttggttacccggtcgttacccggtaccgttaaccctaagttcccgtttacgg

SEQ ID NO: 250680 - DNA, 802 bp, Homo sapiens
  misc_feature: GYAE6OF01CUUF4.44.65.F10.1.454.CMB.1.raw
  modified_base (205)..(205): a, c, t, g, unknown or other
  misc_feature (205)..(205): n is a, c, g, or t
  modified_base (221)..(221): a, c, t, g, unknown or other
  misc_feature (221)..(221): n is a, c, g, or t
tcagacagtatatacacgaccggtgctcgatttagctacgctctaagggggaggaactgctcagttaggacccagacggaaccatggaagcccagcgcagcttctcttcctcctgctactctggcctcccagataccacgtggaagaaatgtgatgacgcagtctccagcccaccgtgtctgtcgtcctaccggaaggggaaacncgcccacccttctccnggcgacgggccaagtcaaggtacgttacgttaacccagtaccctaaaacggtttccggaccgttacgggtaaccccaacggtaaaccggtaaaaccgtcggggaccgtaacgggtcccctaccggaacggcccttaccgtactacgttacgtaacggtacggaaaccaccttaccgaacccggtacgggtaccctaacggtaccggtactaccccctaaccggtagggtttacccgaggtccgggtacggtaggggtaccggggtaccggaacgtacggtacggtccctacgttacccgaccacgtaacgtccgacggtccggctgtaccgtgtcgtaggtacgttacgtttcgtacgtttagtttacgttacgttacgtcgtacgtagtaacgttataacgtcgtacccggttacgtccctttcccgggtaacggaacccggaaccggtaacgaccgggttaacgtaacggtaacggttaacgtaaacgggttactacgggtacgtaccgcgttaaccctacctacgttcgtaccgttcttaccgtaaccccgttctacccggtcttacggtacttaacg

SEQ ID NO: 250681 - DNA, 824 bp, Homo sapiens
  misc_feature: GYAE6OF01EUBSU.44.65.F10.1.454.CMB.1.raw
  modified_base (144)..(144): a, c, t, g, unknown or other
  misc_feature (144)..(144): n is a, c, g, or t
  modified_base (194)..(194): a, c, t, g, unknown or other
  misc_feature (194)..(194): n is a, c, g, or t
tcagacagtatatacacgaccggtgctcgatttagctacgctctaagggggaggaactgctcagttaggacccagacggaaccatggaagccccagcgcagcttctcttcctcctgctactctggctccagataccactggaanaaatagtgatgacgcagtctccagccacctgtctgtgtctcgaagggaancgcccacctctcctgcgacgggccaggtcagtagttcgttaccagtacctaaacgttcgcccgttaggtaaccccaaccgtaaaggtaaaacccggtggggacccgtaacgggacccccttaccccggaagggtccctttaccgtacgtaacttaccttaaaggtacgggtaaacctaaccgttacccccgaacccggtaaccggggtacccttaaccggttacggtaacccctaccccgaaccccgttagggtttaccgagggttccggacgttacggggttaccggggggtacccggaacgtaacggttacgtttaccacccgtttacgtacccggtaccgtaactacggaactaaacgttgtaaaccgacgttaccgtaaggtaacgtttacgttttcgtaaccttttaagttttacgttaccgttacggtacgtacgtcgtaaccgttcccgttacccgcggtaccgccgttaccgtccggttacgggttccggggaaccgggggtaccgtaaggggttacggaacgacgtacgaacggtaccggtagtcggtacggacgtccggtacctacgtaactcgttcgtcctttacccgtaacctttcccgtacccaccttgttacgtac

SEQ ID NO: 250682 - DNA, 863 bp, Homo sapiens
  misc_feature: GYAE6OF01ERDWJ.44.65.F10.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
tcagacagtatatacacgaccggtgctcgatttagctacgctctaagggggctctggggaggaactgctcagttaggacccagacggaaccatggaagccccagcgcagcttctcttcctcctgctactctggctcccagataccactggagaaatagtgatgacgcagtctccagcctaccctgtctgtcgtctaccgaaggggaaanacgccctaccctntccgtgcgacgggtcctaggtcgaagtacgttcgttaaccgagactaaacctttcggacccgttacgggtaaaccccaacccgaaacggtaaaaacccggttggggaaccctacggggacccttacccccgaaggggtcccttacccccttaccggaaactttccgtaaacgtacggtaaaaccctactacccccgaacccggtacgggccctaaacgttacccgggtaacctaccccgtaacccgtaacggttacgtacggtcggacggtacgggtacggggtaccggaacgtacggtacgttacgtacctaccgtaccgtaaccgtacgtacgtacggtccgggtaccgtacggtaccgtacgttacggttacggttaacgggtttaacgttttacggttacgtttaacgttttaacgttacgttacggtacgtacgtacgtaacgttaacgttaacgttaaccgttaccggtaccgttaccgttaccgttaccgggtttacggggtaacgggggtaaccggtaacgggtaacgggtaacggtaacgtaaccgtaaaccggtaacggtacggttacggtacgtacgtacgtaccgttacgttacgttacgttaccttacgttaccgttcccgttacccg

SEQ ID NO: 250683 - DNA, 773 bp, Homo sapiens
  misc_feature: GYAE6OF01A9MXQ.44.65.F10.1.454.CMB.1.raw
  modified_base (210)..(210): a, c, t, g, unknown or other
  misc_feature (210)..(210): n is a, c, g, or t
tcagacagtatatacacgaccggtgctcgatttagctacgctctaaggggagggaactgactcagttagacccagacggaaccatggaagcccagcgcagcttcgtccttcgtcctgctactcgtggcctcccagactaccacttggagaaactacgtagatgacgcggtctccagcccaccctgtctggtcgtactccgaaggggaaancgccctacctctccgtcgcgtacgggtcctaggtacaggtagttgttacgcgaagctaacgtttacggccgtacgtaccgacgcgaagtaaaactcgtacggacctaacggtcctacccgaggtccttcccgtacaacgttaccgtaaggtacggtactacccgtaacgtaccccgacggtacgggccctacgttcgggtacctaccccgagtaccgttaacggttacctacgggttcggacgtacgggttcgggtaccgttcgggtaaactcggttacgttaccaccttcgacaccgtacgcgtaacgacgtacgtacctcgacgtacgttacgtaacgtaacgttatttacgtattacgtttaacgttacttacgtacgtacgttaacgtaacgtacgttacggaccttacgttaacgttacttacgtaccgtttaacgaaccgttaacggtaaaccgtaacggttaccgtacggttaaacgtaccggtaaaccgttacggttccggtaacgttaccgtacggaaccgttaaccgttacgttccttaggttaccgttaccg

SEQ ID NO: 250684 - DNA, 763 bp, Homo sapiens
  misc_feature: GYAE6OF01BIN3N.44.65.F10.1.454.CMB.1.raw
  modified_base (481)..(481): a, c, t, g, unknown or other
  misc_feature (481)..(481): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctctgtctccgaggggaaagcgccaccctctcctgcgagggccagtcagagtgttggcagcgagcgtagcctggttccagcaagaaacctggccagacctcccgaggcctcctcactctaactaccacactcccgacgacggccctacgtggtacctcccgagccagtacttccgaaggtcggactacggtgggtacgtcggggaactacggtaggtttacccaccgttcctaccgtaaccctacgttaccgaacgccgtaacgccctaggaccgtaacggtttccgtaaggttaaacggtttntttttacgggaaccttttaagggtttttaacttaccgtttgttacgtaacggtaacgttaaggtttaacggtaaacggtttcggttaacccggtttcccggggttacccccttttaccgggttttaccgttacccgggtttccccggggtaccccggttaggggtaaacccccgttacgttaaccggtttaaccggtttaacttaacccggaaaacggtttacccggttagggttccgggtacctaccgtacccttaacccgtagttttcccgggttacccg

SEQ ID NO: 250685 - DNA, 727 bp, Homo sapiens
  misc_feature: GYAE6OF01C5RBU.44.65.F10.1.454.CMB.1.raw
  modified_base (146)..(146): a, c, t, g, unknown or other
  misc_feature (146)..(146): n is a, c, g, or t
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactgggaanaaatagtgatgacgcagtctccagcccaccctgtctgtgtctccgaagggggaaacncgcccaccctctcctgcgagggccagtcagagtgtaccagcaacttgcctggtacccacgaagaaccgtgggacaggcctccgaggcctcctnatctataggaacnctaccaccgagggcccaacgtcggtaacctccccgaaccgtagggttcagggtcggaccgtagggtcggggtacccggaataggtacgttccaactcgtaccaacctagtccgacggcccggcttacggcgttaggtcgtaggtacggttattttcgacgttagttttactacgtacgtacagtactaagttaactaagttaaccgtggtacccttcgttaccggtaaccggtttaccggggggaaccgggggtaactaaggggtacggtaaaccggtaacggttaaccgaaaaacggttaccggttagggtaccgggtaccttacgggaaccccttaaccgtaacgtttcccgttaaccggtttcctttaaccgtacccgttttaccccgttaccccggaacttctttcccggtaag

SEQ ID NO: 250686 - DNA, 703 bp, Homo sapiens
  misc_feature: GYAE6OF01B82DI.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagacgccaccctctcctgcgacggccagtcagagtcgttaccagactaacttacgcctggtaccaccgaagaaccgtgggaccacgggcctacccgaggccttcctaccgtacttctaagttacggaacctacctaccgaccggaacgggtcccaacgtttcggtacctaccccgtacccgtaggtttaccaggtcggaccgtacgggtccggggtaccgggacgtaggtacgttaccaccgtcctaccgacctacgtcgacggccggtcctcggaccgtagtcgtacggaaggtttacgtttcgacgttagttttactacgtgttacagtacttaagtaataactacgtcggtaccttcgtacgtccgggttacggggacggggtaactagggtacggacgtaacgtacgtaaacgtcgtcggtcggactaccgggtaactaccgtagttcgttaccggtttaccttacgtcccgtttacccacccggttactaccggttgttaaccg

SEQ ID NO: 250687 - DNA, 607 bp, Homo sapiens
  misc_feature: GYAE6OF01C8GLY.44.65.F10.1.454.CMB.1.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
  modified_base (284)..(284): a, c, t, g, unknown or other
  misc_feature (284)..(284): n is a, c, g, or t
  modified_base (415)..(415): a, c, t, g, unknown or other
  misc_feature (415)..(415): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagagatcaccggagattattgtgttgacacagtctccaggcaccctgtctttgctccgagggganagagccacctctcctgtacggccaggtcggagtgttgctaagtacctagcctggaccaanagaaacctggccaggcctccaggcctccncatatacgatgcaatccagcaaggccgctggcactcccagacaggttcagtggactaggtgggtctggggactaggtacttcactctcgagcatcgacggcggactgggaactccgtggaacgtactttcnggtacgttaagttttacttagtcgtcgtagacgttagggttatttggggtttcgtaccgttccgttccgtaggttaccggttaccgggaaccgtaaccggggactaaacgggtaggaaactaaccggaaaagtacgttggacgtacgtagacccacgtagttcgtacgtttctctacgttcccgttaccccg

SEQ ID NO: 250688 - DNA, 786 bp, Homo sapiens
  misc_feature: GYAE6OF01B9Q7V.44.65.F10.1.454.CMB.1.raw
  modified_base (144)..(144): a, c, t, g, unknown or other
  misc_feature (144)..(144): n is a, c, g, or t
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (423)..(423): a, c, t, g, unknown or other
  misc_feature (423)..(423): n is a, c, g, or t
tcagacagtatatacacgaccggtgctcgatttagctacgctctaaggggggaggaactgctcagttaggacccagacggaacatggaagccccagcgcagcttctcttcctcctgctactctggctcccagataccatggaanaaatgtgatgacgcagtctccagccaccctgtctgtgtcctccggaaggggaaancgcccctaccctntccgtgaccgacgggccaagtcaagagttcgtaaccagactaacgttcgcctaggaccaacaacgtaaccgtggcgacgcctaccgaggtacctccactagtactaggtacggaactacgtacccaccggtacggccctacgtacggttaccctacccccgacgtagggtacctagggtcggtacggtacgggttacgggggacccggaanacgggttactaccgtaaccgtcctaaccgacacgtacgtaccggcggtccgacggtactggttaccgtagggttagtttagtttaccggtactttaagttttaacttagttaccggtgtaacgtaacgttaagttaaacgttaaacgtaacccgtcggttaccgttaccgttacccggggttaaccgggtttaaccggggggacccggggtaaacggttaaacggggtaggtaaccggtaaacggtaaccggtaaaaaccggttgggtacgttccgggacgtacggtaaccccgtaagtaccgttcgttaccggtactttaccttacccgtccccgtttacccgacgtttagtcggttaaacc

SEQ ID NO: 250689 - DNA, 935 bp, Homo sapiens
  misc_feature: GYAE6OF01B9XD1.44.65.F10.1.454.CMB.1.raw
  modified_base (200)..(200): a, c, t, g, unknown or other
  misc_feature (200)..(200): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggaagaaatagtgatgacgcggtctccagccaccctgtctgtgtctccgaaggggaaancgcccaccctctcctgcgagggccagtcagagtgttagcagactaacttagcctacgtaccagcaagaaactcgtggaccaggcctcccgaggtcctccctcacttcgtagtggtcactaactcccaaccgacggggtccctaacggttcggtaacctccccgaaggtacccgtaagggtttccgagggttccgggaccgtaagggggtttcgggggttaccgttagggggaacgtaacggtacggtttccctaaaccctttccaacccgtaaacccgtacgttaccggaacggtacccgtaacgggtccctcggtaaccccgtaaggtttacccgttaaagggtaaaacggttttaacgttttttcgggaacccgtttttaaaaggttttttaaccgttaaccggtttcgtaaccggtaaacggttaccttaaaagggtttaacttaaaacggttccggttaaaccccggttccggggttaccccccttttaaccccccgggtttacggggaacccccgggtaaaaacggggggtaccccttaaaaccggggttaaccgggttaaacgggggtaaaaaccctttaaaaaccgggtttaaaaaaaccccggggtaaaccggttttcggggttaaacccgggtacccgtttaaaccgggaaaccccccttaaacccggttaacgttttaacccggggtttacccttttaacccgggttttcccttaaaccccccgg

SEQ ID NO: 250690 - DNA, 892 bp, Homo sapiens
  misc_feature: GYAE6OF01EWT3K.44.65.F10.1.454.CMB.1.raw
tcagacagtatatacacgaccggtgctcgatttagctacgctctaaggggggaggaactgctcagttaggacccagacggaaccatggaagccccagcgcagcttctcttcctcctgctactctggctccagataccactggaagaaatgtgatgacgcagtcctccagccctacccgtgttcctggttcgtacctaccggaaagggggaaacgcgcccctacccttcgtccgtggaccgaacggggccctaaggttccgaaggtacgtttacggttaacccgagtacctaaacgttacggccttacggaacccaacgtaacggaaaccggtgggcgaaccggtcctacccggacggtccttaccgtactacgttcgttaacggttcgggtaccaccgtacgtacccgaaccggtacggggtaccctaacggttcgggtaaccctacccgacggtaccgttaggttaccgacgggttcggacggtacgggttcggggttcgtacggggtaactagggttaccgttacctaccgttctacccgaaactacgtacgtaacgaccgtacgtacccgttggacccgtaacgggtcccgtttaaggggtacttttacggttaccggtaccgttttaaacgttttaccgttaccgtaacccgtaaacctttaaacctttaagttttaaccgtttttttacccgtttttaaccggttaaccggttttaacgggttttacggtttacccggggaaccgggtaaaccgggttaaccgtacggttaccggaagggttacgaaaccgttaacgggaaagttaccggttggtaccggtacttacggacccctagtacgttcccgtttaacgtcccgttaacttcccttcccgtacccctaacgg

SEQ ID NO: 250691 - DNA, 729 bp, Homo sapiens
  misc_feature: GYAE6OF01DFOO3.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctaccgaggggaaancgcccaccctctcctgcgagggccagtcagagtgttagcagcaacttgcctcgtaccagacagaaatcgtggccaggcctccgaggtcctcctcactctagtcggtgcctactcccaaccgacgggccacgtcgggtacctccccgagacccgtagggtttccaacggttgggcctagggttcggggtcgttacgggggaacctaagggtacgtttaccaccgttccgtacccaacctactaccgacggtaccctacggccccgttaggaccgtacggttccgttaggtaaacgtttacgttttcggtaccttaggttttacttacgtcgttactacggtactaagttagtaaacgttcggtaaccgttccgggtaccctttcccggttccgggaacccggtaacgggtacccgtaaccggtaacggtaccgggtaaagttaaaccgtttaaaaaccggtacggtttacggtcgggtaccgttacggaccctaaccgttagttcccgtttacgtccgtttacgttaccccg

SEQ ID NO: 250692 - DNA, 635 bp, Homo sapiens
  misc_feature: GYAE6OF01EG2YC.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaancgcccaccctctcctgcagggccagtcagagtgttagcagctaacttacgcctcgtaccagacaagaaactcgtggaccgaaggactcccgaggtcctcctacacttcgtagtggtcgctactcccgaaccgagggccctaacgttcggtaacctcccgagtacccgtaggtttccagggtcggacgtaggggttcggggtcgtagggacgtaaggtcgttaccacgttcctacacctatcgacgctacgcctgcctagtctagtaagtttgtttacgactttagttttattcgtgtactagtataattataacgttcgacgtccgtcccgttcccgtacggaccgaacggaccacgtacgtaggaaagttaaccggttaaacgtacgtggtcgtaccgtacgaccgtacccttagttccttcgttcctcgttacccg

SEQ ID NO: 250693 - DNA, 656 bp, Homo sapiens
  misc_feature: GYAE6OF01ARA2K.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctctgtctccgagggggaaanacgccaccctctcctgcgagggccagtcagagtgttggcagcaggcgtagcctggtccagcacgaaccgtggccagcctcccgaggcctcctcatctataccactactcccaccgacgggccacgtggtacctcccgacgccgaagacttcgacgttcggctacgtggggtcctagggactaggacgttccacgtccgtacacccgatcctagctagcctgacgtgtactggtaagttagttttcgacgttagtttaacgttacgtgtacgtacgtcgtaagttacgtaggtacggtaccgtccggttacccgttacccgtttaccgtaccggtttacccggtacccggttaccggggtaaccctacggttaaccggtaccggttaacgttaaccgtaaaccggttacccgtacggtacgggtacccttacggacccttaaccgtcgttccgttaccg

SEQ ID NO: 250694 - DNA, 669 bp, Homo sapiens
  misc_feature: GYAE6OF01ESF9J.44.65.F10.1.454.CMB.1.raw
  modified_base (193)..(193): a, c, t, g, unknown or other
  misc_feature (193)..(193): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
  modified_base (662)..(662): a, c, t, g, unknown or other
  misc_feature (662)..(662): n is a, c, g, or t
tcagacagtatatacacgaccggtgctcgatttagctacgctctaaggggggaggaactgctcagttaggacccagacggaaccatggaagccccagcgcagcttctcttcctcctgctactctggctccagataccactggagaaatagtgatgacgcggtctcagccacctgtctgtgtctcgaggggaanacgccaccctctcctgacagggccagtcagtgtagttagcagactaagttgcctacgtacagacaagaatcgcggacaggacnccgagctccntatctgtaggtcanacctccgaccgacgggtacctacgttaggtacctaccccacggaccgtaggttcaacggttggaccgtagggttcgggtacgtagggacttaggtagttacctaccttcgtaccactacgtacgtacgaccctacggacgttcggacttaggtttacccgtaagggttaactttaggtttttaccgactttaacgttttttaagttaccttggaaccgttacacgttaaggtttaaactacggttacgaccgttccgggttacccttacccgggttacgaacccggtaagggaccagtaccggttagaagtaaacgttacgaacggtggtacgactacgacctatacgttacgtcttaccgngttaccc

SEQ ID NO: 250695 - DNA, 746 bp, Homo sapiens
  misc_feature: GYAE6OF01CDXMU.44.65.F10.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (366)..(366): a, c, t, g, unknown or other
  misc_feature (366)..(366): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagcccaccctgtctgtcgtctccgaggggaaancgacccaccctcncctggacgaggccagtcaagtacgttgtaaccagacctaacttcgaccgtggtacccaacaacgaaccgttggaccacggcctacccgacggtcctccgtacactctaacgtacgaactacgtacccgaccgacgggtacccacgtcggtaccnccctaccggtagttcgagtcggcgtaggtcggggccggaacgtcgaagttccgactctacgtacctacgtccacccgttagtccctacgacccaacgttacgtaacggttactttcgaactttaccttacgttaactacgttaactaaacgtacgttaacgtttactacccggttacccgttcccgttttaagttacccgggttttaggggaaccgggttaaccgaacggttccggtaacgggtaaccgttaaccggttaaaccgaacgttacggtagggttccgacgttaccggacccttacgtaccgttactttaccggtttctaacccgttaccttccccggttacccgtacttacgttcccttaagtactttaacg

SEQ ID NO: 250696 - DNA, 637 bp, Homo sapiens
  misc_feature: GYAE6OF01BBC69.44.65.F10.1.454.CMB.1.raw
  modified_base (377)..(377): a, c, t, g, unknown or other
  misc_feature (377)..(377): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtcgtctccgaggggaaagacgcccaccctctcctgcagggccagtcagagtgtagcagcaactagcctcgtaccagacagaaatcgtacggccaggcctccgaggcctcctacactctagtggtcgacactcccaccgacggcctacgtcggtactaccccgaggcctaggttcaggtggacgtagggtcgggtcgngggaacgacggttagtccgacttcctaccgaacctacgtacgacggtcaccgtcctagacgtaggttctaaggtaacgttgtttacggactttaagtttacttacgtaggtacaacgtactaagtaagttaactggtaacccgtccgtacccttccggtacggaccgaacggtacacggtagtaacgggtaataaccggtaaacgtacggtaggtacggtacctgaacctacgttactaccgtcgttccctgttaccccg

SEQ ID NO: 250697 - DNA, 907 bp, Homo sapiens
  misc_feature: GYAE6OF01DLYOB.44.65.F10.1.454.CMB.1.raw
  modified_base (214)..(214): a, c, t, g, unknown or other
  misc_feature (214)..(214): n is a, c, g, or t
tcagacagtatatacacgaccggtgctcgatttagctacgctctaagggggaggaactgctcagttaggacccagacggaaccatggaagccccagcgcagcttctcttcctcctgctactctggcctcccagataccacgtggaagaaataggtgaatgaacgcagtcctccacgccctaccctgtctgttcgtccgtaccgaaggggaaacnccgaccctacccctctccgtaggaccgacggggcctaacggttcgaaggtaaggttacgttaacccgaagtaccgttaaaccgtttaccggaccctttacgggtaaaccccaaacctaaacggtaaaacccggttggggaccgtaaccgggtccctacccggacgggttcccttacccgtactattaccgtaacggttaacggaaaacctcctaccccgaaccggtaacggtacccctaccggttacggtaacccttacccccgaaccggttacgggttacgtaggtcggggaaccgtaggggtccgggggtaacccggaaagtacggtacgtttacccacttacccgtacaaccgtaacgtccgacgggtccgtccgtaggtaccgtagttacgttggtaaggtttactttacggttacgttaacggttttaactttcgtacgttacgtaacggtaacgtaagttaaactaaaggttaccgtacggttcccttaccgttacggttaacccgggttaccggggggtaacccgggtaccgggtaagggttacgggaacgttaaaccggtaacggaaaaccggttcggttccgggtacggttaacctacgggtaacccctacgttaaccgttccggtttaaccgtaccgtttaaccttccggttaccccttaccccgcgttaacgtcgttaaacg

SEQ ID NO: 250698 - DNA, 927 bp, Homo sapiens
  misc_feature: GYAE6OF01CVUKG.44.65.F10.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (884)..(884): a, c, t, g, unknown or other
  misc_feature (884)..(884): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatggacgcggtctccagccacctgtctgtgtctcgaggggaaancgccacctctcngcgaggccagtcagtagtgttagcagactaacttagcctggtaacacaaacacgaaccaccgtcggaccgtacggcctacccgagggtcccttccgtactacttctaagtcgtattcggacctaacgtacccgaaaggttaccgggggcccgtaccggggtacctaacccggttaccccgaaacgggtacccgttaaacggggtttccgaaacggggttttcggggacccggttaagggggtttcggggttaaccgtacgggtaaaccggtaacgtaaccggttaacccctttttacgggtaaaaccccgtttcccgtaaaccctaaaccccgttacggttaacccgaaccggggtcccccggggttaaaccgttaaaccggggaaccgggtaaccccgggttaaaaggttttaaccgttttttaaccgggaaccgttttaaggtttttaacctttaacgggtttactaaaccccggttaaaaccggttaccccggttaacggtacccgggttaaaccgggttaccgggttaacccggtttaaacgggtttaacccgggtttacggggttttaccgggacccgggttaaacggggtaacccgtaacgggttcgtaaccggggtaacctaccgttaaaccggtaaaaccgggttacgttacgggtacgtcccggtanacccgtaaacgttccgttagtttccgttccttaccgttacccg

SEQ ID NO: 250699 - DNA, 814 bp, Homo sapiens
  misc_feature: GYAE6OF01BCCIP.44.65.F10.1.454.CMB.1.raw
  modified_base (201)..(201): a, c, t, g, unknown or other
  misc_feature (201)..(201): n is a, c, g, or t
  modified_base (422)..(422): a, c, t, g, unknown or other
  misc_feature (422)..(422): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaattagtgatgacgcagtctccagccaccctgtctgtcgtctccgaaggggaaacncgcccaccctcgtcctgccgagggtcctaggtcgaggtagttacgttaaccaggtacctaacgttacggccctacggtaacccaacgaacggtaaacccgtggggacctacgggcctcccgaaggtccctcgtacagttcctaagtacgggaaccacttacccgaaccggacggggaccctacggttacgggtaccctcccgtaaccccgtaggtttacgnggtacgggcgtagggtacggggttccgtaggggaactaggtacgtttccacgttccacgtacctagtcgaacgctaacgggcctgtacgtacgttacgtaggttaacggtttacgtttacgtaaccgtttagtttaacgttacgtacgttacgtaacggtacgttaacgtaagttacgttacgtaaccgggttccggtttaccccggttaccccggttaccgggtaacccggtaaccgggttaccggaaaccggttacggttaacgggtaacgttaacgttaaaaccggtaccgttacgggtaccggtaccgtacgggtaacccttccgacgtttaaccttcgggtttaccctaccggttacctttaccccgttccccggtaccgttaacgg

SEQ ID NO: 250700 - DNA, 923 bp, Homo sapiens
  misc_feature: GYAE6OF01BHT80.44.65.F10.1.454.CMB.1.raw
  modified_base (340)..(340): a, c, t, g, unknown or other
  misc_feature (340)..(340): n is a, c, g, or t
  modified_base (406)..(406): a, c, t, g, unknown or other
  misc_feature (406)..(406): n is a, c, g, or t
  modified_base (862)..(862): a, c, t, g, unknown or other
  misc_feature (862)..(862): n is a, c, g, or t
tcagacagtatatacacgaccggtgctcgatttagctacgctctaagggggctcttgggaggaactgctcagttaggacccagacggaaccatggaagccccagcgcagcttctcttcctcctgctactctggctcccagactaccacgtggaagaaatagtgatgacgcagtcctccacgcccacccttgtcttcgtcgtccgtaccggaaggggaaacgacgaccctaccctccgtccgtcggacgacgggaccacggtaccgaggtacggttacgttaaccgacgtactaacgttacgacccggttacggtaacccaaaccgaaccggttaaaccgnggggtaacccgaacggtccctccccggaggtcccttacctactacgttaacctacggacgaaaccncccgtacccgaaccggtcggtaacccctacggttaccggtaccctaaccccgaccggttagggttaccagggttccgggacggttacggggtccggggtaccggaaacgacggtttaccgttaccaccgtttaccctaaccgaccgttaaagcccccggtacgggtaaccccggccgttaacggggtaccgtaacccggtttaagggttaaggtttagtttttaccgggaagttttagtttaaccggtttaaacgtttacgtttaccgttaaccgttttaacccgttttaccggttaccgttaccccggtttttacccctttaacccgggtttaccggtttaaccgtttaacccggggtaacccggtaaaccgggtaaccccgttaaaagtacggtaaaacccggttacgtaaaaccgtggttagtaacccggttcgaaccgtaccgttaaccccnggttttaacccttccggttactaccgttccctacccgttcctaaccctagtcgtttaaacg

SEQ ID NO: 250701 - DNA, 755 bp, Homo sapiens
  misc_feature: GYAE6OF01BFEZ8.44.65.F10.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcggtctccagccaccctgtctgtgtctccgaggggaancgccaccctctcctgcagggccagtcagagtgttaggaactacttagcctggtatcaacagacacgtggccaggcctccgaggcctcctcatctangatgcatccaagtcgggccgcgggcactcccgagcctaaggttcaggtcggacgtaggtcgggtctggagactaggtaccttcaccttctaccacctatcgacggccggtaccgtaaggacggtaccgggtaaagttagtttttacggacgtttaaggtttttaacttaccgtttacggttaaccaaaccgttaccgggggttaactacccgggtaaccggttacggggttaacccgttaaaggggttttaaaccgggtttttccggggaacccgggttaaccggggggtaaaccctaaagggttcccggtacgggtaaaccgttacccggttaaaccggtaaaaaccgggttaacggttacgggtaccgggttaccgttaccggacccctaaccgttaccgttaccgtttaccgtttacctttacccgttacccgtttccccgttccccccggttaacccg

SEQ ID NO: 250702 - DNA, 772 bp, Homo sapiens
  misc_feature: GYAE6OF01BE6MT.44.65.F10.1.454.CMB.1.raw
  modified_base (184)..(184): a, c, t, g, unknown or other
  misc_feature (184)..(184): n is a, c, g, or t
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagactaccactggagaaatagtgatgacgcggtctccagccaccctgtctgtntctccgaaggggaaagcncccaccctctcctggcgagggccagtcagagttgttagcagcaacttcgcctacgacagacaagaactcgtcggccaggcctccgaggtacctcctcatactagtggtacncctactcccgaaccggtacgggacctacgttacggtacctaccccgagcccgtaagtccgttacgacggttacgggccgtagggttaccggggtcgtacggggaactacggtacgttacctaccgtccgtacctaaacctacgtaccgacggtacctacggtcctacggaccgttaacggttcgttaaggttaaactttcggttttaacgtacgttttaaacgtttttacgttaaccgtttggtaaccgtaacggttaacgttaacggtttaacttacgggtaacgttaccggttccggtttacccccgttcccggttaaccgggtacccggaaacggggtcccgtaaacgttaccggtagggttaaaaccggttaaaccggttaaacggaccggtttaggtaccggtaccgtaacggtaccctaacccgttagtttcccgttaccgtttcttaacccg

SEQ ID NO: 250703 - DNA, 918 bp, Homo sapiens
  misc_feature: GYAE6OF01EXBM6.44.65.F10.1.454.CMB.1.raw
  modified_base (912)..(912): a, c, t, g, unknown or other
  misc_feature (912)..(912): n is a, c, g, or t
tcagacagtatatacacgaccggtgctcgatttagctacgctctaagggggaggaactgctcagttaggacccagacggaaccatggaagccccagcgcagcttctcttcctcctgctactctggcctccagataccactggaagaaatagtgatgacgcagtctccagcccacctgtctgtcgtctacggaaggggaaacgcgcccaccctctccgtgaccgacggggcctagtacaaggtagttacgttaaccaggtacctaaacgttacggtacccgttaccggtaaccccaaccgaacggtaaaacccggtcgggggaccaacgggcccttacccggaacggtcctaccgtaccattaccgtaacgtaacgggaacctaccgttaccccggaaaccgggtaccggggacccttaaaccgggtttaccgggtaacccctaccccccgtaaacccggttaggggtttaccaacgggggttccgggaaccggtacggggggtttaccggggggtaaccccggaagtaacggggttacccggtttacccaacccggtttaccccgtaacccgaaacccgttaacgggtacccggtaccggggttacccggtacccgtttaggaaccccgggtttacggtttcgggttaacggggttaaccggtttttaagtttccgggtaaaccgtttttaaggttttaaccgttccgttagggtaacccaggtttaaccgtaaagttaaccttaagtacccgttcgtcccctttagggtaccgtttaccggggttaccggggggacccgggtaataagggttacggacttaaccgtaacggaaaggttcggcggttcggaccttagacccttaagtccgttcgttactcttacctaccgttcccgttacccgattacggtnttaaac

SEQ ID NO: 250704 - DNA, 967 bp, Homo sapiens
  misc_feature: GYAE6OF01AT9ZZ.44.65.F10.1.454.CMB.1.raw
  modified_base (62)..(62): a, c, t, g, unknown or other
  misc_feature (62)..(62): n is a, c, g, or t
tcagacagtatatacacgaccggtgctcgatttagctacgctctaagggggaggaactgctnagttaggacccagacggaaccatggaagccccagcgcagcttctcttcctcctgctactctggcctcccagtataccacgtgggaagaaatagtgatgacgcagtcctaccacgcccacctgttctgtcgtccgtaccggaaggggaaacgacgaccctaccctccgttccgcggaccggacgggccaacggtacgaacggtacggttacgttacccgaacgtacctaaacgtttacggacccgtacggttaaacccgaaccgtaaacggaaacccggttagggaccgaaccggtaccccgtacccgacggttccctaacccgtactaacgttaccgtaaagtaccggtaaacctaacccgtacccgaacccggaccgggtaccctaaaccgttacggttaaccccgacccccgttaacccggtagggttaccggtacggtaccgggacggtacggggtaccgggggtaaccggaactaacgggttacgttcccgtaactaccctaccaaccgttactaccgacggtaccgtaccgtccgtacgtaacgtaggttcgtaaagggttaaacgtttacgtttttacgaaacgtttaagttttaacttaccggtagttaacccaacggtttaaacgtaacgtttaaaacgttaaccgggtacgtaaccccgggttccgggttaaccccctttcccgggttaaacccgggaaccccggggttaaagggttaaccccaacgggggttaaaccgttaaggggtaaacgttaaaacccgggttaaaacttacggggtttacgggaccggtaaccgttaccgggaacccttaacctacggtttttacccgacctttttaaaccggttcctaacccccgggtttacccccaacccgttagtttcttaaaccccg

SEQ ID NO: 250705 - DNA, 745 bp, Homo sapiens
  misc_feature: GYAE6OF01EGFQX.44.65.F10.1.454.CMB.1.raw
tcagacagtatatacacgaccggtgctcgatttagctacgctctaagggggaggaactgctcagttaggacccagagggaaccatggaagccccagctcagcttctcttcctcctgctactctggctccagattccacggctaaattttgtgacacaatctcacgcctaccctgttctttgtccgtaccgggggaacacgccacccttctcgttcgccgacgggccggacagtacgttggttacgacgtacgtacgttacgccgtacggtaaccaacgacggaacggtccgtacggaccgacggtccctacccgagtaccttcctactacttcttagtcggtcgacctacgtaccccgaaccggacgggtaccctacggttacggtaccctacccggacgtaccggttaggttaccgaggtcggacgtgggttcgggtacgtacgggaactaggttaccgttcaccgttaccaccactacgtacgacgtcgaacgtccgtcgtacagttacgtagtaactttagtttacgatttacgtttactaccgttgtactacgtaacgttaaggttaactacggttacgtaccggttccgtaccccgttaccggtacggaaccggtaaccgggtacgtacggttaacggtacgaaacggttaacttaacggtaggttcgcgttacaccggtaccgtacttacgtacgtttaccgtcttaacgtcttcccctacgtacacttcggtataacg

SEQ ID NO: 250706 - DNA, 856 bp, Homo sapiens
  misc_feature: GYAE6OF01DIQUS.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagcccaccctctcctgcgagggccagtcgagagtgttagcagactaacgttacgcctcgtaccagcagaaatcgtaggccgaaggtcctacccgaggcctcctactaacttctaggtcggtacgacctacgttaccccgaaccgacggggtacccctaacggttacgggttaaccttacccccggaagtcccggtaacgggtttaccgacgggttacgggaccgttaaggggttccgggggtaccggttacgggggaaaccgtaacgggttacggtttaccctaaccgttcccgtaccgaaaccctaacgttccgaacggtaccaaccggtccctgggtaccgtaacgggttcttaacgggtaaaacgtttacggttttttacggaacttttaacgggtttttaaactttaccggtttaggttaacccgtaaaggttaccgttaaagtttaaacgtttaaacgttacgggttaaccgttacccggggttcccccgtttaccccggttaaccggggaacccggtaaacggggttaaccccaaccgggttaacgggtaacgggttaaacgtaaaccggttaaaaccggtacgtttaacgggttccgaccgttacgaacccgttaccttaacgttccgtttacgtaccgtttccgtaacccg

SEQ ID NO: 250707 - DNA, 776 bp, Homo sapiens
  misc_feature: GYAE6OF01B27EF.44.65.F10.1.454.CMB.1.raw
  modified_base (143)..(143): a, c, t, g, unknown or other
  misc_feature (143)..(143): n is a, c, g, or t
  modified_base (193)..(193): a, c, t, g, unknown or other
  misc_feature (193)..(193): n is a, c, g, or t
tcagacagtatatacacgaccggtgctcgatttagctacgctctaagggggaggaactgctcagttaggacccagacggaaccatggaagccccagcgcagcttctcttcctcctgctactctggctccagataccactgganaaatgtgatgacgcggtctcaggccacctgtctttgctaccgaggggaancgccacctctcctgcgagggccagtcagtagtgttacggaactacgttagccttaggtataccaacgacgtaccaccgtcggacccgaacggtccctcccgacggtccttcccgtactacttcctaagtcgtacgttacggcctaaccgttacccgaaacggtaccggggttcctaaccggttacggaccccgaaaccccgtaggaaccgttacggttaccgagggttcggacgttagggtcggggttacgtacggggtaactacgtaccttaccgtaccgttacctaccggtacccgtacgacggtaacctaacggtcgtaaccaccggtaccgttaaggttaacgtttacgttttaggacgtttaagtttacgttacgttggtaacgtacgtattaaacgttaattaacgttacgtacggtccctttaacggtacggttaccgggtttaccgggggaccggggtaacgtagggtacggtaacgtacgtaaccggtaaacggtcggtaggtacggtacgtaccgtacgtaccttgttacccgttctcccgtttactacccgtttccgtccccgtagttaccg

SEQ ID NO: 250708 - DNA, 760 bp, Homo sapiens
  misc_feature: GYAE6OF01CIHIZ.44.65.F10.1.454.CMB.1.raw
  modified_base (201)..(201): a, c, t, g, unknown or other
  misc_feature (201)..(201): n is a, c, g, or t
  modified_base (755)..(755): a, c, t, g, unknown or other
  misc_feature (755)..(755): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtcctccagccaccctgtctgtcgtctaccgaaggggaaancgaccaccctcgtcctgaccgaggccagtcagagtcgtaccagctaacttagcctggtaacccaccaacgtaaacccgtgggaccaacggcctacccgaaggccttacccgtactacttaccttaaacgtaccgggtaaacctaaccgttaccccaacccgtacgggggtaccccaaacggtttacgggtaccctaacccccggtaaccccgttaaggggttaccctaggttcggacggttacgggtaccggggttaccggacgtaacgtacggttaccaaccttcgtacccaaccgtaatcccgaacggtccggtcccgtacgaccgtaggtcgtagggttacggttcgttttaggtaaccgttaagtttttataacttggtacctacggaccttacggttcccgtttacctcccggtacgggccctcgtacgtaccggtttcgggggaccggggtaactggggtacgagtacgtcgaaggaccggtaaggtcgggtacacgtacgtacctagtccgttacgtctttactccgttccttaacccgctaccgtntaccg

SEQ ID NO: 250709 - DNA, 628 bp, Homo sapiens
  misc_feature: GYAE6OF01C9ZMG.44.65.F10.1.454.CMB.1.raw
  modified_base (145)..(145): a, c, t, g, unknown or other
  misc_feature (145)..(145): n is a, c, g, or t
  modified_base (277)..(277): a, c, t, g, unknown or other
  misc_feature (277)..(277): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (369)..(369): a, c, t, g, unknown or other
  misc_feature (369)..(369): n is a, c, g, or t
tcagacagtatatacacgaccggtgctcgatttagctacgctctaaggggggaggaactgctcagttaggacccagacggaaccatggaagccccagcgcagctttctcttcctcctgctactctggctcccagataccatgganaaatagtgatgacgcggtctccagccacctgtctgtgtctaccggaaggggaacacgcccaccctctccgtgcgagggccagtcagtagtgtagcagactaacttcgcctacgaccagacaagaaagtccgnggaccgacggtcctaccgagccttcctcacttcgtagtcggtnctacncccgaacggccggctacgtcgtaccaccgagaccagtactacgnggtcggactacggtgggtacgtagggacaggttacgtctacgtcctacgaccactcgaacgtcacctccgtgacgtaagttcgtaagtaagttgtttcgatttagtttactcgtagtccgaatagttaatagttaacgtcggtaaccgttccgtacccttccggttacggaccggaacggtacccgaacggaggttaggaaacgtaacgttaaacggacggttgaccgtcacgtaccgtactagtttctcgttctaccg

SEQ ID NO: 250710 - DNA, 875 bp, Homo sapiens
  misc_feature: GYAE6OF01DQTXG.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctccagataccactggagaaatagtgatgacgcggtctccagccacctgtctgtgtctaccgaaggggaanacgccctaccctctccgtgccgacgggccaggtaccaggagttgttagcacgtactaaacttacgacccttcgtacccagaccaagtaaaactcgtacgggaccctaacggtccgtacctacggtcccttacctcctacgttaccgttaagtcggttacggacctaacctacccgaacccggtacggggccctaacgttaccggtaacctacccccggacgtaccgtacggtttacccgtaaggtcggtacggtacggggttacgggttaccggtacggggtaactaacggtaacggtttacccaaccgtttccgtaacccgtaaactacggttaacctacgacccgtaaggtccccttacggaaccgttaacgttaccggttaagtaaaacggtttaacgttttcggtacttttaacggttttttaacgtttacgttaccgttacgtacggttaacgttaacgtttaataaaacggttcggttaaacccgttccggggttaccccctttaccgggtacccgggtaaaccccggttaagggaacccgtaacggttaacccgggtaaggtaaaacggttaacccgtttaaaaacggtaccggtttagggttaacggaacccgttaccggaacccctaacggttaacctttccggtaaccgtttcgttacccgtaaccccg

SEQ ID NO: 250711 - DNA, 910 bp, Homo sapiens
  misc_feature: GYAE6OF01AFIFH.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctccagataccactggagaaatagtgatgacgcagtctccagcccaccctgtctgtgtctaccgaggggaaacgacgcccaccctctcctcggcagggccagtcgagagtcgttaccagactaacgttacggacccgttcgggtaacccaaccgtaacggtaaaacccgtcgggggaccaacgggtcccctaccccggaacgggtcccttacccgttcactttaccgtaggttacgggtccggacctaaccgtccccgaaaccccggtaccgggggtacccctaaccggttacgggtaacccttacccccggtaaccggtcccgtaaagggtttccgtaacggggtacgggtaccggttaacggggttcgggggttaaccgggtacgggggtaaacccgttaagggtacccgtttccgtaaccttacccttacccgaaacccgttacgttaccggaacggtcccgtaacgtacccggtacggtaccgttaacgggtttaccttaacggggttaaagttttaacgtttttacggtaacgtttttaaggtttttaaccgtttacggttacgtaccggtacggtacgttacgggtacgtaacggaacccgtaacgggttaccgggtacgtacccgttacccgtaaccgggttacccgggaaccggtaacgggaacccgttaacggaccgggtaaggttaaaacggtaaacgtttaaacccggtagttcgggttacggtaccgtcgaacccgttaacgtacttaccgttccgttccgttaccttacccg

SEQ ID NO: 250712 - DNA, 794 bp, Homo sapiens
  misc_feature: GYAE6OF01ES5GY.44.65.F10.1.454.CMB.1.raw
  modified_base (207)..(207): a, c, t, g, unknown or other
  misc_feature (207)..(207): n is a, c, g, or t
tcagacagtatatacacgaccggtgctcgatttagctacgctctaaggggggaggaactgctcagttaggacccagacggaaccatggaacgccccagcgcagcttctcttcctcctgcttactcgtgcctcccagactaccactggagaatgtgatgacgcgtctcacgccaccgtgtctagtcgtccgtaccggaaggggaaacncgcccaccctcgtcctggccaacgggcctagtcaggtacgttgtacgctagacttaactcgccgttacaccagctaagaaattccgacggactaggactccgaacgtcctactctattaccgtagtagggtcaccttaaccgtcccgaaccgacgggtacctaacggtcggtacctccgaacggtcctaaggttcgaaggttccgagtaggtcgggtacgtagggactacggtaacttcgaccgtcctaccgtaaactacggtacgtacggaccctacgggtaccttacgggtaccttacggttacggttaaaggttaaacgtttacgttttaaccggtattttaacggttttaacgtacgttacgtacgtacgggttaactaagttaaacgttagtaccggtttaacccggtcgggttacccccttaccccggggttaaccggtaacccgggtaaacgggtaaccccgtagggttaaacccggaacggttaaaaggttaaggtaaaacccgttcgggttaaccggtaggtcccgaacgtaacctaccgtttaactaccgtttcgtttaacccttaccgttaccccg

SEQ ID NO: 250713 - DNA, 702 bp, Homo sapiens
  misc_feature: GYAE6OF01AW85I.44.65.F10.1.454.CMB.1.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactaggagaaatagtgatgacgcggtctccagccaccctgtctgtgtctccgaaggggaancgcccacctctcctgccagggccagtcagagtgttancgagactaacgttcgcctacgtaccagcaagaatcgtcggccaggcctaccgaggtcctcctctactcgtagtggtncacgtcccgacggacgggtccacggttcggtacctcccgagtccggttacggtcgtacggtggtaccgtacggggtcgggtacgtaggggactaggttaaccgttctaccgttctacctaacgtactcgacgcctaacggtccgtgacgtagttccgtaaggttaattcgtttacgaactttagttttacgtacttacggttaccgaagttaccgtaagttaagttcgtaaccggttacccgttaccggtacccttccccgggttaacggaccggtaacggacctacggttaacggtacggtaaaacgtaacgttaaacccggtaggttacgggtcccgtacgtacggtaaccctaccgttagtttccgtacgttccttaccgttacccg

SEQ ID NO: 250714 - DNA, 730 bp, Homo sapiens
  misc_feature: GYAE6OF01EJIOG.44.65.F10.1.454.CMB.1.raw
  modified_base (167)..(167): a, c, t, g, unknown or other
  misc_feature (167)..(167): n is a, c, g, or t
  modified_base (206)..(206): a, c, t, g, unknown or other
  misc_feature (206)..(206): n is a, c, g, or t
tcagacagtatatacacgaccggtgctcgatttagctacgctctaaaggggggaggaactgctcagttaggacccagacggaaccatggaagccccagcgcagcttctcttcctcctgctactctggcctcccagataccactggaagaaatgtgatgacgcagtcnccagcccaccctgtctgtcgtcctaccgaaggggaaacncgccccacccttctccgtcggaccgacgggcccagtaccgagtacgttacgtaccagtacctaacgttacgccgtaacggtacccaaccgaacgaaaccggtggaccgtacggcctacccgacggcctcctacattctatgatcgactactaccggaagtccgggccgcggacaccgtcccgacgccgttacggtcgaggtcgtacgtaggttcgggtccgtaaggacgaaccggtactaccgttacctaccgtcctaaccgaccgtagtacccgacgggtacccgtaccgtaacggacccggtaaccgggttaaggtttaccgtttacgtacgtttaagtttaaccttaccgttcgtaaaccctaccggtacgtaccgtcggtactcgggttaaccgtaggttcggtacgggttccgggaccggtaacggaccaggtcggacggtactacgaaccgaaccgtacggtgtaccggcacgaccctacgtacgttcctaccgttctaccgttccgtcccgttaccg

SEQ ID NO: 250715 - DNA, 747 bp, Homo sapiens
  misc_feature: GYAE6OF01D5P9T.44.65.F10.1.454.CMB.1.raw
  modified_base (202)..(202): a, c, t, g, unknown or other
  misc_feature (202)..(202): n is a, c, g, or t
  modified_base (709)..(709): a, c, t, g, unknown or other
  misc_feature (709)..(709): n is a, c, g, or t
tcagacagtatatacacgaccggtgctcgatttagctacgctctaagggggaggaactgctcagttaggacccagacggaaccatggaagccccagcgcagcttctcttcctcctgctactctggcctcccagactaccactggaagaaatgtgatcgacgcagtcctccagccctacccttgtctttgctccggagggganacgacgccctacccgtcttaccgtgtaacggcctaggtcggagttgttcgactaacgtacctagtccgtaggtaaaccaacgaacgaaaccgtcggacccaacgggccctacccgaaggtccttcctactaatctaactgactcgactacaccgaagcggtcacgcgacccaccgagacgtacgtcaggcgtcgaggttcggtcgagggacctagtaccttaccactcctacacacgtacagtacaggtactacgggactaccgttaaggtaacgtttacgtttagaacttaacgggttatttaacgttacgttacggtaacctaggtaacgtttagttaactaccggttaacccttaaccgtccgggttaacccttgggttaaaccccggttaccggttaaacccgggaaccggaaaggggttaaacccgtaaaggggttaaccaaaaagtaacccggtaaaacggttcgtacgggaccggttactacggaaccctaacccggttntttaccgttacgttacctcccgttacggttaccccacc

SEQ ID NO: 250716 - DNA, 759 bp, Homo sapiens
  misc_feature: GYAE6OF01DDEPL.44.65.F10.1.454.CMB.1.raw
  modified_base (469)..(469): a, c, t, g, unknown or other
  misc_feature (469)..(469): n is a, c, g, or t
tcagacagtatatacacgaccggtgctcgatttagctacgctctaagggggaggaactgctcagttaggacccagacggaaccatggaacgcccagcgcagcttctcttcctcctgctactctgctcccagataccactggagaaatagtgatgacgcggtctccagccacctgtctgtgtctacgaaggggaacacgccacctctcctgcgaggccattcagtagtgtagcagtcaacttacgcctcgtaccagacaagtaaacgtccgtcggaccacggtccctacccgaggtccccttactacctacttacgtagttcggtacgacctaaccgtaccccgaacgggtaccggggtacctaacggttaccggttaaccaccccgtaacggtccggttaacggttcggtaaggtcggtaccggttaaggggttcgggtacggttacgggaacggttaagtcggttacncccttaacgtaccaaccgtctacgtccgaacgccgtacgtccgtaaggtacgttacgttagtaaacgtttgtttacgttattaaagtttcttaacgtcgttacgtaatcgttaagttaactaacttaccgggtaccgtacgggttacccctccgggtttaaccggaccgggttaaaggacccggtaaccggttaacgggtagttaaaccggtaaactttaaacgggacgtttacgggctaaccgggtacgtaccgtaactacgttcccttaggtcccttacgttaccccg

SEQ ID NO: 250717 - DNA, 894 bp, Homo sapiens
  misc_feature: GYAE6OF01A0N1K.44.65.F10.1.454.CMB.1.raw
  modified_base (122)..(122): a, c, t, g, unknown or other
  misc_feature (122)..(122): n is a, c, g, or t
  modified_base (802)..(802): a, c, t, g, unknown or other
  misc_feature (802)..(802): n is a, c, g, or t
tcagacagtatatacacgaccggtgctcgatttagctacgctctaaggggggagaactgctcagttaggacccagacggaaccatggaagccccagcgcagcttctcttcctcctgctactntggctccagataccactggaagaaatagtgatgacgcagtcctccacgcccaccgtgtctgtcgtctacggaaggggaaacacgcccctaaccccttctcccgtaggaccgacgggaccagtaccgaggtacggttacgtaaccgaggacctaacgtttacggacccgttaggtaaccccaaccgaacggtaaaacccggtcggggtaccaaccggggtccccttaccccggaacgggttcccttacccgtaccgttaacgttacttaacggtacggaaacctacgtaccccgaaccggtaacggggtcccctaaggttccggttaacccctacccccgtaaacggttcgggttaccgacgggtcgggtaccgttaggggtaccggggacggtaacgtaaggttaccggttacccaccgttaccaaccgtaaccctacgtacgggcggtacccggcgtatacccgtagggttcgtaagtaacgggtttctttacggtacttttaaggttttactacggtacgtccgtaacgtaacgttaaagttaacgttaacgtaccggacgttacccttaccggtttaaccggttccggggtaaccgggggaaccgggggtaaacgttagggggaacgttaaccgtaagtaacccggttaaaccgggtacgttggtacccgggtaacncccggtaacccctagttaacgttccgtttaaccggtaccctttaccgggttaacccctttcccggtaaccccgtttactgttaaccgttacg

SEQ ID NO: 250718 - DNA, 829 bp, Homo sapiens
  misc_feature: GYAE6OF01CK1I4.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaagcgcccaccctctcctgcgagggccaagtcagagtgttagcagtctacgttacgcctaggtaaccaacgaacgaaaccgtggaccaggcctacccgaggtctcccgtacatctagtggtacgccactaccgaaacgtacgggaccctacgtacggtaccctacccccgaaccgtaggttaccgaggttcgggacgtaacgggttcgggggtaccccggggaaagtaacggtaccggttttacccaaaccgtttcccgtacccgaaacccgttaaaccgttccggaaacccgggtcccggggttaccccgttggtcccggaaaggtttacccggttagggttaacgggtttaactttttacggaaccgttttaaaggtttttaaccgtttacggtttaccgtaccgtaacgtacgttaaagtttaacttaaaactttaaccgtccgggttacccttccgttaaccgttaaccgggtttcccgggggaccggggggtaacctaaggggttacgggtaacgaagttaaccggaaaaccgtaacggttacgggtcggtaaccggttacgacccgtaaccctacgttaccgttcggttaccttacccgtttcttcccccgtttaccgacccttaacg

SEQ ID NO: 250719 - DNA, 795 bp, Homo sapiens
  misc_feature: GYAE6OF01EWZF4.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctcagccaccctgctgtgtctcgaggggaaagcgccaccctctcctgcagggccagtcagtagtgttcgacaaccaccaccagtctttactacgcctaggtaccagcgagaacgccgtcggaccacggcctaccccgaggccttcccgtacaacgttaactaaccggacttcggactaactaccacggaccgaaaccgggcccgcgttacgggactaacctaccccgaaggaaccgtagggtttcgaacggtggggaccgtagggtggggtccgttacgggggaaccttacggtaaccgtttcctaacctttccgtacgaaccggtaccgtaacgttccggaacgggtaccgggtaaccggtagggtaaccgaccccggttagggtaacgggcttttaccggtcggttacctttaaaggttttacctttaaccgttgtaccgtacggtacgtacgggttttagttcggggtttacgttaccgttaaccccgttcggttaccgggttaaccggtttcccgggtaacccgggttaaaccgggaaccggttaacggggtaaacggtaaaacgttaacccggaaaacgttaaccggttaggtaacggttaaccctagtaaccccgtaagttaacccg

SEQ ID NO: 250720 - DNA, 910 bp, Homo sapiens
  misc_feature: GYAE6OF01C8ZXJ.44.65.F10.1.454.CMB.1.raw
  modified_base (202)..(202): a, c, t, g, unknown or other
  misc_feature (202)..(202): n is a, c, g, or t
tcagacagtatatacacgaccggtgctcgatttagctacgctctaaggggggaggaactgctcagttaggacccagacggaaccatggaagccccagcgcagcttctcttcctcctgctactctggcctcccagataccactggagaaatagtgatgacgcagtcctccagccaccctgtctgtgtctccgaagggggaaancgacccaccctctccgtggcgagggcctagtcagacgttcgtaaccagacctaacgttgcctaggtaccccaacgaacggaaaccgtgggggaccaacgggtcccttacccgaagggtcctttacccccgtataacttaccgttaaggtacgggaaaaaccctccgttacccccgaaaaccgggaaccgggggtccccctaaacccggtttcggggtttaaaccctaccccccccggtaaaccccggttagggggttttaaccaaccggggttacggggcccgtaagggggtttccgggggcccccgggtaaagaaccgggttaaacggtttcccaacctttaccgtacccaaccgttaagtccgggaacggcccggtcccgtttaggaccgttaaggttccgttaacggtacgggtttaactttttcggacgtttaacgttttttacgtaacgttcggttaccgagtaacgttaaacgtttaaagtaaacgtttaaccgttcggtacccctttagtttacccgggtttaaccggggttttaccggggggaaccgggggtaaccgtaagggggtacggtaaccggttaactaccggaaaacgttacggttacggtacggggttactacggacccgtaacgttacgtttaccgtttcgtttaaccttccgtaccgtttacccccgttaccgtacctcgttaccgttaag

SEQ ID NO: 250721 - DNA, 728 bp, Homo sapiens
  misc_feature: GYAE6OF01CKMIK.44.65.F10.1.454.CMB.1.raw
  modified_base (144)..(144): a, c, t, g, unknown or other
  misc_feature (144)..(144): n is a, c, g, or t
  modified_base (198)..(198): a, c, t, g, unknown or other
  misc_feature (198)..(198): n is a, c, g, or t
  modified_base (320)..(320): a, c, t, g, unknown or other
  misc_feature (320)..(320): n is a, c, g, or t
  modified_base (425)..(425): a, c, t, g, unknown or other
  misc_feature (425)..(425): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactgganaaatagtgatggacgcggtctccagccacctgtctgtgtctccgaaggggaacncgcccaccctctcctgcgacgggccagtcaggagttgttacgactaaacgtacctagccttaggtaaccaactagacctaccgtggaccaggccctacccgaggtcctccctgacttctaangtactcgactactaccgaaggtcgggccggtcggctaccgtcccgaggtccgtacggttacagggtcggctagggttcgggtctaggactacgtacgtccttacnccttacgaccacctaggtcccgacggcccggtacgtacgggaccggtaaccgggttaagtttacgttttacgtacgtttaacgttttaacgttacgtacgttaccgaaccgtacggttacgaccggtacgttccggtacgttacgggtacgtttacgggtttaccgggaccggtaacgggtacaacggtcgtacgggtaccgtaccgtaacggtaaaccgttacggtcggttacgggaccttcggaccctacgttccgttaccggtttacgttaccctttacctcgtttcccccgttaacccg

SEQ ID NO: 250722 - DNA, 635 bp, Homo sapiens
  misc_feature: GYAE6OF01BJS5D.44.65.F10.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (363)..(363): a, c, t, g, unknown or other
  misc_feature (363)..(363): n is a, c, g, or t
  modified_base (456)..(456): a, c, t, g, unknown or other
  misc_feature (456)..(456): n is a, c, g, or t
tcagacagtatatacacgaccggtgctcgatttagctacgctctaagggggagaactgctcagttaggacccagacggaaccatggaagccccagcgcagcttctcttcctcctgctactctggctccagataccactggagaatagtgatgacgcggtctccagccacctgtctgtgtcctccgaaggggaaacncgcccaccctntccgtgcagggccagtcagtagtgttagcagcctaacgttcgcctcgtaccagtacaagtaactcgtacggaccacggtcctaccgagtcctactcgattcgtagtggtacacctactcccgacgaggcctagtggtacctccagtccgtagtccnggtcgactagggtcggtacagggactaggtcgttacaccgtctaaccgacctacgtacgacgctacgcgtacgcgtacgtactagtaacgttntttacgacgttaagtttactacgttggtactgtactagttacgtcggtacgtacgtccgttacccgtttacgttccgtaaccggttaccgcccggtaggttaccctagtacggttacctacgttactaaacggtgttcggtcgtaccgttacgacgttaccgtctacggtcgtaacccg

SEQ ID NO: 250723 - DNA, 758 bp, Homo sapiens
  misc_feature: GYAE6OF01AJ8J2.44.65.F10.1.454.CMB.1.raw
  modified_base (201)..(201): a, c, t, g, unknown or other
  misc_feature (201)..(201): n is a, c, g, or t
  modified_base (722)..(722): a, c, t, g, unknown or other
  misc_feature (722)..(722): n is a, c, g, or t
tcagacagtatatacacgaccggtgctcgatttagctacgctctaaggggggaggaactgctcagttaggacccagacggaaccatgggaagcccagcgcagcttctctcctctgctactctggactccagactaccactggaagtaaatgtgatgacgcgtactccagcctacctgtctgtcgtctaccgaaggggaacncgccctaccctctacctggaccgacgggtaccaggtactaggagttagttagactacggactaacgttcgaccttacgaaccagacaacgtaactcggacggaccaaggtaccctaccgaacggtccttcccgtatactacgttagcggtcactacctaccggacggtacggccttaaggtcgtaaccgtcctaggtaccgaggttaccagggttacggaccgtaggggttacgggtccctaaggggtacccgtaggtccggttaacctccttacggacctaaacgtacgccgtaacggctaacggtcccgttagacgttaaccggtcgttaaacggttaacggtttagtttacggaaccggttttagtttaactcggttacacgtaaagtcgttaaacgttaacggtaagttaccgtacggtcggtaccctttacccgggacgtaccgaaacgggtacccgtaagtaccggttaaggaaacctttaaccgggtaaccgattcggggactccggtaaaccnctacgggttaccttagttaccttgttaccgtacccg

SEQ ID NO: 250724 - DNA, 896 bp, Homo sapiens
  misc_feature: GYAE6OF01A5WC2.44.65.F10.1.454.CMB.1.raw
  modified_base (170)..(170): a, c, t, g, unknown or other
  misc_feature (170)..(170): n is a, c, g, or t
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (681)..(681): a, c, t, g, unknown or other
  misc_feature (681)..(681): n is a, c, g, or t
  modified_base (834)..(834): a, c, t, g, unknown or other
  misc_feature (834)..(834): n is a, c, g, or t
tcagacagtatatacacgaccggtgctcgatttagctacgctctaagggggaggaactgctcagttaggacccagacggaacatggaacgccccagcgcagcctttctcttccctcctgcctacgtctggcctcccagactaccacgtggaagaaatagtgaactggacncgtacgtcctaccacgccccaccttggtcttgggtctccgtaccggaaggggaaacnccggtcccctaccccgtnttccgcggacggacgggcccaagttccgaggtaacgtttacgttaaccgaccggtaacctaaacgtttcggcccgtaacgggtaaccccaaccgaacggtaaccggtcgggaccgtaccggcccgtacccgtacggtccctaccgtctacgttacgtacgtacggtaacacctaccgaaccgacgggtaccctacgtaccggttaccctaccccggtaacccgtaccgggttacgtaacccgggtgggaacccggtcggggttacccggggtaaccgggtaccggtaacggttaaccggtttaccgtacccgttacccgtaaccgttaacccaccgtacggtccgtaccccggtactccggaacgttcggtaccgtagggttaccggtttcgtttacgttcgtttaacggtttacttaaccgtcggaaccggttanacgttaaaccgtaatttaacgaaccgtttccgtacctccggttaacggttaccgggttaaccgggggtaccggtaacggggtagggtaccggaagtaaccgttaacggaacgttacgtgggtaccgtacggtaccgtcctaaccgtcggtttntaccccgttagtttaccccgtaaccttacccgggttaccgttcccgtaattccgggtaaacc

SEQ ID NO: 250725 - DNA, 687 bp, Homo sapiens
  misc_feature: GYAE6OF01B3XIH.44.65.F10.1.454.CMB.1.raw
  modified_base (322)..(322): a, c, t, g, unknown or other
  misc_feature (322)..(322): n is a, c, g, or t
  modified_base (639)..(639): a, c, t, g, unknown or other
  misc_feature (639)..(639): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcggtctccagccaccctgtctgtgtctccgaaggggaaagacgccaccctctcctgcgagggccagtcaggagttgttagcacgactaacttcgcctacgtaccagacaagtaactcgtcggccaggtcctcccgacggcctccctacattcttagtcgggtnaccgacctacccgaccgacggggtaccctacgtacggttacctaccccgacgtaccgtaacgggttcacgggttcggagtacggggttcggggtaccgtaaggggacgtacggttacgtttaccgaccttccgtaccaacctacgtacacggaccgacgtccctgacgtagttacggtagtaacgtttagtttacgtagtttacggttttaatacgttcgtacacgtactaagttatacgtacgtaccgtcgttacccgttccggttacggaacgtacggacgtaccggtaggtaggtaaacgtaacgttaaacggngtggtcgcggtacacccgtacttcgtagtttccttacttcccgtaccg

SEQ ID NO: 250726 - DNA, 628 bp, Homo sapiens
  misc_feature: GYAE6OF01AQK4S.44.65.F10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (311)..(311): a, c, t, g, unknown or other
  misc_feature (311)..(311): n is a, c, g, or t
  modified_base (520)..(520): a, c, t, g, unknown or other
  misc_feature (520)..(520): n is a, c, g, or t
  modified_base (592)..(592): a, c, t, g, unknown or other
  misc_feature (592)..(592): n is a, c, g, or t
  modified_base (616)..(616): a, c, t, g, unknown or other
  misc_feature (616)..(616): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaatagtgatgacgcggtctccagccaccctgtctgtgtctccgaggggaaancgccaccctntcctgcagggccagtcagagtgtagcagctaacttagcctacgtaccagcaagtaaatcgtcggccacggcctcccgaggtcctcctcgtactccgtagtcggtnaccgtacttacccaccggaacgggccctacggtagtacctccccgagccgtaggttcaggtcgcgtaggtgggtctaggggactagtcgtctactccgtacacctagtcacgctacgtcctgtactcggttactaggtaacgttacgttttgacgtttacgttttacgttacgtacgtactagtcgtaagtttacgtgtaccggttacncgggttacccttaccgtaccggacgacggacgtacggtacgtacggaataaccgttaacgagttggtacgtntaccgtactactacttcgtacttntacccgttaccg

SEQ ID NO: 250727 - DNA, 668 bp, Homo sapiens
  misc_feature: GYAE6OF01EJY1B.44.65.F10.1.454.CMB.1.raw
  modified_base (194)..(194): a, c, t, g, unknown or other
  misc_feature (194)..(194): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctcaggggaaancgccaccctctcctgcgaggccagtcagagtgtagcagctaacttagcctcgtaccagcagaaactcgtggccaggcctccgaggcctcctctatctagtcggtcacgtacctcccgaacgacgggcctacgtggtacctcccgagaccgtaggttccaggttcggactagggttcgggtcgtaggggactaggtacttaccgaccttcgtaccaccgtactaccgacgaccgtacgcccgtagcctaacggttcgtaaggtaactttacgttttacgtacctttaaggtttttaccttacgtcggttactaacggtactagttaattaagtaccggtacgttaccgggtccccttacccgggttaccggaaccggtaacgggtaccaacggttaacgtacgggtaaacttaacggtaaccgtagttcggtacggtcctacgcgtaaacctgttacctacgttccgtctacccg

SEQ ID NO: 250728 - DNA, 885 bp, Homo sapiens
  misc_feature: GYAE6OF01AYZQK.44.65.F10.1.454.CMB.1.raw
  modified_base (144)..(144): a, c, t, g, unknown or other
  misc_feature (144)..(144): n is a, c, g, or t
  modified_base (151)..(151): a, c, t, g, unknown or other
  misc_feature (151)..(151): n is a, c, g, or t
  modified_base (206)..(206): a, c, t, g, unknown or other
  misc_feature (206)..(206): n is a, c, g, or t
  modified_base (823)..(823): a, c, t, g, unknown or other
  misc_feature (823)..(823): n is a, c, g, or t
tcagacagtatatacacgaccggtgctcgatttagctacgctctaagggggaggaactgctcagttaggacccagacggaaccatggaagccccagcgcagcttctcttcctcctgctactctggcctccagataccatggaanaaatgtnatgacgcgtctaccagtccaccttgtctagtcgttaccaccggaaggggtaaacncgtcccctaacccgtcgttacccgtaggacccggtagggacccctaaggttaccgaaaggttcgtttacggttacacgtaacggtaaccttaaaccgtttacggaccgtttacccgtaaccgagaaccaaaggtaaaaccgttccgtaccggtacgaaccggtacccgtacccgtaacggtcccttacccggttactaaccgttaccggtttaacgtccggggttaacgacctaaccgttaccccggaaaccggtaccgggtaaacccttaccgttacgggttaacccttaccccgtaacggtaccgtacgggtttaaccaggggtacgtaccggagggtttcgggacggtacgggtacgaattaaccggttctaaccgttccggtaaccacgtacgtacccgaacgccgtacggtcccgtagtaccggtaaccggttaactaacgtaagtttaacgttttacggttaactttaaagttttaccgtacgttaacggtaaccaagttaacttaaagtacgttaaggtaccgtaccggtaccgtttacccgtaccgtttaccggaaccgtaacggaaccgtacgaaacggtacggtaacgttaaaaccgtaaacgttanacgggttaccgactaaccgactaacccgttataccgggtttactacccgttacgtaaccccg

SEQ ID NO: 250729 - DNA, 755 bp, Homo sapiens
  misc_feature: GYAE6OF01AU3L2.44.65.F10.1.454.CMB.1.raw
  modified_base (156)..(156): a, c, t, g, unknown or other
  misc_feature (156)..(156): n is a, c, g, or t
  modified_base (165)..(165): a, c, t, g, unknown or other
  misc_feature (165)..(165): n is a, c, g, or t
  modified_base (230)..(230): a, c, t, g, unknown or other
  misc_feature (230)..(230): n is a, c, g, or t
  modified_base (347)..(347): a, c, t, g, unknown or other
  misc_feature (347)..(347): n is a, c, g, or t
  modified_base (701)..(701): a, c, t, g, unknown or other
  misc_feature (701)..(701): n is a, c, g, or t
  modified_base (747)..(747): a, c, t, g, unknown or other
  misc_feature (747)..(747): n is a, c, g, or t
tcagacagtatatacacgaccggtgctcgatttagctacgctctaaggggggaggaactgctcagttaggacccagacggaaccatgggaacgccccagccgcacgctttctccttcctcctgcctacttctggcctccagactaccacgtggaanaaatgtganaggacgccagtcctaccacgccctaccgttgtcctggttcgtaccgtcggaaacggggggaaacncccgaccctacccgttcgtaccggtcgaccgacgggcctaggtacgtaggtacgtacgtaccgagacctaacgtaccgtccgtacggaccaacgaacgacgcggacgcggacctccncgtcctactacactcgacgacgaccacgaccacggaccgtccgactccgtacctacccgtacggtcgttacgaccggtcggcggtacgggtacgggtacggacgtacggtacgtacccgcttaccgtaaccacgtacggaaccggtcggaccggtccggtcgtaaccgtcggttaacgttacggttaacggtttctttacggtttacgttttacgtttacttaaccggtcgtacggtaacgtacttacgttaacgtacgttcggtctaccgttcgtacggttaccggggtaccgggcgggacggtaacgtacgtacgaacgtacgtaacggtcgtacgggtcgacctacccggngttaacctcggttacgttcctacttccggtacctccgttacccgtntgtacgtc

SEQ ID NO: 250730 - DNA, 700 bp, Homo sapiens
  misc_feature: GYAE6OF01CIMBF.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagattccaccggcgaaattgtgttgacacaatctccagccacctgtctttgtccgtccggggaacgacgcccacctctcttgcgagggccgcagctgtgacgacgatagcctaggtaccaacgagaacgtccgtcggaccacgggtccctacccgaacgtccttcctactacttcctaacgtgtaacttacctttagtaacgggtccgggccttgtcgctacctcccgtacgcccgttcttacgacggtcgtcggtagggtcgtcgtaggaacgacgtacgtacgtcctacctacactaccgtacgtcgacggccggtaccgtaaggaccgggtaccgtaaggttacgtttacgtactttaacggtttacttacgttacggtaacctaaccgtacgtacgaccgtaccgtacggtaccgttaaggttacgtaggtttaccgggacggacgggtaaccaggtaccgtagggtacacgtaacgtaaccggtacgtcggtacgtacgtccgaactccgttagtcgttccgttctacccgttacttcccgtccctaactcgttagtagttaacg

SEQ ID NO: 250731 - DNA, 905 bp, Homo sapiens
  misc_feature: GYAE6OF01DF3WH.44.65.F10.1.454.CMB.1.raw
  modified_base (141)..(141): a, c, t, g, unknown or other
  misc_feature (141)..(141): n is a, c, g, or t
  modified_base (201)..(201): a, c, t, g, unknown or other
  misc_feature (201)..(201): n is a, c, g, or t
tcagacagtatatacacgaccggtgctcgatttagctacgctctaagggggaggaactgctcagttaggacccagacggaaccatggaagcccagcgcagcttctctcctctgctactctgctcccagataccaccggagngattgtgttgacgcagtcctccagaccctaccctgttctttcgtctccgaagggggaaanacgcccaaccctctccgtgacgacgggcccagtcaggtacgttagtagcagtacctacttacggccttacggtaaccaacgaacggaaaaccgttcgggacccaacggtcctacccccgaggtaccttaccctactaacgtgttaacgtcgggttacgaccgtaaccgttaacccggaaaacggaccgggggtaaccctaaccggtttacggacccaaccgttacccccgaaggtaaccccgtacggttaacgaacggttcggacgtagggtttcggggtactacgggggtaccaacggttaaccgttcctaaccttaccgtacccgaaaccctagtacggaactaccggaacgtaccgtaacggtaccgtaaccgttaggtaaacgttactttttacgggaaacttttaaggtttaaccgtaagtaccgttaggtaaccggacggtaacgtacgggtacgtaaccggtaacgttaaaccgggtacgggacccggtaactaaccccgttaccggggttaacccgggaaccggttaaacgggaacccggaaacccgttacgggtaaacgggttaaacgtaaacgggttttaaaaaaccggtaacgggtttacggtaaccggggtaaccgttacccggaaaccgttacccgggttaaacgtttcccggttttcccgggttaaacctttcccgggttaaaacccccg

SEQ ID NO: 250732 - DNA, 879 bp, Homo sapiens
  misc_feature: GYAE6OF01EL2YE.44.65.F10.1.454.CMB.1.raw
  modified_base (206)..(206): a, c, t, g, unknown or other
  misc_feature (206)..(206): n is a, c, g, or t
tcagacagtatatacacgaccggtgctcgatttagctacgctctaaggggggaggaactgctcagttaggacccagacggaaccatggaagccccagcgcagcttctcttcctcctgctactctggcctcccagataccacgtggaagaaatagtgatgacgcagtcctcagcccacctgtctgtcgtcgtaccgaaggggaaacncgcccaccctctacctggacgacggggccagtacgagtcgttacgttaaccgaagccttaaacgttacggcccgttacgggtaaccccaaaccgtaacggtaaaacccggttcgggggaccgaaccgggtcccgttaccccgaacgggtcccttaccccttacgtaacttaccgttaacgtaccggggaaacctaaccgtaccccggaaacccggtccgggggtaccctaacgttaccggggtttaccctacccccgtaaccccggtacgggtttaccggacggttacggggtaccgtaacggggttccggggggacccgggtaaacgtaacgggtaaacgtttcccggtaacttccccgtaaccgaacccgtacgttaccgacgggtaccccgtccgtacggaccgtaggttaccgttaggtaccggttagttttcgaacctttagtttaaccgttacgttcgttacgtaccgtagtaacgttaagtaggttacctaccggttcggtccccttaccggtacccggaaccggtaacgggtacccgtaacgggtaccgtaagggtaacgtaacggttaacggtaacgttcggtaccgggactaccggtacctaaccgttcggttccttagtcccttacgttcccgttacccgtcccgtactccgtacgttaacg

SEQ ID NO: 250733 - DNA, 846 bp, Homo sapiens
  misc_feature: GYAE6OF01B1KHI.44.65.F10.1.454.CMB.1.raw
  modified_base (207)..(207): a, c, t, g, unknown or other
  misc_feature (207)..(207): n is a, c, g, or t
tcagacagtatatacacgaccggtgctcgatttagctacgctctaagggggaggactgctcagttaggacccagacggaaccatggaacgcccagcgcagcttctctctcctgctactctggctcccagactaccactggagaatagtgatcggacgcagtctccgagcccaccctgtcctgtcgttcgtaccgaagggggtaaacncggcccacccgttcgtcctaggccaacgggccaggtcaggacgttcgttaaccgacgacctaacttacggacccgtcggttaaccaccgaagtaaacccggttggaaccgtacggtacccgtacccgagggtccctacgttaccaacgttcgtaaccgtaggaaaacctccgttacccgaaccgtaccgggccttaacggtacgggtaaccctacccccgtaacggtttaacgggtccgtacggtacggtaccggtaacggggtttcggggccccgggaaattccggggtaaagtttcccggtacttaaccccgtttccggaaaaccctgggttacccgtacggccggggttccccttaacggacccggttaaggtaccgttaggggacggttttaacgtttcggtaccttaagggttttaaacctcgggttactacggtacgttacgtaacgggtaactttacggactttaccggtccgttaccgttcccgaaccgggttaacgaaccgggaacgttacggaacccggttaagtacggttaaccctaaacgggtcgttagggacggtacgtaccgtccgtaaccgttacgtcgttcgttacctttccgactttcccgaccgtacctccgtggttaccc

SEQ ID NO: 250734 - DNA, 800 bp, Homo sapiens
  misc_feature: GYAE6OF01AS699.44.65.F10.1.454.CMB.1.raw
  modified_base (200)..(200): a, c, t, g, unknown or other
  misc_feature (200)..(200): n is a, c, g, or t
tcagacagtatatacacgaccggtgctcgatttagctacgctctaagggggagaactgctcagttaggacccagacggaaccatggaagccccagcgcagcttctcttcctctgctactctggctccagataccatggaagaaatagtgatcgacgcggtactccacgccaccctgtctgtgtccacggaaggggaaacncgaccctaccctctcctggccgcgggctagcaggagttgtgcacgacttaactcgccctacgtaacagaccgaacgtaaacgtcgtacggaccgacggtccctacccgaggtacccttcctacgactttaaccggtggtacggttcctccgtaacctaccccgaccggtacgggtacctaccggttacggtaccctaacccggaccggttaaccggttacgggttacgacggggttacggacggtttacggggttaggggtacccgttagggaaaccggttaacgtaccggtttctaccccgtcctaccgtaaaccgaactccggaagtcccgtagtacccgtggtacctaggttacccgaagtttaacgtttcttaacggtccgttttagttttaccgactttcggtagtagtaacgtaaacgttacgttacgtacgtccggtttcccgtacccggttacccggtaccggaacgggtaccgggtaaacgtaccggtaaacggtccggtaaaggttaaacccgttaacgggcggttacgggtacggtcccgtaactaacccgttacgttacctaacggtttccttcgttacctaccccgg

SEQ ID NO: 250735 - DNA, 1073 bp, Homo sapiens
  misc_feature: GYAE6OF01DQWO2.44.65.F10.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
tcagacagtatatacacgaccggtgctcgatttagctacgctctaaggggggagggaactgctcagttaggacccagacggaaccatggaagcccagcgcagcttctctcctcctgctactctggctcccagataccactggagaaatgtanatcgacgcagtctccagcccacctgtctgtcgtctaccgaggggaaagcnccacctcacctgcgagggccaggtcagtagttcgttaccagtcctaaacgttacgcccgtacgtaccgaagtaccgaacgtaaaacgtccgttacgggaccccgaacgggtaccctaccccggaagggtcccccttaccgttaccctaacgttacccgttacgtttccggggttacggaccttaacccgttacccccggtaacccggaaccggggggtccccttaaaccgggttcggggttaaccctacccccccgggtaaggtaccccccggttaaaggggtttacccgtaaggggttttccggggaccggttaaacgggggttccgggggggtttaacccggtttacggggggaaaacccggttaaacgggttaacccgggtttttcccgtaaacccgttttacccccgttaaccgaaaccccctttaacgtttacccggaaaccggggtccgtaaaccccgggttccccggttacgggtacccgttaaaccgggttttaccggttaaaggttaaaaaccggtttttcggttttacggttaaccgggttttaattttttaaccggttacgtttacggtaacgttaacggtaaccgtttaaagggttaaactttaacgggttaacccgggttaaccggtttccccgggtttaacccgtttaccccgggtttccccggggaaaccggggtacccgggtaaaccggttaaacccggggtaacggttaaccgggggtttaaaaccgttaaaccggtaaaaaccccggggttaaaagttccgggggtttaacggaccccggttaacgggtaccccgttaaaccggtttaacgtttccccgtttaaacggtttcccttttccccggtaaaccccg

SEQ ID NO: 250736 - DNA, 500 bp, Homo sapiens
  misc_feature: GYAE6OF02IG03R.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggccactggtatcccagccaggttcagtggcagtgggtctgggacagagttcactctcaccatcagcagcctgcagtctgaagtattttgctagtttattactgtcagcagtataataactgccttctctactttcgggcggggtaccaagggtggagatacgaaacgtactgtggctgcaccatctgtcttctac

SEQ ID NO: 250737 - DNA, 511 bp, Homo sapiens
  misc_feature: GYAE6OF02IRYA1.44.65.F10.1.454.CMB.1.raw
  modified_base (284)..(284): a, c, t, g, unknown or other
  misc_feature (284)..(284): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaccagcaacttagcctggtaccaccagaaacctgggcaggctcccaggctcctnatctatggaacatccaccagggccactggtactcccaccaggttcagtgcagtgggtccgganagngttcactctcaccatcagcggcctgcagtctgaggtntttgctagtttattactgtcagcagtataatactgcctctctacgttcgggcggggtacaagggtggagatacgaaacgtactgtgctgctaccatctgttcttcacttcctcccgctatctag

SEQ ID NO: 250738 - DNA, 508 bp, Homo sapiens
  misc_feature: GYAE6OF02GVCNK.44.65.F10.1.454.CMB.1.raw
  modified_base (197)..(197): a, c, t, g, unknown or other
  misc_feature (197)..(197): n is a, c, g, or t
  modified_base (500)..(500): a, c, t, g, unknown or other
  misc_feature (500)..(500): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttaccagcaacttagcctggtaccaccagaaacctgggcaggctcccaggctcctcatctatggaacatccaccagggccactggtactcccaccaggttcagtggcaggtgggtccggacagagttcactctcaccatcagcggcctgcagtctgaggtattttgctagtttattactgtcagctagtataatactgcctctctacgttcgggcggggactagggtggagatacgaaacgactgtgctgcactatctgtctctctcctccnctatctag

SEQ ID NO: 250739 - DNA, 547 bp, Homo sapiens
  misc_feature: GYAE6OF02HH0OM.44.65.F10.1.454.CMB.1.raw
  modified_base (369)..(369): a, c, t, g, unknown or other
  misc_feature (369)..(369): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttaccagcaacttagcctggtaccaccagaaacctgggcaggctcccaggctcctcatctatgatgcatccaacgagggtcactggcaccccagacaggttcagtggcagtgggtctgggacagacttcactctcaccgtnagcaatgtacagcctgaagtattttgctagtttattactgtcagcagtccgttcctccgacggtccgcgttactaccgtttccgggacgggggtacctaagggtcggacgacgtacgaggacgaacgttggtcggctggccacctagttcttgtccttacacttccgttccccgtacc

SEQ ID NO: 250740 - DNA, 489 bp, Homo sapiens
  misc_feature: GYAE6OF02I3VY3.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggccactggtatcccagccaggttcagtggcagtgggtctgggacagagttcactctcaccatcagcagcctgcagtctgaagtattttgctagtttatactgtcagcagtataatgactgcctcccttcggccaagggacacgactggagagttaaacgactgtgctgcacatctgtcttctac

SEQ ID NO: 250741 - DNA, 517 bp, Homo sapiens
  misc_feature: GYAE6OF02FMES8.44.65.F10.1.454.CMB.1.raw
tcagacagtatatacacgaccggtgctcgatttagctacgctctaagggggctctggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaccagcaacttagcctggtaccaccagaaacctgggcaggctcccaggctcctcatctatggaacatccaccagggccactggtatcccacccaggttcagtggcagtgggtccgggacagagttcactctcaccatcagcgcctgcagtctgaggtatttgctagtttatactgtcagcagtataataactggcctctctacgtttcgggcgggggtaccaagggtggagatacgaacgaactgtggctgcaccatctgtcttcacttcctcccgtcc

SEQ ID NO: 250742 - DNA, 521 bp, Homo sapiens
  misc_feature: GYAE6OF02GU58F.44.65.F10.1.454.CMB.1.raw
  modified_base (354)..(354): a, c, t, g, unknown or other
  misc_feature (354)..(354): n is a, c, g, or t
  modified_base (503)..(503): a, c, t, g, unknown or other
  misc_feature (503)..(503): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctggtaccaccagaaacctgggcaggctcccaggcctcctcatctatggaacatccaccagggccactggtactccccaccaggttcaggtggcaggtcggggtccgganaggagttcactctcaccatcagccggcctgctagtctgaggtattttgctagtttattactgtcagcagtataatactgcctctctacgttcgggcggggtacctaagggtgagatacgaaacgacgtgtgctggcacatctgtcttcnctccttcccgctatctag

SEQ ID NO: 250743 - DNA, 500 bp, Homo sapiens
  misc_feature: GYAE6OF02GTP7G.44.65.F10.1.454.CMB.1.raw
  modified_base (472)..(472): a, c, t, g, unknown or other
  misc_feature (472)..(472): n is a, c, g, or t
  modified_base (497)..(497): a, c, t, g, unknown or other
  misc_feature (497)..(497): n is a, c, g, or t
tcagacagtatatacacgaccggtgctcgatttagctacgctctaagggggagctacaacaggcaggcaggggcagcaagatggtgttgcagacccaggtcttcatttctctgttgctctggatctctggtgcctgcggcgacatcgtgatgacccagtcaccagactccctggctgtgtctctgggcgagagggccaccatcaagtgccagtctagccagagtattttgaacagctccgacaggaagaactaccttgcttggtaccagcagaaaccaggacaacctcctaaaactcctcatttactggtcatccaccgggactccgcgtccctgaccgattcagaggcagcgggtctgggacagacttcactctctccatcagcagcctcagctgaagatgtggccgtttatactgtcagcaattatttcacttgttcctcgaacccttcggccaagggacacgactgganattaaacgaactgtgctgcaccatntcg

SEQ ID NO: 250744 - DNA, 509 bp, Homo sapiens
  misc_feature: GYAE6OF02GCACI.44.65.F10.1.454.CMB.1.raw
  modified_base (328)..(328): a, c, t, g, unknown or other
  misc_feature (328)..(328): n is a, c, g, or t
  modified_base (461)..(461): a, c, t, g, unknown or other
  misc_feature (461)..(461): n is a, c, g, or t
tcagacagtatatacacgaccggtgctcgatttagctacgctctaagggggaggaactgctcagttaggacccagacggaaccatggaagccccagctcagcttctcttcctcctgctactctggctcccagataccaccggagagattgtgttgacacaatctccagccaccctgtctttgtctccgggggaacagccaccctctcttgcagggccggccagactgttgacgacgacttagcctggtaccaacagaagcctggccaggcctcccagacctcctcatctatgatacttctagtagggcctctggcatcccagccccgnttcagtggcaggtgggtctgggacagacttcactctcaccatcaccagcctagacgcctgaagtattttgctagtttattactgtctacacgtaagagtgcctcaatatcacttcgcctggaccaagtgatanacaaacgactgtgctgcaccatctgtcttcactccttcccgctatctg

SEQ ID NO: 250745 - DNA, 605 bp, Homo sapiens
  misc_feature: GYAE6OF02IPVF7.44.65.F10.1.454.CMB.1.raw
  modified_base (198)..(198): a, c, t, g, unknown or other
  misc_feature (198)..(198): n is a, c, g, or t
  modified_base (415)..(415): a, c, t, g, unknown or other
  misc_feature (415)..(415): n is a, c, g, or t
tcagacagtatatacacgaccggtgctcgatttagctacgctctaagggggaggaactgctcagttaggacccagacggaaccatggaagccccagcgcagcttctcttcctcctgctactctggcctcccagataccactggagaaatagtgatgacgcggtctccagccaccctgtctgtgtctccgaggggaaangccaccctctcctgcagggccagtcagagtgtagcagcaacttagcctcgaccagcagaaatctggccaggcctcccaggcctcctcatctatggtgcactccaccgaggtccaactggtactcccagccctaggttccaggtcggactaggtgggtctgggacaggtagttcacgtctaccaccatccgaagccagcctagcctagtctagaagtntttgcttaagtttacttacttgtcagtcaagttaataagtcgacttacggtcccttacccgtttacgggaccgtaaacgggtaccaacggtaccgtagggtaacgtaaacggttaaaaccggtaacgttgggtaacggtaccttaggaccctaaccgtaacgttccgttacggttcctttacttaacccg

SEQ ID NO: 250746 - DNA, 481 bp, Homo sapiens
  misc_feature: GYAE6OF02HFIYZ.44.65.F10.1.454.CMB.1.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
  modified_base (462)..(462): a, c, t, g, unknown or other
  misc_feature (462)..(462): n is a, c, g, or t
  modified_base (478)..(478): a, c, t, g, unknown or other
  misc_feature (478)..(478): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcagaaatctggccaggctcccaggcctcctcatctatggtncatccaccaggccactgtactcccagccaggttcagtgcagtgggtctgggacagagttcactctcaccatcagcagcctgcagtctagaagtatttgactagtttatactgtcagcagtatatgactgcctccgtcgccaaggacacgatgagtataaacgactgngctgcacatctgtctntac

SEQ ID NO: 250747 - DNA, 499 bp, Homo sapiens
  misc_feature: GYAE6OF02GBWSX.44.65.F10.1.454.CMB.1.raw
  modified_base (200)..(200): a, c, t, g, unknown or other
  misc_feature (200)..(200): n is a, c, g, or t
  modified_base (496)..(496): a, c, t, g, unknown or other
  misc_feature (496)..(496): n is a, c, g, or t
tcagacagtatatacacgaccggtgctcgatttagctacgctctaagggggaggaactgctcaagttaggacccagacggaaccatggaagccccagcgcagcttctcttcctcctgctactctggctcccagtataccactgggagaaatagtgatgacgcggtctccagccaccctgtctgtgtctccaggggaaagngccaccctctcctgcagggccagtcagagtgttagcagcaacttagcctcgtaccagcagaaatctggccaggctcccaggcctcctcatctatggtgcagtccaccagggccactggtatcccagccaggttcagtggcagtgggtctgggacaggagttcactctcaccatcagcagcctgcagtctgaagtatttgctagtttatactgtcagcagtataatgactgcctcccttcggccaaggacacgtactggagtagtaaacgactggtgctgactacgattctgtcttntac

SEQ ID NO: 250748 - DNA, 514 bp, Homo sapiens
  misc_feature: GYAE6OF02GFDX8.44.65.F10.1.454.CMB.1.raw
  modified_base (196)..(196): a, c, t, g, unknown or other
  misc_feature (196)..(196): n is a, c, g, or t
  modified_base (350)..(350): a, c, t, g, unknown or other
  misc_feature (350)..(350): n is a, c, g, or t
  modified_base (512)..(512): a, c, t, g, unknown or other
  misc_feature (512)..(512): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaccagcaacttagcctggtaccaccagaaacctgggcaggctcccaggctcctcatctatggaacatcccaccagggccactggtactcccaccaggttcagtggcaggtgggtccgganagagttcactctcacatcagcagcctgcagtctgaagtattttgctagtttattactgtcagtcagttatagtgactggccttccgttcacgtttcggccctgggacctacagtcgatttacaacgtactggtggctgcaccatctgtcttcacttctcccncc

SEQ ID NO: 250749 - DNA, 519 bp, Homo sapiens
  misc_feature: GYAE6OF02GKGK8.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggccactggtatcccagccaggttcagtggcagtgggtctgggacagagttcactctcaccatcagcagcctgcagtctgaagtattttgctagtttattacttgtcagtctagtattaatagtactcggtcccttcccgttcggaccgaaagggaccacgactaggagtaagttaaacgaacttggtggctgaccactacttctcgtcttctac

SEQ ID NO: 250750 - DNA, 507 bp, Homo sapiens
  misc_feature: GYAE6OF02IZXWK.44.65.F10.1.454.CMB.1.raw
  modified_base (195)..(195): a, c, t, g, unknown or other
  misc_feature (195)..(195): n is a, c, g, or t
  modified_base (349)..(349): a, c, t, g, unknown or other
  misc_feature (349)..(349): n is a, c, g, or t
  modified_base (482)..(482): a, c, t, g, unknown or other
  misc_feature (482)..(482): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaanagccaccctctcctgcagggccagtcagagtgttagcagcaacttagcctcgtaccagcagaaatctggccaggctcccaggctcctcatctatggtgcatccacagggccactggtactcccagccaggttcagtggcagtgggtctgggacngagttcactctcacgtcagcaatgtacagctgaagtatttgctagttattactgtacagctagccgttcctccgaggtccgtactctaccgtttcgggccgggggtaccaaggtggagatcagacgtaatcgnggctgcacatctgtcttcattcccg

SEQ ID NO: 250751 - DNA, 504 bp, Homo sapiens
  misc_feature: GYAE6OF02I0DTI.44.65.F10.1.454.CMB.1.raw
  modified_base (501)..(501): a, c, t, g, unknown or other
  misc_feature (501)..(501): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagcccaccctctcctgcagggccagtcagagtgttagcagcaacttagcctcgtaccagcagaaatctggccaggctcccaggctcctcatctatgatgcatccaacagggtcactggccaccccagacaggttcagtggcaggtgggtctgggacagacttcactctcaccatcaccagcctagacgcctagaagtatttgctagtttattactgtctactaccgtaagagtcgcctacaatacttctacttcgccgtaggaccaagtgatatacaacgtactgtgctgacactatctcttctntac

SEQ ID NO: 250752 - DNA, 525 bp, Homo sapiens
  misc_feature: GYAE6OF02HDU1C.44.65.F10.1.454.CMB.1.raw
  modified_base (195)..(195): a, c, t, g, unknown or other
  misc_feature (195)..(195): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtgtaccagcaacttgcctggtaccacagaaacctgggcaggctcccaggctcctcatctatggaacatcccaccgagggcccacgtggtactccccaccgaggttcaggtggcaggtcggggtccggacaggacgttcacttctcaccatcagcggcctgctagtctgagtatttgctagtttatactgtcagcagtataatactgcctctctacgttcgggcggggtacaagggtcgagtagtacgaaacgtacgtgtgctgacactatctgtcttctacttccttcccgctactctacg

SEQ ID NO: 250753 - DNA, 560 bp, Homo sapiens
  misc_feature: GYAE6OF02JF8RR.44.65.F10.1.454.CMB.1.raw
  modified_base (205)..(205): a, c, t, g, unknown or other
  misc_feature (205)..(205): n is a, c, g, or t
  modified_base (367)..(367): a, c, t, g, unknown or other
  misc_feature (367)..(367): n is a, c, g, or t
tcagacagtatatacacgaccggtgctcgatttagctacgctctaaggggtaggaacgtgctcagttacggacccagacggaaccatggaagccccagcgcagcttctcttcctcctgctactctggctcccagataccacgtggagaaatagtggactgacgcagttctccagccaccctgtctgtgtctccgaggggaaacgngccaccgtctcctgccaggccaggtcagagtcgtaccagcaacttagcctggtaccacagaacctggcaggctaccaggcctctcatcctaagtcggaacatccaccgagggccactggtactccccacctaggttcaggttcggactaggtcggtccgganagtacgttcactctcacatcaggccgtcctgctagtctagtacgtattttcgacgtagtttaacttacgtcgtacagtactaagttataacttactcgtacctctactacgttcggcggggtacaaggtcgtagtagtacgaacgacgtgtcgctgctacgagtctgtctcacgtcctccgctacgtcgtacg

SEQ ID NO: 250754 - DNA, 500 bp, Homo sapiens
  misc_feature: GYAE6OF02HN0LT.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggccactggtactcccagccaggttcagtggcagtgggtctgggacagagttcactctcaccatcagcagcctgcagtctgaagtatttgctagtttattactgtcagcagttataatgactgccttcccgttcgccgaaggacacgactggagtaacgttaaacgactggtcgtcgtgcacatctgttcttctac

SEQ ID NO: 250755 - DNA, 705 bp, Homo sapiens
  misc_feature: GYAE6OF02G1QLA.44.65.F10.1.454.CMB.1.raw
  modified_base (115)..(115): a, c, t, g, unknown or other
  misc_feature (115)..(115): n is a, c, g, or t
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
tcagacagtatatacacgaccggtgctcgatttagctacgctctaaggggagggaacgtggctcagttaggaccagacggaaccatggaagcccagcgcagcttctctcctcctnctactctggctccagataccactggagaatagtgatgacgcagtctccagccacctgtctgtgtctccaggggaancgccacctcnctgcagggccagtcagngtgtaccagcaacttagcctggtaccaccanaacctggcagcctccaggctccnctacncttaancggaactactccaccgacggggccaactcgggtaacctccccgaacccgtaggtttaccgagtcgggacgtaggttcgggggttaccccgggataacggtacgggtttccaactttacccgtccgaaccgtacgttaccgaggggcccggtcccttagggacccgtaggtacgtacggtacgggtactttttacggaccgtttaggttttaacttttacgtcggttactaacggtcttaaacgggtttaacttaaaggttcgtaacgttcggtacccttacccgttcgggaccgtaaacggggtaccacgggtaccttagggaaccgtaagtttaaaaacccgacgttagggtacggtactacggtaccaacttacgtctacggtttactcgtacttcccgttcccgaccttatccgttacg

SEQ ID NO: 250756 - DNA, 539 bp, Homo sapiens
  misc_feature: GYAE6OF02G3XTX.44.65.F10.1.454.CMB.1.raw
  modified_base (196)..(196): a, c, t, g, unknown or other
  misc_feature (196)..(196): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaccagcaacttagcctggtaccacagaaacctgggcaggctccaggctctcatctatggaacatcccaccagggccactggtactcccaccaggttcagtggcaggtgggtccgganagngttcacgtctcaccatcagcggcctgctagtctgaggtattttgctagtttattacttgtcagtcagtataattaactggcctcgtcacgtttcgggcgggggtaccaagggtgagtatacgaaacgtacgtgtacggcgtacgctaccatccttgttccttaccacttccgttcccggcctatctacg

SEQ ID NO: 250757 - DNA, 774 bp, Homo sapiens
  misc_feature: GYAE6OF02JZJND.44.65.F10.1.454.CMB.1.raw
  modified_base (195)..(195): a, c, t, g, unknown or other
  misc_feature (195)..(195): n is a, c, g, or t
  modified_base (231)..(231): a, c, t, g, unknown or other
  misc_feature (231)..(231): n is a, c, g, or t
  modified_base (280)..(280): a, c, t, g, unknown or other
  misc_feature (280)..(280): n is a, c, g, or t
tcagacagtatatacacgaccggtgctcgatttagctacgctctaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgtaccngcaacttagcctggtaccaccagaacctgggcaggctcccaggcctccnctatctatcggaaccagtccaccgaggccacgtcggtaactccccaaccgtaggttccacggttcgggctacgggtcggggtacccggaacacggtacgtttccgaactttcccgtaccgaaccctagtacccggacggtccccgggcttcggaccgtaaggttccctaggtaaaccggtttgttttttcggacttaaaggttttttaacttacccggttcgtaccggaaatcggtttaaacgtaattaacggttaccgtaaccttcggggtacccccttttacccgggtttcgggaaaccctaacggggggtaaccccttaacggtaaccgttaacgggggtaaaattaaacccgtttaaaaaccggggtaacgtgggttaccgggtacgtttaacccggaaccccgttacctaggttttaaccccgtggttttaaccctttacccggtaacgtttccccctttaccccggactttacccgtacgttttaacg

SEQ ID NO: 250758 - DNA, 525 bp, Homo sapiens
  misc_feature: GYAE6OF02FWX61.44.65.F10.1.454.CMB.1.raw
  modified_base (350)..(350): a, c, t, g, unknown or other
  misc_feature (350)..(350): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttgccagcaacttagcctggtaccaccagaaacctgggcaggctcccaggctcctcatctatggaacatccaccagggccactggtactccccaccaggttcagtggcaggtgggtccgganagagttcactctcaccatcagcggcctgcagtctgaggtatttgctagtttattactgtcagctagtataatactgcctctctacgttcgggcgggggtaccaagggtggagatacgaaacgacgtgtggctgcacctagtctagttcttctacttccgttcccgcctactctag

SEQ ID NO: 250759 - DNA, 880 bp, Homo sapiens
  misc_feature: GYAE6OF02H1IVY.44.65.F10.1.454.CMB.1.raw
  modified_base (154)..(154): a, c, t, g, unknown or other
  misc_feature (154)..(154): n is a, c, g, or t
tcagacagtatatacacgaccggtgctcgatttagctacgctctaagggggctctggggaggaactgctcagttaggacccagacggaaccatggaagccccagcgcagcttctcttcctcctgctactctggctcccagataccactgggaanaaagtagtagagtacgacgctacgtcctccgacgcccctaccgttgtcgtggttcgtccgtaccgggaaaggggaaacgaccgaccccctaccccttccttccgtcggaccggaccgggacctacgtacgaaggtacggttaccgttaaccgacgaccttaaacgttacgccgttacggaaccccaccgaaacgtaacccggtgggaccgacggtcccctacccggaggtcccttccctactacttacgttacgtaacggaactacctacccgaaccggaccgggacccctacggttacggttaacccctaccccgtaaccggttacggttaccgtagggtcggacgtcgggggttccgggggtaacccggaacgtagggttaccgtttacccaccgttccctaacccgaacctacgtaccgaccgggcccggttccgtcggacgtacggttaccgtagggtaacggttttacgtttacggtaacgtttaaggtttttactttacggttcggtaaccgtacgtaacgtttaagttaaacgtaaacttaccggttcccgtacctttacgtaccggttttaccggttccgggggggaaccgggtaacctaaggggtagaaccgttacgtaaccgaaacgttcggtagggtaccggtactacggaaccctaaccgttagtttcccggttcgtttaccccttagtcccttttcccccggacccgttaacc

SEQ ID NO: 250760 - DNA, 529 bp, Homo sapiens
  misc_feature: GYAE6OF02JYQYS.44.65.F10.1.454.CMB.1.raw
  modified_base (196)..(196): a, c, t, g, unknown or other
  misc_feature (196)..(196): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (343)..(343): a, c, t, g, unknown or other
  misc_feature (343)..(343): n is a, c, g, or t
  modified_base (367)..(367): a, c, t, g, unknown or other
  misc_feature (367)..(367): n is a, c, g, or t
  modified_base (413)..(413): a, c, t, g, unknown or other
  misc_feature (413)..(413): n is a, c, g, or t
tcagacagtatatacacgaccggtgctcgatttagctacgctctaagggggagggaactgctcagttaggacccagacggaaccatggaagccccagctcagcttctcttcctcctgctactctggctcccagattccaccggcgaaattgtgttgacacaatctccagccaccctgtctttgctccgggggaacngccaccctctcttgcagggccggccagactgttgacgacgacttagcctggtaaccaacagaccacctggccaggctcccaggctcctcatctatgatgcatccaatgggccncggcntccagccaggttcagtggcagtcgggtcngagacagtaccttcgactctcacntcagcgcctaagcgccggaatgtttgctagtttactactgtcaacncgtacgcgactggcctagtactaggtttcggccgaagggtaccaagtcgtaggtacgacctacgaaaccgtatgtcgactggcacgatctgccttcactcttacccgctatctacg

SEQ ID NO: 250761 - DNA, 561 bp, Homo sapiens
  misc_feature: GYAE6OF02IJCGE.44.65.F10.1.454.CMB.1.raw
  modified_base (396)..(396): a, c, t, g, unknown or other
  misc_feature (396)..(396): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccgagggcccactggtactcccagccaggttcaggtggcgagtgggtctgggacaggagttcactctcaccatcagcagcctgcagtctagaagtnttttgcttaagttttattactgttacagtacaagttataagtgtacgtcggtaccccttccgtccggaccgaaacgggtaccacggtaacgtagggaacgtaacgttaaacggaacttcgggtaggactacggacctaaccgtacttcgtcgttccttactaccg

SEQ ID NO: 250762 - DNA, 495 bp, Homo sapiens
  misc_feature: GYAE6OF02IOFD2.44.65.F10.1.454.CMB.1.raw
  modified_base (388)..(388): a, c, t, g, unknown or other
  misc_feature (388)..(388): n is a, c, g, or t
  modified_base (488)..(488): a, c, t, g, unknown or other
  misc_feature (488)..(488): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccacagggccactggtactccagccaggttcagtggcagtgggtctgggacagagttcactctcaccatcagcagcctgcagtctgaagtntttgctagtttattactgttcagcagtataagtgtactcgcctccgttcgaccgaacgggacacgacgtggagtagtaacgaactgtgctgcactatctntctctac

SEQ ID NO: 250763 - DNA, 512 bp, Homo sapiens
  misc_feature: GYAE6OF02IQOMR.44.65.F10.1.454.CMB.1.raw
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
  modified_base (465)..(465): a, c, t, g, unknown or other
  misc_feature (465)..(465): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaccagcaacttagcctggtaccacagaaacctgggcaggctcccaggctcctcatctatggaacatccaccagggccactggtatcccacccaggttcagtggcagtgggtccggacagngttcactctcacatcagcgctgcagtctgagtnttttgctagtttattactgtcagcagttataatactgctctcacgttcggcggggaccagggtcgagatacgaaacgactgngcgtgcaccatccgtcgttcttcacttccgttccccgctactctacg

SEQ ID NO: 250764 - DNA, 586 bp, Homo sapiens
  misc_feature: GYAE6OF02FU895.44.65.F10.1.454.CMB.1.raw
  modified_base (195)..(195): a, c, t, g, unknown or other
  misc_feature (195)..(195): n is a, c, g, or t
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtgtaccagcaacttagcctggtaccaccagaacctgggcaggctcccaggctcctcatctatgaacntccacgaggccactggtacncccactagttcagtgcaggtcgggtcgganagagttcactcncacatcgagcgctgctagtctagagtatttgacttagtttactactgtacctacgtaccgttaagacggttcgcccttcccgttcggaccgtaagggccaggaccgtgggaacgtaacgttaaacgacgttggtagcttacgactaaccgtacgttcgttacgtttccttaccgttaccgtttcccgttaccccgtaccttacgttaccgttaggttaacttaactttaaccg

SEQ ID NO: 250765 - DNA, 624 bp, Homo sapiens
  misc_feature: GYAE6OF02HVPDT.44.65.F10.1.454.CMB.1.raw
  modified_base (231)..(231): a, c, t, g, unknown or other
  misc_feature (231)..(231): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagacaccactggagaaaatagtggatgacgcagtctccagcccaccctgtctctgtcctcgaaggggaagcgcccaccctctcctgcgagggccagtcagngtggtggcagcagcgtacgccgttggttccagcaacgaaaccgtcggaccagacctcccgaggcctcctcactctaactaccacactcccaccgacgggccacgtcggtactcccgagcccaagtacttacgagtcggactacgtcggggtcgtcgggaacaggtacgttccaccgttcctaccaacctatcgaacgccgtacgccctgactagttcctaggaaacgtttagttttcgacgttaagttttacttacttgtacagctaagtatagtgacgttcggccttccgttactacgttccggcccgtacggacctacgtacggtcgttaactttaccgaaaacgtacgttggtaccggtacttcggacctaacccgttctccgttaccgg

SEQ ID NO: 250766 - DNA, 797 bp, Homo sapiens
  misc_feature: GYAE6OF02JY6E5.44.65.F10.1.454.CMB.1.raw
  modified_base (203)..(203): a, c, t, g, unknown or other
  misc_feature (203)..(203): n is a, c, g, or t
tcagacagtatatacacgaccggtgctcgatttagctacgctctaagggggagggaactgctccagttaggacccagacggaaccatggaagccccagcgcgacgcttctcttcctcctggctactctggctcccagataccactggagaaatagtgatgacgcggtctccagcccacctgtcctgtcgtctccgaggggaanacgccaccctcgtcctgacgacgggccaggtccagtaggtcggttacgcagactaacttacgcctcggtaccgagccgaagtaaactcgtacggacccaacgggaccgtaccccgacggtcctccctcaacttcctaaggttgggtacgaccgtaccttaccccgaaccggacgggtccctaaccggttcggtaactaccccgaaggtccccgtaagggttccaagggtcggacggtaaggggtttcggggtaccgtacgggggtaactacgggttacttaccgtaccttccgtacccgaacctatccgaacggtcccacggtcccttacggacgtacggttacgtacggtaaagtttcgttttacgacctttaaaggttttactttacacggttaacaaggttaccttaagggttaattaccggtagtacccgtcgggtaccccgtttacccgttaacgggaaccggtaaacggtaccgtaaccggtaagttcgggaacgttaaaacccgttaacgggtaacccgttgggtaacccgttcggttaaaccgacccgttaacgtaccgttcctttccggtttacccttactaccg

SEQ ID NO: 250767 - DNA, 585 bp, Homo sapiens
  misc_feature: GYAE6OF02GZ2JY.44.65.F10.1.454.CMB.1.raw
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctgtgtctccgaaggggaaagcgccaccctctcctgcagggccagtcagagtgtaccagcaacttagcctcgtaaccagcagaaatctggccaggcctcccaggcctcctcatctatggtcgcactccaacgacgggccacgtggcaactccccagcctaggttcaggtgcaggtgggtctggacagacttnactctcacatcagcncgactagacgcctagaagtatttgactagttatgtactgtcacgtctaagttataagtcgtacgttcggtcccttacccgttacgggacccgtaaacgggacctaccgggtacgtacgggtaaacgtaacgttaaaaccggtaccgtacgggtacggtccgtacggacctaaccgtacgttacccgttggttacccttaccg

SEQ ID NO: 250768 - DNA, 548 bp, Homo sapiens
  misc_feature: GYAE6OF02JIM4B.44.65.F10.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagcccaccctgtctgtgtctccaggggaaangccaccctctcctgcagggccagtcagagtgttagcagcaacttgcctcgtaccagcagaaatctggccaggctcccaggctcctcatctatggtncactccaccagggccacgtggtactcccagccaggttcaggtggcaggtgggtctggggacaggagttcactctcaccatcagcacgcctgcagtctacgaagtattttgctaagtttatactgtcagtctagtataagtcgtactcggtcccttccgttcgccgtaacggtacacgtactggaacgtaagttaaaccggtaacgttggtacgacgttcggacctaaccgtacttccgtcgttccgttactaccg

SEQ ID NO: 250769 - DNA, 505 bp, Homo sapiens
  misc_feature: GYAE6OF02F51OQ.44.65.F10.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
  modified_base (275)..(275): a, c, t, g, unknown or other
  misc_feature (275)..(275): n is a, c, g, or t
  modified_base (342)..(342): a, c, t, g, unknown or other
  misc_feature (342)..(342): n is a, c, g, or t
  modified_base (379)..(379): a, c, t, g, unknown or other
  misc_feature (379)..(379): n is a, c, g, or t
  modified_base (480)..(480): a, c, t, g, unknown or other
  misc_feature (480)..(480): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatgtgatgacgcggtctccagccacctgtctgtgtctccaggggaaangccacctntcctgcagggccagtcagagtgtagcagcaacttgcctgtaccngcagaaatctggccaggctccaggctccncatctatggtgcatccaccagggccactggtactcccagccaggttcagtgcagtgggtctgggacngagtcactctcacatcagcagcctgcagtctgaagtntttgcttagtttatctgtcagtctagtaatagtgtacgtcgtccttccgttcggaccaacgggactacgacgtggacgtaagttaaacggacttggtacgntacgacactatctcgtcttacgtac

SEQ ID NO: 250770 - DNA, 590 bp, Homo sapiens
  misc_feature: GYAE6OF02G2ONM.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaccagcaacttagcctggtaccaccagaacctggcaggctccaggctcctcatctatggaacatcccaccgacgggccacgtcggtactccccaccaggttcaggtggcaggtcggggtccggacaggtagttccacttctcaccatccacggccggcctgcctagtcgtggtaggtagttttgtcgtagtttatttacttgtctagactagttaattaataactcgtcctctcgtacgtttccgggaccggggtttttttttttttaccgaagggtagggagtacgtacgtaaacgaacgtagtaggtcgtacgcacctactcgttcgttcttctacttccttcccgtcctactctacg

SEQ ID NO: 250771 - DNA, 504 bp, Homo sapiens
  misc_feature: GYAE6OF02F4Z7G.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctctgtctccaggggaaagagccaccctctcctgcagggccagtcagagtgttggcagcagcgtagcctggttacagtagaaacctggccagactcccaggctcctcatctataccacatccacagggccactggtactcccagccagattcagtggcactgggtctgggacagagttcactctcacatcagcagcctgcagtctgaagtattttgactagtttattactgtcagtctagtataatgtactggtcctccttcggaccaacgggacacgtacgtggagtagtaaacgactaggtcggctgacactatctgtcttctac

SEQ ID NO: 250772 - DNA, 508 bp, Homo sapiens
  misc_feature: GYAE6OF02JGNJY.44.65.F10.1.454.CMB.1.raw
  modified_base (196)..(196): a, c, t, g, unknown or other
  misc_feature (196)..(196): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttgcctcgtaccagcagaaatctggccaggcctcccgaggcctcctcatctatggtgcactccacgacggccacgtgtactccagccagtcagtgcagtggctggacagagtcnctctcaccntcagcacgcngcagtctgaatntttgctagtttattactgtacctactaaccgtaagtagtcggacctactaatacttacactttccggcctaggacctaagtcgatacgtcaaagtctagcgtatacgcacctatctacgtcttcg

SEQ ID NO: 250773 - DNA, 519 bp, Homo sapiens
  misc_feature: GYAE6OF02IYRD4.44.65.F10.1.454.CMB.1.raw
  modified_base (330)..(330): a, c, t, g, unknown or other
  misc_feature (330)..(330): n is a, c, g, or t
  modified_base (398)..(398): a, c, t, g, unknown or other
  misc_feature (398)..(398): n is a, c, g, or t
  modified_base (511)..(511): a, c, t, g, unknown or other
  misc_feature (511)..(511): n is a, c, g, or t
  modified_base (518)..(518): a, c, t, g, unknown or other
  misc_feature (518)..(518): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcttgcagggccggccagactgttgacgacgacttagcctggtaccaacagaagcctggccaggctcccagactcctcatctatgactacttctagtagggcctgtggcatccccagccccgtnttcagtggcaggtgggtctgggacagtacttcactctcaccatccaccgagcctagacgctgaacgtnttttgactagtttacttactgtactacgtaccgtaagtagtcgcctacaattctactacgttcgcctaggacctaagtgatatacaagactgtgctgctacatctgtcttctntcctccnc

SEQ ID NO: 250774 - DNA, 520 bp, Homo sapiens
  misc_feature: GYAE6OF02FQJ1L.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttagcctcgtaccagcagaaatctggccaggctcccaggcctcctcatctatggtgcatccaccagggccactggtactcccagccaggttcagtggcagtgggtctggggacaggtagttcactctcaccatcagcagcctgcagtctagaagtattttgctagtttattacttgtcagtctagttatatgactcgtccttccgttcgaccgaacgggacacgacgtggacgtaacgttaaacgactcggtaggtctcgacacgtatctgttccttctacg

SEQ ID NO: 250775 - DNA, 519 bp, Homo sapiens
  misc_feature: GYAE6OF02FRZ9I.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaccagcaacttagcctggtaccaccagaaacctgggcaggctcccaggctcctcatctatggaacatccaccagggccactggtatcccaccaggttcagtggcagtgggtccggacaggagttcactctcacatcagcggcctgcagtctgaggtattttgctagtttattactgtcagcagtataataactgcctctctacgttcgggcgggggtaccaagggtggagatacgaaacgacgtgtggctggcacctatctgttcttctactccttcccgctatcctag

SEQ ID NO: 250776 - DNA, 746 bp, Homo sapiens
  misc_feature: GYAE6OF02GDIIM.44.65.F10.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
  modified_base (351)..(351): a, c, t, g, unknown or other
  misc_feature (351)..(351): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctgtgtctccgaggggaaanagccacctctcctgcagggccagtcagagtgttaccagcaacttgcctggtaccacagaacctgggcaggctccaggcctctcatctatggaacntccaccgacgggccacgtcggtactcccaccaggttcaggtggcaggtcgggtccggaanagtagttccacgttctaccgaacctagtcacggtccggcctgcctaggttccgtagggtaacggttacttttttcggacctttaaggtttttaactttaccggttacgttaccgacggttaacgttaaagttaaacgttaaaacgtttaaccgtaccgggtaccctttaccgttacccggtttaccgggtttaccggggggtaacccgggggggtaaccgtaaagggggttcggtaaacggtaaacgttaaacccggaaaacccgggttaacgttacgggttacgggtaccgttaacggtaccccttaacccggttacggttcccgtttaccggtttaccttaccgttacccgtttcccccgtttaccccgtaccgttaaccgttccgttaaccg

SEQ ID NO: 250777 - DNA, 530 bp, Homo sapiens
  misc_feature: GYAE6OF02GDZ3H.44.65.F10.1.454.CMB.1.raw
  modified_base (310)..(310): a, c, t, g, unknown or other
  misc_feature (310)..(310): n is a, c, g, or t
  modified_base (387)..(387): a, c, t, g, unknown or other
  misc_feature (387)..(387): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccaccggggaaattgtgttgacacaatctccagccaccctgtctttgtctccgggggaacagccaccctctcttgcagggccggccagactgttgacgacgacttagcctggtaccaacagaagcctggccaggctcccagactcctcatctatgatacttctagtagggccctntggcatcccagcccgcttcagtggcagtgggtctgggacagacttcactctcaccatcaccagcctagagcctgaanattttgctagtttattactgtctacacgtaagaagtggcctcaatattcactttcggcctggaccaaagtgatactacaaacgactagtggctgacacctatccttgtcctttcgacttccttcccgcccatctacgattaac

SEQ ID NO: 250778 - DNA, 545 bp, Homo sapiens
  misc_feature: GYAE6OF02GUJKG.44.65.F10.1.454.CMB.1.raw
  modified_base (200)..(200): a, c, t, g, unknown or other
  misc_feature (200)..(200): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
tcagacagtatatacacgaccggtgctcgatttagctacgctctaagggggagggaacgtgctcagttaggacccacgacggaaccatggaagccccagcgcagcttctcttcctcctgctactctggctcccagataccactggagaaatagtgatgacgcggtctccagccaccctgtctgtgtctccagggggaaangccaccctctcctgcagggccagtcagagtgttagcagcaacttagcctcgtaccagcagaaatctggccaggctcccaggcctcctcatctatggtgcatcccaccgagggcccacgtggtactcccagcccaggttcaggtggcaggtgggtctggggacaggtagttcacgtctcaccatcagcagctgganctgaagtntttgcagtgtattactgtcagctagtatgcttactcactctgtaccgttcgaccgtaacggaccgaaggtacggaaacgttacgaaaccgtaacgttggtacggtctacggacctaaccgacgttcctacggttccttaccg

SEQ ID NO: 250779 - DNA, 532 bp, Homo sapiens
  misc_feature: GYAE6OF02I6E1R.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaccagcaacttagcctggtaccaccagaaacctgggcaggctcccaggctcctcatctatggaacatccaccagggccactggtactcccaccaggttcagtggcaggtgggtccggacaggagttccactctcaccatcagcggcctgcagtctgaggtattttgctagtttatactgtcagcagtataatactgcctctctacgtttcgggacgggggtacctaagggtggagtacgtacgaaacgtacttggtgcgtgcctacctatcttcgtcttcacttccgttcccgacctatctag

SEQ ID NO: 250780 - DNA, 686 bp, Homo sapiens
  misc_feature: GYAE6OF02JV0U4.44.65.F10.1.454.CMB.1.raw
  modified_base (203)..(203): a, c, t, g, unknown or other
  misc_feature (203)..(203): n is a, c, g, or t
  modified_base (373)..(373): a, c, t, g, unknown or other
  misc_feature (373)..(373): n is a, c, g, or t
tcagacagtatatacacgaccggtgctcgatttagctacgctctaagggggctctggggaggaactgctcagttaggacccagacggaaccatggaagccccagcgcagcttctcttcctcctgctactctggctcccagataccactggagaaatagtgatgacgcagtctccagccacctgtctgtgtctccaggggaaangccaccctctcctgcagggccagtcagagtcgtaccagctaacttgcctggtaccacagaacctgggcaggcctccgaggtcctcctcatcgtatcggaacactccaccgacgggccacgttcggacctccccaccgtaggttccaggtcggcgaggtcggggtccgganacggacgttcgactcgtccgaacctagtccgacggcccggtacctcggaccgtacggttccgtaggtacggttacgttttcggaccgtttaaggtttttacttaaccgtcggttaccgtaaggttaccgttaaacgttaaacttaaacgtaaaccggtacggttacccttacgtttacccgtaaccgggttttcccgggggaccgggggtaaccgttaaggggtcgaaagtacgtaaccgaacgtacgttcgggtacgcgtacggccaaccgtattccgttacgtacctttacgacctttcccgtaccctacg

SEQ ID NO: 250781 - DNA, 722 bp, Homo sapiens
  misc_feature: GYAE6OF02FF5Q4.44.65.F10.1.454.CMB.1.raw
  modified_base (106)..(106): a, c, t, g, unknown or other
  misc_feature (106)..(106): n is a, c, g, or t
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
tcagacagtatatacacgaccggtgctcgatttagctacgctctaagggggaggaactgctcagttaggacccagacggaaccatggaagccccagcgcagcttcncttcctcctgctactctggctcccagataccactggagaaatagtgatgacgcagtctccagccacctgtctgtgtctccaggggaaangccacctntcctgcagggccagtcagagtgtaccagcaacgttgccctggtacccacagaacctggcaggctccaggctctcatctatgatgcactccaactgggtcacgtcggaccacccgagaccaggttcacggttcggctaggtcgggtctaggggacaggtaccttcgacgttccttcgaacccgttccaaggtcctaaagttcggttaacgacggtacccgttaggtaaacggttacgttttacggaccgttaacggtttacgttaccgtttacggttactaacgggtacgttaccggttaccggtttacccgttaccgtaccgggttacccgtaccgttaccggttacccggtttttacggggacccggggggttaacccgtaaacggggttacgggtaacggttacgttacccggtacggtaccggtaacggttcgggtacggttaccgttacggtacccgtaacccgtacgtttacccgtcggtttaccctccgttacgtttcccggttaacccccgg

SEQ ID NO: 250782 - DNA, 576 bp, Homo sapiens
  misc_feature: GYAE6OF02II4RT.44.65.F10.1.454.CMB.1.raw
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagccaccctgtctctgtctccgaggggaaagagcccaccctctcctgcagggccagtcagagtgttggcagcagcgtagcctggttccagcagaaacctggccacgactcccaggcctcctcatctactaccacactccaccagggccacgtcggtactcccagccagactcagtggcactgggtcgtgggacaggacgttcactctcaccatcagcacgcctgcagtctagtaagtattttgcttagtttattacttgtacagtctaagtattagtgtacgtcggtcccttccgttcgtaccgtttccggtcccgttacggggtaccctaccggtacggttccgttaactttaccgaaaccgtaaccgttgggtacgggtcgttcggacctacctacgttccttccgg

SEQ ID NO: 250783 - DNA, 521 bp, Homo sapiens
  misc_feature: GYAE6OF02IDP5I.44.65.F10.1.454.CMB.1.raw
  modified_base (195)..(195): a, c, t, g, unknown or other
  misc_feature (195)..(195): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (496)..(496): a, c, t, g, unknown or other
  misc_feature (496)..(496): n is a, c, g, or t
  modified_base (515)..(515): a, c, t, g, unknown or other
  misc_feature (515)..(515): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaanagccaccctctcctgcagggccagtcagagtgttagcagcaacttagcctcgtaccagcagaaacctgggcaggctcccaggctcctcatctaatggaacatccaccgagggccacgtggtactccccacccaggttcagtggcaggtgggtccgganagagttcactcncacatcacgcgcctgcagtctgaggtatttgctagtttatactgtcagtctagtaataatacgtcgtcctctctacggtttcgggacgggggtacagggtgagtactaacgaacgtactgcgcgtgcactntctgtctctacttcctccncctatc

SEQ ID NO: 250784 - DNA, 619 bp, Homo sapiens
  misc_feature: GYAE6OF02IHB66.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagcccccagcgcagcttctcttcctcctgctactctggctcccagataccactggagaaatagtgatgacgcagtctccagccaccctgtctgtgtctccgagggaangccaccctctcctgcagggccagtcagagtgttaccagctaacttagcctggtaccaccagaacctgggcaggcctcccaggcctcctcatctataggaacatcccaccgagggccctacgtggtacctccccacccgtaggttcagtggcctaggtcgggtccggacagtagttcactctcaccatcgagccgcctgctagtctggtacgtattttgctagtttattcgtgttacgacgtcgaagttaataactaacgtcgaccttactcgtaccgtttccggggaccggggacctaagggttacggaacgtagtaaccgaaaacgttagtcgggttacgacgttaccggcctaacccgtacttaccgtttcgtaccgttttacctacgtttccccgttccccgacccttacttacgtaccg

SEQ ID NO: 250785 - DNA, 573 bp, Homo sapiens
  misc_feature: GYAE6OF02HS9SS.44.65.F10.1.454.CMB.1.raw
  modified_base (283)..(283): a, c, t, g, unknown or other
  misc_feature (283)..(283): n is a, c, g, or t
  modified_base (363)..(363): a, c, t, g, unknown or other
  misc_feature (363)..(363): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccaccgataccactggagaaatagtgatgacgcggtctccagccaccctgtctgtgtctccaggggaaagagcccaccctctcctgcagggccagtcagagtgttagcagcaacttagcctcgtaccagcagaatctggccaggctccagctccncatctatggtgcatccacagggccactggtactcccagccaggttcaggtcggcagtgggtctgggacaggattcactcncaccatcgagcacgcctgcagcctggacgtatttcgcgtactttacttactgtacccaactaattactttctttttacttaccgttactacgttttggtacccgtaggggtacccgtaagacgttgggaacgtacgtaacgtaaagggtaaccgttacggtagggtcctagaccgtacctacttccgttggttcctttacctattccccg

SEQ ID NO: 250786 - DNA, 506 bp, Homo sapiens
  misc_feature: GYAE6OF02G2D0B.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccaggggcccactggtactcccagccaggttcagtggcagtgggtctggggacagagttcactctcaccatcagcagcctgcagtctgaagtattttgctagtttattacttgtcagcagtataatgactgccttccgttcgaccgaacgggacacgactggagtaacgttaaacggaactggtagctgcactatctgtcttctac

SEQ ID NO: 250787 - DNA, 522 bp, Homo sapiens
  misc_feature: GYAE6OF02INDZF.44.65.F10.1.454.CMB.1.raw
  modified_base (284)..(284): a, c, t, g, unknown or other
  misc_feature (284)..(284): n is a, c, g, or t
  modified_base (394)..(394): a, c, t, g, unknown or other
  misc_feature (394)..(394): n is a, c, g, or t
  modified_base (435)..(435): a, c, t, g, unknown or other
  misc_feature (435)..(435): n is a, c, g, or t
  modified_base (518)..(518): a, c, t, g, unknown or other
  misc_feature (518)..(518): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccacccctctcctgcagggccagtcagagtgttaccagcaacttagcctggtaccacagaaacctgggcaggctcccaggctcctnatctatggaacatccaccaggggccactggtactcccacccaggttcagtggccaggtcggggtccggacagagttcactctcaccatcagcggcctgcagtctgaggtntttgctagtttattactgtacagcagtataatactggcctntctacgttcgggcgggggtacaagggtggagatcgaaacgacgtgtgctgcaccatctgtcttcacttccgttcccgctactntacg

SEQ ID NO: 250788 - DNA, 212 bp, Homo sapiens
  misc_feature: GYAE6OF02IFNA7.44.65.F10.1.454.CMB.1.raw
  modified_base (210)..(212): a, c, t, g, unknown or other
  misc_feature (210)..(212): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccaggaactgtggctgcaccatctgtcttcatcttcccgcatctgatatatactgtctgagcgggctggcaaggcgcatagnnn

SEQ ID NO: 250789 - DNA, 690 bp, Homo sapiens
  misc_feature: GYAE6OF02HMZOO.44.65.F10.1.454.CMB.1.raw
  modified_base (157)..(157): a, c, t, g, unknown or other
  misc_feature (157)..(157): n is a, c, g, or t
  modified_base (329)..(329): a, c, t, g, unknown or other
  misc_feature (329)..(329): n is a, c, g, or t
tcagacagtatatacacgaccggtgctcgatttagctacgctctaagggggaggaacgtgcgtcagttacggtacccgtagacggaaccagttggaagccccaggcgcgagcgttctccttcctcctgctaactcgtggctccagataccgatgganaaatagtagatagacgcggtactccagcccacctggtcttggtcgtcgtacgagggtaagtcgcctacctctcttagcgaggccagtcagagtgtacgcgtagctaacgttacggcggtacggtaccgaggtccaaggaactcggtaggccaggccgtaccgagtcctcctnatcctagtcggcgtactactacccgacgaacggtacctacgttacggtactcccgacgtaccggtagggttaccaggtcggccgtagggtcgggtacgtagggactaggtacttcgacgtctacgaacctagtcagcgtacgtacgtagacgtagtcgtaagtaacgttatttcgacttaagtttacgtaccgttgtaccgaacgtacggtaattaagttaagtacgtaccgtaccggttcccttaccggttacggaaccgtaaaggtaccgtaacggtacgtaacggaacgttaacgttaaaccgtaggtacggtaacgtacgtacgactacctagttaccgtacgttacctacgtaccg

SEQ ID NO: 250790 - DNA, 506 bp, Homo sapiens
  misc_feature: GYAE6OF02FTPE1.44.65.F10.1.454.CMB.1.raw
  modified_base (391)..(391): a, c, t, g, unknown or other
  misc_feature (391)..(391): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccgaggctcctcatctatggtgcatccacagggccactgtactcccagccaggttcagtggcaggtcgggtctgggacaggagttcactctcacatcagcagcctgcagtctgaagtntttgctagtttatctgtcagtcagtataagtgtactcggtcctcccgttcgaccgaacggacacgactggacgtaagtaaacgactggtcgtctagcactatctacgtcttatac

SEQ ID NO: 250791 - DNA, 622 bp, Homo sapiens
  misc_feature: GYAE6OF02HUIEK.44.65.F10.1.454.CMB.1.raw
  modified_base (198)..(198): a, c, t, g, unknown or other
  misc_feature (198)..(198): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagngcccaccctctcctgcagggccagtcagagtgtagcagcaacttgcctcgtacagcaagaaatctggccaggcctccccgaggcctccncatcgtagtggtncatcccgaaccgtagggcccacgtcggtaacctccccgaggcccctaggttcaaggtggcggtagggttcggggtacgtggggaacaggtacgttcgaaccttcctaccaacctatcgaacgcacgtcctgacctagtctagtaattctttgactttaagttttatactgtctaagtacgtaagttaattagtacgtacgttccggtcccttaccggttaccggaccggaaagggacccacgtaccggtaggtaactaacggttaaacggacgttggtacggtctggaccctacgtacgttacgttcgttaccctatacccg

SEQ ID NO: 250792 - DNA, 595 bp, Homo sapiens
  misc_feature: GYAE6OF02HH7Q8.44.65.F10.1.454.CMB.1.raw
  modified_base (197)..(197): a, c, t, g, unknown or other
  misc_feature (197)..(197): n is a, c, g, or t
  modified_base (395)..(395): a, c, t, g, unknown or other
  misc_feature (395)..(395): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagcccaccctgtctctgtctccaggggaagngccacctctcctgcagggccagtcagagtgttgcagcagcgtagcctggttccagcagaaacctggccagactcccagctcctcatctataccacatccgacgagggccacgtggtactcccagccagacttcagtggcacgtggtctggacaggagttcactctacaccgatcagcacgtcctgcagtctagaagtntttgacttagtttacttacgtgtacagcgtaagttagtacgttgaccttcgggtaccctttccgttaccgttaccgtttcccgggaccccggttccgggacccgtacgttaccgggtaccggttaacgtttaaccggaaaccggttaccgttggttaccggtccttacgtaccccgtaaccttacgttaccgtttaccgg

SEQ ID NO: 250793 - DNA, 543 bp, Homo sapiens
  misc_feature: GYAE6OF02GTK83.44.65.F10.1.454.CMB.1.raw
  modified_base (319)..(319): a, c, t, g, unknown or other
  misc_feature (319)..(319): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
tcagacagtatatacacgaccggtgctcgatttagctacgctctaagggggaggaactgctcagttaggacccagacggaaccatggaagccccagctcagcttctcttcctcctgctactctggctcccagattccaccggcgaaattgtgttgacacaatctccagccaccctgtctttgtctccgggggaacagccaccctctcttgcagggccgcagactgttgacgacgacttagcctggtaccaacaaagcctggccaggctcccagactcctcatctatgatacttcagtaggcctcgtgcatcccagcccncttcagtgctagtggtctgggacaggtcttcacttcncacatcaccngcctagcgcctagaacgtatttgctagttttattacttgtctacaccgtaagagtcggcctctaatacttactacctttcggacccgtagggaacctaagtcggtatatacaaacgtactagtcgactgacacctagtcttgtcttacattcccttccgacctactctagtattacg

SEQ ID NO: 250794 - DNA, 666 bp, Homo sapiens
  misc_feature: GYAE6OF02JBSGL.44.65.F10.1.454.CMB.1.raw
  modified_base (387)..(387): a, c, t, g, unknown or other
  misc_feature (387)..(387): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagacgcccaccctctcctgcagggccagtcagagttcgttaccagacaacttgccctaggtacccaccaagaaaccgtggacacggcctcccgaggcctccctcatctatcggaacactcccaccgacgggccaacgtggtacctccccaccgtacggttcgaggtcggctagggtcggggtaccgggaanagggtacgtttccacttcgtacaccgattccacggtcccggcctggccgtagtcgtacggtaggttactttttggtaccttagttttacttacgtcgttacacgtactaagttaattaaactaacgtcggtacccttacttaccgttaccggtttaccggggacggggggtaaccgtaaggggtcggaagtaagaaccgtaaaccgtacgtgtcggcgtacgcctaactacgtcgttacgttccttactacctttcccgtccccgtcttacgtctaacg

SEQ ID NO: 250795 - DNA, 581 bp, Homo sapiens
  misc_feature: GYAE6OF02JH9J0.44.65.F10.1.454.CMB.1.raw
  modified_base (389)..(389): a, c, t, g, unknown or other
  misc_feature (389)..(389): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggcccactggtatcccagccaggttcagtgcagtggtctgggacaggtagttcactctcacatcagcagcctgcagtcagaagtntttgcttaagttttattacgtgtacagactagttaataatgtactcgggtacccttccccgtttcgggacccgtaaacggggacctaaccggtacgttacggggaacgtaacggtttaaaaccggaacggttcggtacgggtacccttacgggaccctaacccgtacttcccgttacggttaccctttaacc

SEQ ID NO: 250796 - DNA, 540 bp, Homo sapiens
  misc_feature: GYAE6OF02FTUFL.44.65.F10.1.454.CMB.1.raw
  modified_base (197)..(197): a, c, t, g, unknown or other
  misc_feature (197)..(197): n is a, c, g, or t
  modified_base (353)..(353): a, c, t, g, unknown or other
  misc_feature (353)..(353): n is a, c, g, or t
  modified_base (531)..(531): a, c, t, g, unknown or other
  misc_feature (531)..(531): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttaccagcaacttagcctggtaccaccagaaacctgggcaggctcccaggctcctcatctatggaacatccaccgagggcccacgtggtactccccaccaggttcagtggcaggtcgggccggangagttcactctcacatcagcgctgctagtctgaggtatttgcttagtttacttactgtcagtctagtattaaagtactcgccttctcgtacgttcgggcgggggtaccgaagggtggaagtataccgaaagtacgtggtcgcgtcgccacactcgtcgttcttctacttccgttcccnctatcgtag

SEQ ID NO: 250797 - DNA, 574 bp, Homo sapiens
  misc_feature: GYAE6OF02GQ0IO.44.65.F10.1.454.CMB.1.raw
  modified_base (319)..(319): a, c, t, g, unknown or other
  misc_feature (319)..(319): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagccaccctgtctgtgtctccgagggggaaagagcccaccctctcctgcagggccagtcagagtgttaccagcaacttagcctggtaccaccagaacctgggcaggctccaggctcctcatctatggaacatccacagggccacgtggtacncccaccaggttcagtggcaggtcgggtcgganagtnttcactctcacatcagcagcctgccagtctagaagtatttgactagtttattactgtacagtactagttaataacttaacgtcggtccttctaccgttacgtttcggggacgggggtaccgtaagggttggagtacgtaacgaaacgtacgtggtcggtacgtcgacctacgtattcgttcgttacttactaccgttcccgttaccccgtactacttcg

SEQ ID NO: 250798 - DNA, 491 bp, Homo sapiens
  misc_feature: GYAE6OF02FPMKF.44.65.F10.1.454.CMB.1.raw
  modified_base (454)..(454): a, c, t, g, unknown or other
  misc_feature (454)..(454): n is a, c, g, or t
  modified_base (487)..(487): a, c, t, g, unknown or other
  misc_feature (487)..(487): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccagggaaagagccaccctctcctgcagggccagtcagagtgttaccagcaacttagccctcgtaccagcagaaatctggccaggctcccaggctcctcatctatggtgcatccaccagggccactggtatcccagccaggttcagtggcagtgggtctgggacagagttcactctcaccatcagcagcctgcagtctgaagtattttgctagtttattacttgtcagcagtataatgactgcctccgtcgccaaggacacgactgganacgtaaacgactggtggctgcactatctgtctntacg

SEQ ID NO: 250799 - DNA, 640 bp, Homo sapiens
  misc_feature: GYAE6OF02GRO84.44.65.F10.1.454.CMB.1.raw
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
tcagacagtatatacacgaccggtgctcgatttagctacgctctaagggggctctggggaggaactgctcagttaggacccagacggaaccatggaagccccagcgcagcttctcttcctcctgctactctggctcccagataccaccggcgaaattgtgttgacacaatctccagccaccctgtctttgtctccgggggaacagccaccctctcttgcagggccgccagactgttgacgacgacttagcctggtaccaacagaagcctggccaggcctcccagacctcctcatctatgatacttntagtacggcctcgtggcatcccagccccgnttcaggtcggcagtggtctgggacngtacttcactctcaccatccaccagcctagacgcctagaagtatttgactagttttacttacttcgtacttactaaccggtaagtaacggttcggacccttaccgtaaattacttacctaccgttttcccgggacccgttacgggtaaccctaaaggttaggtaacttaactaccgaaaacgtaccgttaggtacggtaccgttacggaccctaacccgttaacgttccgttacgtttccgtttacctaactttcccgtttacccccggaccttaaccg

SEQ ID NO: 250800 - DNA, 525 bp, Homo sapiens
  misc_feature: GYAE6OF02I9FGE.44.65.F10.1.454.CMB.1.raw
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (485)..(485): a, c, t, g, unknown or other
  misc_feature (485)..(485): n is a, c, g, or t
  modified_base (520)..(520): a, c, t, g, unknown or other
  misc_feature (520)..(520): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttaccagcaacttgcctggtaccaccagaaacctgggcaggcctcccaggctcctnatctatggaacntccacgngggccacgtggtactcccaccaggttcaggtggcaggtcgggccgganaggacgttcactctcacatcagcggcctgcagtctgagtatttgctagtttatactgtcagtctaagtataactacgtcgtcctcgtctacgttcgggacggggtaccgagggtgagatacgaaacgagtgngctcgcacctatcgtgtctctacttcctcccgctntctag

SEQ ID NO: 250801 - DNA, 579 bp, Homo sapiens
  misc_feature: GYAE6OF02I30V1.44.65.F10.1.454.CMB.1.raw
  modified_base (286)..(286): a, c, t, g, unknown or other
  misc_feature (286)..(286): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagagccaccctctcctgcagggccagtcagagtgttagcagcaacttagcctcgtaccagcagaaatctggccaggctcccaggcctcctnatctatggtgcactcccaccgagggcccacgtggtactccccagccctaggttcagtcggcaggtgggtctggggacaggtagttcacgtctacacctatcagcacgcctgcagtctgaagttagttttgcttaagttttattactgttacagtctagttaataattaacgtcgtcctactccgttacgtttccggggcggggtaactagggtacggagtacgtaaccgaaacggtaacgttgggtacggtacgtgtaccgtaccgtagttaccgtcgttccttacgtacccg

SEQ ID NO: 250802 - DNA, 818 bp, Homo sapiens
  misc_feature: GYAE6OF02JOTGY.44.65.F10.1.454.CMB.1.raw
tcagacagtatatacacgaccggtgctcgatttagctacgctctaagggggagggaactgctcagttaggacccagacggaaccatggaagccccagcgcagcttctcttcctcctgctactctggcctcccagataccactggagaaatgtgactgacgcggtctccagccacctgtctgtgtctccgaggggaagagccaccctctcctagccgacgggccagtcagagtgttagcagcaacgttagccgttacgtacagacagtaactcgtcggaccgaggtcctacccgaggtcctacctcattacctacgtcggtctccactcccgaacgtacgggacctacgttacgggtaactccccgacgtaccgtaacgggttccgtaacggtacggtcgtagggtttcggggaccgttacgggggaccgtaagggtacgtttcccggtaacttccctaccgaacccgttacgttacgaacggtcctaacggtcccgttacggaccgtacggtttacgtacggtaaacgtttagttttaccggacgtttaacggttttaacgtttaccgtcggtttaaccgaacgtaacgttaacggtttaaacgttaaccgttacggttaccgtttaccggtacccccgttttacccgggttaacgggtacccggtaaacggtaccgtaaccgggttaccggttacgggtaaacgttaaccgggtttaaaaaccggtacggtttaccgggtaacggttaccgtaccggtaaccccgttaacggttaacgttcccggttttacgttacccggtttaaccctttccccgg

SEQ ID NO: 250803 - DNA, 517 bp, Homo sapiens
  misc_feature: GYAE6OF02F06XK.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaccagcaacttagcctggtaccacagaaacctgggcaggctccaggctcctcatctatggaacatccaccagggccactggtactcccaccaggttcagtggcaggtcggggtccggacaggagttcactctcaccatcagcggcctgcagtctgaggtattttgcttagtttattactgtcagtcagtataatactgcctctctacgttcgggcggggtacaggtgagatacgaacgtacgtgtgctgcactattctgttcttctacttccgttcccgctatctag

SEQ ID NO: 250804 - DNA, 721 bp, Homo sapiens
  misc_feature: GYAE6OF02JXFPB.44.65.F10.1.454.CMB.1.raw
tcagacagtatatacacgaccggtgctcgatttagctacgctctaagggggctctggggaggaactgctcagttaggacccagacggaaccatggaagccccagcgcagcttctcttcctcctgctactctggctcccagatacccactggagaaatagtgatggacgcggtctccagcccacctgtctgtgtctccgagggaaagcgccaccctctcctgcagggccagtcagagttgtagcagcaacttgcctcgtaccagcaagaactcgtggccaggcctcccgaggtcctccctacacttacttagtcgggtcacctactcccgaccgtaggggcccaacgttcggtacctcccccgaacgtacggttcaacggttcggactagggttcggggtacccggaactagggtacttccgaccgttccaccgtaaccagttaccacggtcccgggaccttcggacgtacggtccgttggaacggtttacgttttcgaccgttaaggttttaacgttccgttacgtaccgtaacgtacgtaaggtttaaacttaaaccggttacgttccggttacccttccgttaccgtttaaccggggtttaccgggggacccgggggttaaccgtaaggggttcgggaaacgtacggtaacgaaaccggttaacgtcggggtacgtaccgtgtaccgtaccgtagttccgttaggttccttaaccgtcg

SEQ ID NO: 250805 - DNA, 566 bp, Homo sapiens
  misc_feature: GYAE6OF02GPEV1.44.65.F10.1.454.CMB.1.raw
  modified_base (199)..(199): a, c, t, g, unknown or other
  misc_feature (199)..(199): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (404)..(404): a, c, t, g, unknown or other
  misc_feature (404)..(404): n is a, c, g, or t
  modified_base (554)..(554): a, c, t, g, unknown or other
  misc_feature (554)..(554): n is a, c, g, or t
tcagacagtatatacacgaccggtgctcgatttagctacgctctaagggggaggaacgtgctcagttaggacccagacggaaccatggaagccccagcgcagcttctcttcctcctgctactctggctcccagataccactggagaaatagtgatgacgcggtctccagccaccctgtctgtgtctccgaggggaaagngcccaccctctcctgcagggccagtcagagtgttagcagcaacttagcctcgtaccagcaagaatctggccaggcctccccaggcctcctcattctagtggtgcatcccaccgacgggccacgtggtactcccagccaggttcaggtggcagtgggtctgggacngagttcactctcacntcagcacgcctgcagtctagtagtntttgcttagtttattcgttgctagactagtataagtcgtactcggtcccttcccgttacggaccgaaacgggaccaaccgggtacgtacggtaagtaacgttaaaccggtaacgttcgggtacggtacttcgacctaccgtactccgttnttccttctaccg

SEQ ID NO: 250806 - DNA, 615 bp, Homo sapiens
  misc_feature: GYAE6OF02HRZ6Y.44.65.F10.1.454.CMB.1.raw
  modified_base (195)..(195): a, c, t, g, unknown or other
  misc_feature (195)..(195): n is a, c, g, or t
  modified_base (316)..(316): a, c, t, g, unknown or other
  misc_feature (316)..(316): n is a, c, g, or t
  modified_base (387)..(387): a, c, t, g, unknown or other
  misc_feature (387)..(387): n is a, c, g, or t
tcagacagtatatacacgaccggtgctcgatttagctacgctctaagggggaggaactgctcagttaggacccagacggaaccatggaagccccagctcagcttctcttcctcctgctactctggctcccagagatcaccggagatattgtgttgacacagtctccaggcaccctgtctttgtctccgagggganagagccaccctctcctggtagggccaggtcggagtgttgctaagtacctaggcctggtaaccaacgagaaaaccgtggaccaggcctcccgaggctcctcatctatgatgacatccaacgngggtccacgtggccaccccagacaggttcagtggcaggtgggtctagggacagtacttcactctcaccgtnacgcaagtcgtaacacgtcctagaagttattttcgacttaagtttatactgtacagtctagtccgttccaccgtaggtcccgacttccgtacgtttccgggggacgggggtaacctaaggggtcgaagtacgtacgacgaacgtaaccgtgggtcgggtcctaccggacctaaccgtcgtaccgtttcggttacctttaccgtacctttcccgtccccgtacttaccg

SEQ ID NO: 250807 - DNA, 669 bp, Homo sapiens
  misc_feature: GYAE6OF02IKMJ2.44.65.F10.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (488)..(488): a, c, t, g, unknown or other
  misc_feature (488)..(488): n is a, c, g, or t
tcagacagtatatacacgaccggtgctcgatttagctacgctctaagggggaggaactgctcagttaggacccagacggaaccatggaagccccagcgcagcttctcttcctcctgctactctggctccagataccactggagaaatagtgatgacgcggtctccagccaccctgtctgtgtctccgaggggaangcccaccctntcctgcagggccagtcagagtgttagcagactaacttgcctcgtaccagcaagaatcgtggcctaggcctacccgaggcctccgtcattctagtggtacgcctactccccgaaccgtacgggaccctacggttcggtaactccccgaagccctaagtacttaccgagggtcggacctacggttcggggtcgtacggggactaggtaacggtttaccacttccgtaccaacctacgtaccgacgtacgtacgtccgtggacctaggttaccgtaggtaagtttnttttggtactttaagttttacttacgttgtacgagtactaagttaattagcgtaccgttcgtacccttccggtacggacccaaacgggtacaccggtacgtacggtaagtaaaccggtttaaaccgaggttacggtacgtacgtaccggacctaaccgtcctttagtcccgttacttaccg

SEQ ID NO: 250808 - DNA, 621 bp, Homo sapiens
  misc_feature: GYAE6OF02I0GJE.44.65.F10.1.454.CMB.1.raw
  modified_base (205)..(205): a, c, t, g, unknown or other
  misc_feature (205)..(205): n is a, c, g, or t
  modified_base (320)..(320): a, c, t, g, unknown or other
  misc_feature (320)..(320): n is a, c, g, or t
tcagacagtatatacacgaccggtgctcgatttagctacgctctaagggggctctggggaggaactgctcagttaggacccagacggaaccatggaagccccagcgcagattctcttcctcctgctactctggctcccagataccactggagaaatagtgatgacgcagtctccagccaccctgtctgtgtctccgaggggaaancgccaccctctcctgcagggccagtcagagtgttaccagcaacttagcctggtaccacagaaaccgtgggcaggcctcccgaggctcctcatctatggtcgcactcccgaaccgngggcccacgtcggtactccccgagcccgtaggttccaggtcggctagggtcgggtctgggacagtacgttcacgttcctaccaacctactacgacgacacgtccgtgccagtctaggtaagttagttttgacttaagtttattacgttgtacgacgtcacgtccgttcccgtccgtacggtcccgtaccgttccgtaccggtttccggggaaccgggggtaccgtaagggtcggaagtacgtcgaacggaacggtaacgtcggtacggtccgttcgacctaccgtacgttcgtcgttaccg

SEQ ID NO: 250809 - DNA, 607 bp, Homo sapiens
  misc_feature: GYAE6OF02GPRPJ.44.65.F10.1.454.CMB.1.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttaccagcaacttagcctggtaccaccagaaacctgggcaggctcccaggcctcctcatctatggaacntcccaccgagggccacgtggtactcccacctaggttcaggtggcaggtcggggtccgganagtagttcactctcaccatcagccggcctgcngtctgagtatttgactagtttatactgtacagtactagttaataattaacgtgtacctcttccgtacggtttccggggaccgggggtaaccgtaaggggtggaacgtaacgtaccgaaaacgtacgttgggtacggtcgtacggacctaaccgtacgttccgttcgtttaccgttactaccgtttcccctttccccggtacccttacgttcgtaacg

SEQ ID NO: 250810 - DNA, 609 bp, Homo sapiens
  misc_feature: GYAE6OF02HBVVI.44.65.F10.1.454.CMB.1.raw
  modified_base (196)..(196): a, c, t, g, unknown or other
  misc_feature (196)..(196): n is a, c, g, or t
  modified_base (299)..(299): a, c, t, g, unknown or other
  misc_feature (299)..(299): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaanagccaccctctcctgcagggccagtcagagtgttagcagcaacttagcctcgtaccagcagaaatctggccaggcctcccgaggcctcctcatctagtggtcncactcccaccgagggcccacgtcggtactcccgagcccgtaggttcaggtggctagggtgggtctggggacaggtacgttcacttcctaccacctatcgagcacgtcctggctaggttcgtagtaaacgttagttttcgtacttaagttttacttacgttgtacagtctaaggttaataagtcgtacgtcggtcccttcccgttacggaccgtaacgggacctacgtacgtacggtaacgtaaacgtttaaaccggacgttaggtcggtacgtacgacctaccgtacgttcttcggttaccttactaccg

SEQ ID NO: 250811 - DNA, 592 bp, Homo sapiens
  misc_feature: GYAE6OF02GZBXJ.44.65.F10.1.454.CMB.1.raw
  modified_base (195)..(195): a, c, t, g, unknown or other
  misc_feature (195)..(195): n is a, c, g, or t
  modified_base (258)..(258): a, c, t, g, unknown or other
  misc_feature (258)..(258): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagagatcaccggagatattgtgttgacacagtctccaggcaccctgtctttgtctccgagggganagagcccaccctctcctggtagggccagtcggagtgttgctaagtacctagcctggtaccaanagaaacctggccaggctcccaggctcctcatctatgatgcatccaacagggtcactggcaccccagacaggttcagtgcagtggtctgggacagacttcactcncaccgtcagcaatgtacngccgtagaagtatttgctagtttatactgtcagtctacgtcgtttcctccgacggccgtcttcgtaaccggttttccggggaccggggggtaacctaaggggttacgggaacgtacgtacgaaggtaaccgtacgtggtacgggcgttacggaccgtaacctacgttccggttacgttcctttacgtacctttcccgttccccgtacctacg

SEQ ID NO: 250812 - DNA, 809 bp, Homo sapiens
  misc_feature: GYAE6OF02FGG1H.44.65.F10.1.454.CMB.1.raw
  modified_base (202)..(202): a, c, t, g, unknown or other
  misc_feature (202)..(202): n is a, c, g, or t
tcagacagtatatacacgaccggtgctcgatttagctacgctctaagggggaggaactgctcagttaggacccagacggaaccatggaagccccagcgcagcttctcttcctcctgctactctggcctcccagactaccactggagaaactgtgatgacgcgtctccagccacctgtctgtcgtcctaccgaaggggtaacncgccctacccgtctcccgtgaccgacgggccaggttccagtacgttcgtacgcacgtcctaactttcgcccttacgaccagaccaagaacgtcgtcgggccacgggtcctccccgaggtccctcctacgtacttcgtaacgtacggaacctacgtaccgacggaccggtcctaccgttacgtaccctacccgtaccgtaggtttaccgagtcgggtaccgtacgggttaccgggtaccggatacggttacgtacctaaccgtccaaccgtacccgtaacgtcccggaccgggtcccgtacctacgggtaccgtaggttaccgtacggttaacgggtttactttacggtaacgtttaacggttttacgaccgttaggtaccgtaacgtaccgtttaaacgtaaccgttaacgtccggtacccggttaccggttacccgttaccgggtaacccggtaaaccggtaacgggtaaccgtaacgggtaactaaacgggttaacttaaacggttaaaccgtcgtaccgtacggttaaccgtaccgacccttaaccgttacgttccgtttaccgtaccttacccggttacctaccccgtacgttaccttaacgg

SEQ ID NO: 250813 - DNA, 699 bp, Homo sapiens
  misc_feature: GYAE6OF02IJNDX.44.65.F10.1.454.CMB.1.raw
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
tcagacagtatatacacgaccggtgctcgatttagctacgctctaagggggctctggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagcccacctctcctgcagggccagtcagagtgttaccagcaacttagcctggaccacagaactggcagcnccagctccnanctagcgacagtcccaccgacggccacgtcggtactaccccgacctacgggttcaaggtcggacctagggttccggggtacccgggaactacgggtaacgttccgaactccgttaccaacccgtacttcccgaagggtcccggtccctaaggtcccgtacggtttaccgtgggtaaacgggtttacgtttttcgacgttaggtttttacgtttaacgtcggttacctaggtcgtaacgttaattaaagtaccgttgggccctttactccggttaaccgttttcgggggaccggggtaacctaggggttagggaactaacgttaccggaaacgttacggttggtcgggtaccctgggtaaccctacgtaacgttccgtacgtttccgtaagttaccggttccccttaccgacccg

SEQ ID NO: 250814 - DNA, 628 bp, Homo sapiens
  misc_feature: GYAE6OF02HF606.44.65.F10.1.454.CMB.1.raw
  modified_base (606)..(606): a, c, t, g, unknown or other
  misc_feature (606)..(606): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagagccaccctctcctgcagggccagtcagagtgtagcagcaacttagcctcgtaccagcagaaatctggccaggctcccaggcctcctcatctagtggtgctatcccaccgacgggcctaacgtcgggtaactccccgaggtcccgtagggttccaggtcggcgtagggttcggggtctacggggaactaggtacgttccaaccgttcctccgaacctataccgaacgccgacggcccttaggaccgtacggttacgtaggtaagttagtttttcggactttaaggttttactttacgtcgtacagtactaagttaatagtacgacgtccggtcccttcccggtacgaccgaacggactacgacgtaggaacgtaacgtaaacgtacgttggacggtactgacctacctnttaccgtcttaccttactaccg

SEQ ID NO: 250815 - DNA, 679 bp, Homo sapiens
  misc_feature: GYAE6OF02GRNSO.44.65.F10.1.454.CMB.1.raw
  modified_base (198)..(198): a, c, t, g, unknown or other
  misc_feature (198)..(198): n is a, c, g, or t
  modified_base (264)..(264): a, c, t, g, unknown or other
  misc_feature (264)..(264): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgcccaccctctcctgcagggccagtcagggtgttggcagcagcgtagccgtgtccagcagaaccnggaccagacctccgagcctcctactactcctaactaccacaccgtaccacgacggcctacgtcgtacctccgagaccgagtacttcgaggtcggactcggtcgggtcgtagggactaggtacgttccacttacctaccacctactcgacgcgaccgtccgtagacgtacgtacgtaaggttaattacggttttactaccgttttaagttttacgttaacgttcgtacgtaagtacgttaagttaacgttagggtaccgttacggttccgttcccgtttaccgtttacccgttaccggtttcccgggacccgttaccgggaccctacgtaccggtttacgttaaccgttaacgaaaccgggttctgggttaccgtacgttccggtaacccgtacttacgtttccgtacgtttaccg

SEQ ID NO: 250816 - DNA, 754 bp, Homo sapiens
  misc_feature: GYAE6OF02IITBS.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcagggccagtcagagtgttagcagcaacttagcctcgtaccagcagaaatctggccaggcctccaggctccgtcacttctagtggtgcacgtcccacgacggccacgtcggtactcccgacgtaccgtacggtttcgaaggttcggacgtacggtttcggggtaccgtaggggtacgtaggtacgtttcgtaaccgttcctaccgaaccctaacgtttcccgaacgaccgtaaccggtcccgtacgtaacgtacggttacgttaggtaaacggttagtttttcggtaaccgtttaagtttttaaactttacgttaggttaccgtaacggtaccgtaaggtttaacttaaaggttaccggtaacctttccggggtaccccttttcccgggttacccgggtaacccggtaaacggggtaacccgtaccggtaaccgggttacgggtaacgttaaaccggttaaaacggtaaccgtttacgggtacggtccgttaacggtacctaacccggttacttacccggttgtttacccttacttaacccgg

SEQ ID NO: 250817 - DNA, 610 bp, Homo sapiens
  misc_feature: GYAE6OF02G8LLF.44.65.F10.1.454.CMB.1.raw
  modified_base (384)..(384): a, c, t, g, unknown or other
  misc_feature (384)..(384): n is a, c, g, or t
  modified_base (587)..(587): a, c, t, g, unknown or other
  misc_feature (587)..(587): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctccgaggggaaagcgccaccctctcctgcacgggccagtcagagtgttagcagctaacttcgcctcgtacagacaagaatcgtcggccaacgacctccccgaggccttcctacattctaactacccactactaccccaccgacgggcctacgtcggtactcccagccagtacttcgaggtcggcacggtggggtaccgganacggtacgttcgacttcctaccactacgtcgacggccggcctacgtcgacgttcgtagggtaggttactttcggactttaagttttactaggttcgtactacggtactaagttaataacgtacgttcggtcctacgttcgtacggttcggggacgggtacgagggtgacgagtacgaacggtacgtggacgctcgactacgtntcgtcgttctctacttccctccg

SEQ ID NO: 250818 - DNA, 620 bp, Homo sapiens
  misc_feature: GYAE6OF02IM36O.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaagagccaccctctcctgcagggccagtcagagtgttagcagcaacttagcctcgtaccagcagaaatctggccaggctcccaggctcctcatctatggtgcactccacgacgggccacgtcggtactcccagcctaggttcaggtcgcgaggtcgggtcgtgggacaggtacgttcacgttctacaccagtacaggccggcctaaggacgtacgggaagtagtttcgactagtttaacttacgtagttacctaaccgtaccgtacgaccgtacgtcggtaccgttaggtaacgttaggttttcgggaccggtacggggtaacctaaggcgtacggacgtaccgtacgaaacggtaacgtggtacgggtctcggaccgtaaccgtacgttaccgttcgttcctttaccgtacttaccccgttaccccg

SEQ ID NO: 250819 - DNA, 523 bp, Homo sapiens
  misc_feature: GYAE6OF02GOBC1.44.65.F10.1.454.CMB.1.raw
  modified_base (346)..(346): a, c, t, g, unknown or other
  misc_feature (346)..(346): n is a, c, g, or t
  modified_base (519)..(519): a, c, t, g, unknown or other
  misc_feature (519)..(519): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagcccaccctgtctgtgtctccaggggaaagagccaccctctcctgcagggccagtcagagtgtaccagcaacttagcctggtaccacagaaacctggcaggctcccaggctcctcatctatgaacatccacagggccacgtggtactcccacctaggttcagtgcagtgggtccgganagtacgttcactctcacatcagcgcctgcagtctgagtatttgctagtttatactgtcagtcatataatacgtgcctctctacgttcggcggggacagggtgagatacgaaacgacgtaggtgcgtcgctacctagtccgtagttcttacgtacttccgttcccgactacctntacg

SEQ ID NO: 250820 - DNA, 938 bp, Homo sapiens
  misc_feature: GYAE6OF02IUGDL.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttaccagcaacttgcctggtaccacagaacctgggcacggctccgaggctcctcatctatcggaacatccaccgacgggacccacgtggtaactccccgacccgtaggttcaggtcggcgtaggtcggggtaccggatacggtacgttccacgttccttaccgaacctagttccgaacggtcccgggtccctacgggccttacgggtttacccgtagggttaacggggtttaacgttttttcgggtaacccgttttaacgggtttttttaaacgttttaccgtttacgggtttaacccgtacgggttaacccgttaaaggttttaaaacgtttaaaacgtttaaaacccgggtttcccggggttaacccttttaacccggtttaccccgtttaaaccggggttttttaccccggggggggtaaccccggggggggggtttaaaaccccggttaaaacgggggggtttaacgggtaaaccggggtaaaaccgggtttaaaccccgtaaaaaaacccggggttaaccggtttaaccggggttacgggggttacccggtttaaccggggtaacccccgtaaaacccgttaccgggtttttaaccccggttaccgggtttttaaccccgttttaccccgttaacccgggttttttacccccgtttaacccccccggggtcccttttaaaccggtttacccccggttttaaagg

SEQ ID NO: 250821 - DNA, 668 bp, Homo sapiens
  misc_feature: GYAE6OF02JWZHU.44.65.F10.1.454.CMB.1.raw
  modified_base (204)..(204): a, c, t, g, unknown or other
  misc_feature (204)..(204): n is a, c, g, or t
tcagacagtatatacacgaccggtgctcgatttagctacgctctaagggggctctggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanacgccaccctctcctgcacgggccagtcagagtgttaccagctaacttagcctaggtaccaccagaaacctgggcacggcctccgaggcctcctcatcgtagtacggaactactcccgaccgagggcccacgttcggtacctccccgacccgtaggttccacggttcggacgtacgggttcggggtacccgggaacgtacgggtacgtttccacgtcctaccgaacctagtccgacgccggcctacgcgtacgtcgtaggtaggttatttcgactttagtttacttacgtgtactagtacgtaagttaataactaccgttcgtccttactacggttaccggttaccgggggacggggtaacgtagggtacggtaacgtaacgtaaccggaacgttacgtcgggtcggtaccgtacgaccctacgtacgttcgttcggtaccttcgactttacccgttccctacg

SEQ ID NO: 250822 - DNA, 806 bp, Homo sapiens
  misc_feature: GYAE6OF02IFQPW.44.65.F10.1.454.CMB.1.raw
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagccacctgtctgtcgtctccgaaggggaagacgacccaccctctcctggcgacgggccagtcaggtagtacgttaccagactaacttacgccgtacggtaaccaaccgacggaaaccgtggggaccacggcccgtacccgacggtcctaccctactacttaccgtaagtacggaactactacccgaacgacgggcctacgtacggtacctaccccgacccgtaggttccaggtcggacgtacgggtacgggtaccggactagtacgttaccacctcctaaccaaccgtactacgacgggtcccggtccgtaggaccgtacggttacgtagggttaacggtttacgtttttacggaacgttttaaggttttaacttaccggttacggtaccgtaacgtacgttaaagtttaaacgttaaacgttaacccgttccgggtaccttaaccgttccggttaaccggggttttaccgggggggaaccgggggttaaccgtaaggggtacggttaacgaaaccgtaaacggtaaaaccgtacggttggtcgggtaccctacgggtaaccctaaccgttacgttcgttaccgtttaccttacttaccggtttcccccgttaccccgactttaccgttagttaaccg

SEQ ID NO: 250823 - DNA, 579 bp, Homo sapiens
  misc_feature: GYAE6OF02IHOL0.44.65.F10.1.454.CMB.1.raw
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaagcgcccaccctctcctgcagggccagtcagtgtgtaccagcaacttagcctggtaccacagaaacctggccagacctccaggcctcctcatcctactaccactactcccaccgacgggccacgtcggtactcccagcccagtacttcgaggtcggcacgtgggtctggggacagtacgttcacttctaccacctactccaagccacgtcctgcctagtctagtaagttatttcgcgttagttttattacgttgtcagctagtatagtgtacgtcggtcctccgttccttaccgttccggtcccgtacggaccctagtacgtcgtactttaccgaaacgtacgtcggtcgtccgtagtccaccttctcgtcgttcttctcc

SEQ ID NO: 250824 - DNA, 674 bp, Homo sapiens
  misc_feature: GYAE6OF02I8CBX.44.65.F10.1.454.CMB.1.raw
  modified_base (195)..(195): a, c, t, g, unknown or other
  misc_feature (195)..(195): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagagatcaccggagatattgtgttgacacagtctccaggcaccctgtctttgtctccgagggganagagccaccctctcctgtagggccagtcggagtgttgactaagtacctagcctaggtaacccaacagaaacctggaccaggcctccgaggcctcctcatctatgatgcatccaacgagggtccacgtcggccaccccagactaggttcagtggcaggtcggtcgtgggacagtacttcacttctctacccgtcacggtactaacgtgtaaccgacgtcccgttaaggtaagtttagtttttacggacctttaagttttaacttacggtttcgtaccgtaacgtacgtacggttcccgttccctacccggacggtcccgtacgttccgttaccgggtttaccgggggaccggggggtaaccgttaaggggttacgggaacggtacgttaccggaaacggtaccgtacgtcggtacggtccgtacgacctacgtacgtttcgtacgtttcctacgtaccgtttcccgtacccgtactacgg

SEQ ID NO: 250825 - DNA, 571 bp, Homo sapiens
  misc_feature: GYAE6OF02IARCL.44.65.F10.1.454.CMB.1.raw
  modified_base (196)..(196): a, c, t, g, unknown or other
  misc_feature (196)..(196): n is a, c, g, or t
  modified_base (278)..(278): a, c, t, g, unknown or other
  misc_feature (278)..(278): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangcccaccctctcctgcagggccagtcagagtgttagcagcaacttagcctcgtaccagcaagaaatctggccaggcctcccnggctcctcatctagtggtgcactcccaccgacgggcccacgtgaactactcccgacgcctaggttcaggtcggctagggtcgggtactgggacaggtacgttcactctccacctatcagcacgcctgacagtctagaacttgttttcgacttagttttacttactcgtacagtacaagttataacgtgtactcggtccctccgttacgaccgaagggaccacgacgtggaacgtaacgttaaccgacgttggtacgtacgtacgaccaccgttactccgtttcgtccttaccg

SEQ ID NO: 250826 - DNA, 643 bp, Homo sapiens
  misc_feature: GYAE6OF02HB8XQ.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagacgcccaccctctcctgcagggccagtcagagtgttagcagcaacttagccctacgtaccagcaagaaatcgtggaccaggcctcccgaggcctcctcactctagtggtcgcactcccaaccgacgggccacgttggtactcccgagccgtaggttcaggtcggcgtaggttggggtcgtagggacaggtacgttccacgttctaccacctatccgacgccgacgcctgctagtctagtaagttgtttgcttaagttttacttacgttcgtacgtagtactaagttaattagtacgtaccgtccggttaccccttacccggttaccgggaaccggaaacgggacctaaccggtacggtacgggtaacgttaaacgttaaaccggtaacgttgggtaccggtacgttacgacctacctagtttccgttacgttcctttacctacccg

SEQ ID NO: 250827 - DNA, 557 bp, Homo sapiens
  misc_feature: GYAE6OF02ISYLV.44.65.F10.1.454.CMB.1.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
tcagacagtatatacacgaccggtgctcgatttagctacgctctaagggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaacagaaacctggccaggctcccaggctctcatctatggtncatccaccagggccactggtatcccagccaggttcaggtggcagtgggctgggacaggagttcactctcaccatcagcagcctgcagtctgaagtatttgctagtttatactgtcagcagtataatgactcggccttacccgttcggaccgtaaagggaccaacgacgtagggaacgtaagttaaaccgacgtaggtacggtcctacgaccaaccgtagttaccgtgttaccttaccgtacgttcccttaccccggacctaacg

SEQ ID NO: 250828 - DNA, 573 bp, Homo sapiens
  misc_feature: GYAE6OF02F23JR.44.65.F10.1.454.CMB.1.raw
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
tcagacagtatatacacgaccggtgctcgatttagctacgctctaaggggggaggaactgctcagttaggacccagacggaaccatggaagccccagctcagcttctcttcctcctgctactctggctcccagagatcaccggagatattgtgttgacacagtctccaggccaccctgtctttgtctccgagggggagagagcccaccctctcctggtacgggccaggtcggagtgttgctaaagtacctagcctggtaacccaacacgaaacctggccagggcctcccaggcctcctcatctatgatgcatccaacgngggtcacgtggaccaccccagactaggttcaggtggcaggtgggtngggacagtacttcactctcaccgtcaggcaatgtacacgctagaagtatttgnttagtttattattcgtactaacgtaccgtaaagagttcggacctacaattacttctacgtttccggcccgtgggaacctaaagtgaatactacgaaacgtactaggtagtcgtacgactaccattcgtcgttcttactacttcctcccgtctacg

SEQ ID NO: 250829 - DNA, 854 bp, Homo sapiens
  misc_feature: GYAE6OF02HB6VO.44.65.F10.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccatggagaaatgtgatgacgcggtctccagccaccctgtctgtgtctccgaaggggaaancgccaccctntcctgcagggccagtcagagtgtagcagactaacgttagcctacggtaccagacaaggtaaaactcgtacggaccgaacggtccttaccccgaggtccttcccttactaacgttccgttaagttcggggtacgtacctaaccgttccccgaaacccggaaccgggggtaccctaaccgttacgggtaaaccttacccccgaaggtaccccgtaaggggtttaccaaggggttcggtaccgtaagggttcggggttacgttacgggggtaactaagggtacgtttacccgaacgttaccttaacccgaaaccgtacgttaccgaacggtaccgtaacggtccccgtaaggtaccttaacgggttaccgttaagggtaaagtttacggttttacggaaaccgtttaaggtttaaaccttttaacggtacgttaccgtaagtaacgtaacgtttaaagttaaaccgttaacggtacccgttacccgggttacccccgtttacccgggttaaccgggaacccgggtaaacgggtaaacccgtaaccgggtaccgttaagggaaaccgtttaaacggttaaaaccggtacgttacggtacggtaccttacgaaccgtaacctacgttaccgtaggttaccttacgtaacccg

SEQ ID NO: 250830 - DNA, 658 bp, Homo sapiens
  misc_feature: GYAE6OF02IX3HG.44.65.F10.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatgtgatgacgcggtctccagccaccctgtctgtntctccgagggaaanagccacctctcctgcagggccagtccagagtgttagcagactaacttagcctcgtaccagacaagaaactctggcccaagcctacccgaggtctacctacacttccgtatggtgctacgtaccacgacgggaccacgtcgtactcccagacctacggttcaggtcggactagggttgggtaccgtagggacgagtacggttactaccgtactacgacctacgtaccgacgacgaaccgtccgttaagctaaggttctaagggtaaagttcttttacgaccttaaggtttttactagttcgttaccaaggtcttaacgtaacgttcgtaccttttaccgacctaccgttacgtaccggtaaccgttccggaaaccgtaacgggaactaagggtaacctaaagtacctaaaaccggagttacggacgtacgtacgacgtaacctcgttcggttactcgttaaccg

SEQ ID NO: 250831 - DNA, 538 bp, Homo sapiens
  misc_feature: GYAE6OF02G8914.44.65.F10.1.454.CMB.1.raw
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtcctgtgtctccaggggaaagagccaccctctcctgcagggccagtcagagtgttagcagcaacttagcctcgtaccagcagaaatctggccaggctcccaggctcctcatctatggtgcatccaccagggccactggtactcccagccaggttcagtgcagtgggtctgggacaggtacgttcacttctcaccatcagcacgctgcngtctagaagttntttgcgttagtttattactgtcagactagtaatatgactcgccttcccgttcgaccgaacgggtaccacggtacgtcggaacgtaacgttaaaacgaacgtggtcggactacgacaccgtacgttctcgttaccttctaccg

SEQ ID NO: 250832 - DNA, 731 bp, Homo sapiens
  misc_feature: GYAE6OF02FPD2S.44.65.F10.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangcccaccctctcctgcagggccagtcagagtgttagcagcaacttgccctcgtaccngcagaaatctggccacggctcccgaggcctcctcatctatcggtgcactccaccgacgggacctacgtcgtactcccagtcccgtaggttcaaggtcggacgtagggtcggggtcgtacggggaacgtaggtacgtttaccaccgttacctaccgtaaccctacgtaccgtagaccgtaaccggtccctacggctaacggttaccgtaggtaaacggttacgtttttacggaactttaaggttttaacttacgtttcgttaccgtaacgtaccgtaaggttaacgttaaacgttacggttaaccgttccggttaccccgtttaccccggtttaccgggaacccggtaaacggggtaacccaaccggtaacgggtacggtaaacgtaaacggttaaaaccggtaaccggttacgggttacggtaccgttacgaccgtaaccgtactttaccgtacggtttaccttacggttaaccccg

SEQ ID NO: 250833 - DNA, 678 bp, Homo sapiens
  misc_feature: GYAE6OF02GNX19.44.65.F10.1.454.CMB.1.raw
  modified_base (199)..(199): a, c, t, g, unknown or other
  misc_feature (199)..(199): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaaggggaaagngcccaccctctcctgcagggccagtcagagtgttacgcagctaacttacgccttacgtaccagcaagaaactctcggccaggcctccgaggtcctcctctatctagtggtctactacgtacccgaccgacgggcctacgtggtacctacccgacgtacccgtaggttcgaggtcggacgtacggttgggtacgtacggggtaacaggtacgttaccacgtacctacacctaactcgaacgtccgacgtcctaggtactacgtacgtaagtaacgttatttcggacgtttaacgttttacttacgttacgtacctagtaccttaagttaacttaaaggtccgtaccgtccgggtacccttcccggttacggacccggtaaaggcctaacggacgtaggaacgtaacgttaaaaccggtacggttacggtacggtaccgtacgtaccgtaccgttacttcgtacgttaccttacgtacccg

SEQ ID NO: 250834 - DNA, 611 bp, Homo sapiens
  misc_feature: GYAE6OF02HOKPW.44.65.F10.1.454.CMB.1.raw
  modified_base (198)..(198): a, c, t, g, unknown or other
  misc_feature (198)..(198): n is a, c, g, or t
  modified_base (422)..(422): a, c, t, g, unknown or other
  misc_feature (422)..(422): n is a, c, g, or t
  modified_base (445)..(445): a, c, t, g, unknown or other
  misc_feature (445)..(445): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtcgtctccgaggggaaangcccaccctctcctgcgagggccagtcagagtgttagcagcaacttagcctcgtaccagcaagaaatctcggccaggcctccaggtcctcctcattctagtggtgctactccaccgacggcctacgtcggtactcccgagccgtaggttcaggtcgcgaggtgggtctgggacaggtacgttcacttctaccacatcacgcacgctagcgattcgtagaagttntttgactttaagtttactacgtnttacgatacgtaagttaacgtaatggtacccgtcggttccccttacccgttacggaaacccggtaacgggacctaaccgtaggtacgggtaaacgtaaccgttaaacgtaggttacggtacggtacctacggacctaccgtattccgttacttccgtttactaccc

SEQ ID NO: 250835 - DNA, 608 bp, Homo sapiens
  misc_feature: GYAE6OF02FZ410.44.65.F10.1.454.CMB.1.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaancgccaccctctcctgcagggccagtcagagtgtaccagcaacttgcctggtaccacagaaacctggcaggctcccaggcctcctcatctatggaacatccaccgacgggccactggtacncccaccgtaggttcagtggcaggtcgggtccggacagtagttcactcacaccatcgagccgctgcagtctgagtatttgcttagtttacttactgtacagctaagtattagtgacgttcggtcccttcgttcctaccgtttccggtacccgtcgggtaccctacgtacgtaccgttacgtttaccgaaaaccgttacgtacggtacggtccgtacgacccgtaccttaacgttccgttacgtttccctttacccgttaaccgtttccccgttacccccggtaccttaacccg

SEQ ID NO: 250836 - DNA, 566 bp, Homo sapiens
  misc_feature: GYAE6OF02F1CRQ.44.65.F10.1.454.CMB.1.raw
  modified_base (403)..(403): a, c, t, g, unknown or other
  misc_feature (403)..(403): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggcctcccaggctcctcatctagtggtgcatcccaccgaggggccacgtggtactcccagcctaggttcaggtggcaggtgggtctgggacaggtagttcagtctcaccatcagcagtcctgcagtctagaagtntttgcttagtttattactgtacagtactagttataagtgtacgtcggtacccttcccgttacgggaccgtaaacgggacctacgacgtgggaacgtaacgttaaaccggaacgttggtcggtactacggacctaccgtacgttcgttcgttccttcgtacccg

SEQ ID NO: 250837 - DNA, 665 bp, Homo sapiens
  misc_feature: GYAE6OF02JQVK0.44.65.F10.1.454.CMB.1.raw
  modified_base (202)..(202): a, c, t, g, unknown or other
  misc_feature (202)..(202): n is a, c, g, or t
  modified_base (255)..(255): a, c, t, g, unknown or other
  misc_feature (255)..(255): n is a, c, g, or t
  modified_base (336)..(336): a, c, t, g, unknown or other
  misc_feature (336)..(336): n is a, c, g, or t
  modified_base (380)..(380): a, c, t, g, unknown or other
  misc_feature (380)..(380): n is a, c, g, or t
  modified_base (425)..(425): a, c, t, g, unknown or other
  misc_feature (425)..(425): n is a, c, g, or t
  modified_base (451)..(451): a, c, t, g, unknown or other
  misc_feature (451)..(451): n is a, c, g, or t
  modified_base (536)..(536): a, c, t, g, unknown or other
  misc_feature (536)..(536): n is a, c, g, or t
  modified_base (622)..(622): a, c, t, g, unknown or other
  misc_feature (622)..(622): n is a, c, g, or t
  modified_base (656)..(656): a, c, t, g, unknown or other
  misc_feature (656)..(656): n is a, c, g, or t
tcagacagtatatacacgaccggtgctcgatttagctacgctctaaggggaggaactgctcagttaggacccagacggaaccatggaagccccagcgcagcttctcttcctcctgcttactctggcctcccagataccactggagaaatgtgatgacgcagtctccagcccaccctgtctgtcgtcctccgaaggggaaacncgcccacccttctccgtgaccgagggccctaagtccgagacgttcgttaaccnggacctaaccgttgacccttaggacccaaccgaacggaaacccgtgggaccgtccggccgttcccaagggcctccccgtanaccgtctataccggacacctccaccgacggcctacgtggtaccnccccacgtaggttcacggtggacctacgggttcgggtacccgaanacggtaacgttccaactcgtacacgntacgacgcgtcctagcgtacgtcgtagtagtagttttcgacgtttcgtttaattccgtagttcgagttactaacgtattaaacgngtcgtcctactcgtttaccggtcggggaccgggtactaagggtcgtaacgtagtaccgaaaggtacgtagtcggactcggtaaccntacgtcgtccgttatcgtacctccgacctacgtntcgttaacg

SEQ ID NO: 250838 - DNA, 639 bp, Homo sapiens
  misc_feature: GYAE6OF02FNZFV.44.65.F10.1.454.CMB.1.raw
  modified_base (428)..(428): a, c, t, g, unknown or other
  misc_feature (428)..(428): n is a, c, g, or t
  modified_base (442)..(442): a, c, t, g, unknown or other
  misc_feature (442)..(442): n is a, c, g, or t
tcagacagtatatacacgaccggtgctcgatttagctacgctctaagggggctctggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagcgccacccttctcctcgcagggccagtcagagtgttaaccagcaacttagcctggtaccaccgagaaacccgtgggaccaggcctccccgaggccttccctcattactagtacggaacctacgtcccgaacccgagggtccacgtcgggtacctcccccgacccgtaggttaccaggtcggctagggttcggggtccgggactaggtacgttcactctcaccntcgacgcgcctgcngtcgtggagtattgcttagtttatacttgtacagtactagttataatacgtcgtacctcgtcgtacgttcgggtaccggggtacgtaaccgggtaggtagtaacgtacgaacgtacgtaggtcggtccgtacggtaccgtaccgtacgttccgttcgttacccgtttaccgtaccgttcccggttaccccgtacccg

SEQ ID NO: 250839 - DNA, 860 bp, Homo sapiens
  misc_feature: GYAE6OF02GTVJ9.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagcccaacctctcctgcagggccaagtcaagggtattaccgtacgacgtaacttacgtaccgtcgtaaccgtaacccaagaaaccgtacgggcgaacggaccgtacccctacggacgtcctcctaataccttacgttacggaaccgtaaccttacccgtaacccggaccgggtaaccgtaacccgttacgggtaacctaccccgaaacccccgtaacgggtttaccgtaacgttcggggtaccgtaacgggttaccgggggtaacccgggggtaaccgtaacggttaacggttaccccgtaactaccgttaacccgtaacccgaaccgttccgaacgggtacccggtcccggtacgtaccgacgtttacgtacggtaaagggtttacgtttttcggtacgtttaaacggttttaacgtttaaccttagtaccggtacaaccgtaaggtttaaacttaaaccgttaacgttccggaccgttcctttaaccggtacccgggttttccgggggtaaccggggggtaccgtaaagggtcgggtaaggtaaccgtaacgtaaaccggaacgttgtaggtaccgtagttaaccgaaccttagttacccttcggttacctttaccgaccgttttacccttacccgaccgttacttaccggtacttaaacg

SEQ ID NO: 250840 - DNA, 552 bp, Homo sapiens
  misc_feature: GYAE6OF02F1488.44.65.F10.1.454.CMB.1.raw
  modified_base (197)..(197): a, c, t, g, unknown or other
  misc_feature (197)..(197): n is a, c, g, or t
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
  modified_base (528)..(528): a, c, t, g, unknown or other
  misc_feature (528)..(528): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcagggccagtcagagtgtagcagcaacttagcctcgtaccagcagaaatcgtggccaggcctccaggcctcctcatctagtggtgcatcccaccgacgggccactggtactcccgagccaggttcaggtggactaggtgggtcgtagggacaggtacgttcactctaccacatcaagcacgccngcagtctagagttatttgcttagtttattacgtntacgagtctaagtataactgtactcgtccttccgtcgcgaacggacacgtacgtaggaactaagttaaacgattagggtcgacgttaccgacttacccngttaccgttcgttaccttctaccg

SEQ ID NO: 250841 - DNA, 565 bp, Homo sapiens
  misc_feature: GYAE6OF02GXK5G.44.65.F10.1.454.CMB.1.raw
  modified_base (194)..(194): a, c, t, g, unknown or other
  misc_feature (194)..(194): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctccaggggaancgccacctctcctgcgagggccagtcagaggtgttagcagctacttagcctggtaccaanagaaacctggccaggctcccaggcctccgtcatctagtggtgcatccaacgngggccacgtggcatcccagcctaggtcagtggactaggtggtctaggggacaggtacttcactctcaccagtcagcacgcctagacgtacctagaagtattttgacttagtttactgacttgtcagtcgtagcgtacgcgaacgtcggaccgtacgtctacccgttcggaccgtaacgggacaccggtacgtaggaacgtaacgttaaaccggtacgtggtcgacgtacgaccgtaccgtagtaccgttgtccttaccg

SEQ ID NO: 250842 - DNA, 721 bp, Homo sapiens
  misc_feature: GYAE6OF02J2ANY.44.65.F10.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctccgaggggaaangcccacctctcctgcagggcctagtcaggtagtgttagcagcaacttgcctgaccngcagatcnggcagctccagctcnatctagtcggtnctacccgtaccgacgggtcctaacgtcggtaactcccgagcccgtaggttaccaggtcgcgtaggttcgggtctgggaactagttacgttccaccttcgtaccaaccgtagttaccgagaccgtaacgtccccgtagaccgtacgttaccgtacggttaaaacgttggtttttaccgacggtttaaaccgtttttaacgttaaccggttcggttaacccgagggttaactaaagggtttaaacttaacggttaaccgttaacccggtttcccggtaccccctttacccgggttaccgggaaccggtaaaccgggtaaacttacccgggtaaccgttacggtaacgtaaacggtttaaaacccggtacgttcggtaacggttcctaaccggtacctaacgtcgtttaccgttacgttacccttacgttaaccccg

SEQ ID NO: 250843 - DNA, 610 bp, Homo sapiens
  misc_feature: GYAE6OF02IV9NM.44.65.F10.1.454.CMB.1.raw
  modified_base (284)..(284): a, c, t, g, unknown or other
  misc_feature (284)..(284): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctttgtctccaggggaaagcgccaccctctcctgcagggccagtcagagtgttaaggaactacttagcctggtactcaacagaaacctggaccaggctccagctcctnatctatgatgcactccaacgagggtcacgtcggccaaccccgagaccgtaggttccaggtcggctagggttcgggtctaggggaccaggtaccttcactccttcaccgttacagtctaaagtgtaacacgcctagaagttatttaggacttagtttattacgtgtacgtagcgtacgtaccgttcctaccgtaccgccggcttaccgtacggtttccggggaccggggtactaagggtcgagtaacgacgaacgacgtaacgtcgggtacggccttacgaccgtacgtagttccgttgttccctactcctttaccgtccccgtacc

SEQ ID NO: 250844 - DNA, 711 bp, Homo sapiens
  misc_feature: GYAE6OF02GQT69.44.65.F10.1.454.CMB.1.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctctgtcctccgaggggaaangccaccctctcctgcgagggccagtcagagtgtggcngcagcgtagccgtggttccagcagaacctggccagactcccaggctcctcatctactaccacactacccaccgacgggcctaacgtggtacctcccgacggccagtacttcgagtcgggctacggtcgggtctcggggactaggtagttccaccttccttaccaacctactacaacggtccacgtacccgtggacctacggttactaacgggtaaagtttcgtttttacggacgttttaacgttttaaccgtttacggtttcgtaccgtagtactaacgttagttaacgggtacgttaaccggttccggttacccgtttacccgggttttaccttaacccgggttttcccgggtaccccggttaccggggtacccgtacgtaccgggtttaaccgttaaccgttttaaccggaaaccgttaacgttgggttaccggttacgtaccgtacccgtaacgttaccgttaccgtttccgg

SEQ ID NO: 250845 - DNA, 618 bp, Homo sapiens
  misc_feature: GYAE6OF02IZXSP.44.65.F10.1.454.CMB.1.raw
  modified_base (195)..(195): a, c, t, g, unknown or other
  misc_feature (195)..(195): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaanagccaccctctcctgcagggccagtcagagtgttagcagcaacttagcctcgtaccagcagaaatctggccaggctccccaggctcctcatctagtggtcgcatccacgagggcccacgtggtacctcccgagcctaggttcaggtgcagtgggtctagggacagtagtcacgtctaccgaacctctacgagccgacgcctgctacggtcgtacgaagttattttacggcttaaggtttattacgttgtaccagtactagtaactaagtcggtacgtcgggtcccttacccggttcggaacccgtaagggaacctaccgtaacggttacggtaacgtaaacggtttaaaccgaacggttacggttagggacccgtttacgacctaacccgtagtttcccgtagtttaccccttagttaccccg

SEQ ID NO: 250846 - DNA, 762 bp, Homo sapiens
  misc_feature: GYAE6OF02GDYLJ.44.65.F10.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatgtgatgacgcagtctccagcccaccctgtctctgtctccgaaggggaanacgcccaccctctcctgcgaggccagtcagagtgttggcagcagcgtagcctggtccagcagaacctcggccagacctccgaggccttcccgtntactcttaacgtaccactaacgttccccacgacgggccctacgttcggtacctccccgagaccaagtactttaccggaggttccgaccgtaggtcggggttaccgtacgggggtaacctagggtaccgtttaccgtaaacccttccccggtaactaaccccctaagttacccgacggtaacccgtccgtaccccggttgtaacccggtaacggtttcgtaaacggggttaaacgtttacgttttacggtaaccgtttaacgggttttttaacttttaccggtaggttaaccgtacgggtttacctaaggttttaacgaacgggtttcgtaaccggtttccggttacccttttacccgttccgtttaacccggttccggggtaccccttccggacccttacgtaccggtttacctaacgtttaaccgaaccgttaacgtcggtcgacgttcgacctaccggtattcgttccg

SEQ ID NO: 250847 - DNA, 633 bp, Homo sapiens
  misc_feature: GYAE6OF02H2291.44.65.F10.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
  modified_base (331)..(331): a, c, t, g, unknown or other
  misc_feature (331)..(331): n is a, c, g, or t
tcagacagtatatacacgaccggtgctcgatttagctacgctctaagggggaggaacgtgctcagttaggacccagacggaaccatggaagccccagcgcagcttctcttcctcctgctactctggctcccagataccactggagaaataggtgatgacgcggtctccagccaccctgtctgtgtctcgaggggaaangcccaccctctcctgcagggccagtcgagagtgttagctagcaacttagcctcgtaccagcaagaactcgcggccaggcctccgaggcctcctnattctagtggcgccatcccgacgagggcctagtggtacncccagcccaggttcaggtcggactaggtcgggtctggggacaggtacgttcacgtcaccgaccagtccgagcacggccgtacgaccgtacggttacctaggaacgttgttttacgactttaagttttacgttacgttcgttacgaacgtcgaaaggtttacttaaacgttaaccgtcggtacccttaccgtacgttaccgggtttccgggggacggggttaactaaggggtggaacgtacgtaacgaaacggtacgtggtacgacgtcgtaccgtacgtcttccgtcgttccttagtacccg

SEQ ID NO: 250848 - DNA, 797 bp, Homo sapiens
  misc_feature: GYAE6OF02GTQ23.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccactggagaaagtagtgatgacgcggtctccacgccacctgtctgtcgtctccgaaggggaaacgcgcccaccctctcctcgacgacgggccagtcagagtgttagacagctaacttacgcctacgtaccagtacaagaaactcgtaggaccgaggtcctacccgaggtcctcctacattaccgttagtcggtcgcctacctacccgaccgacgggcctaacgtcggtaacctcccgacggtacctacggttacgacggtcggtacgtagggtcgggtacgtagggacgtaacggtacgttacctaacctcgtaccaacccgtagtacgaaccggtcgtaaaccggtccgtacggtaccgtaacggttacggtaagggtaaacgtttaacgttttcggaacgtttttaaagttttaacgtttcggttaacgttccgtaaagggttaacctaaggtttaaaccttaaacggtaccggtttaccccgggttacccggggttaacccccctttcccggttaaaccgggaaacccggtaaacggtaaaccgtaaccgttaacggtacgggtaaacttaaaccggtttaaaccgggaacgtttggaacccggttaccgacgtaaccgtaccgtaaccgttcgttaacccgtttctacccttaaccg

SEQ ID NO: 250849 - DNA, 681 bp, Homo sapiens
  misc_feature: GYAE6OF02H3T1D.44.65.F10.1.454.CMB.1.raw
  modified_base (375)..(375): a, c, t, g, unknown or other
  misc_feature (375)..(375): n is a, c, g, or t
  modified_base (403)..(403): a, c, t, g, unknown or other
  misc_feature (403)..(403): n is a, c, g, or t
  modified_base (449)..(449): a, c, t, g, unknown or other
  misc_feature (449)..(449): n is a, c, g, or t
  modified_base (465)..(465): a, c, t, g, unknown or other
  misc_feature (465)..(465): n is a, c, g, or t
tcagacagtatatacacgaccggtgctcgatttagctacgctctaagggggaggaactgctcagttaggacccagacggaaccatggaagcccagcgcagcttctcttcctcctgctactctggctccagataccacgtggagaaatagtagatagacgcggtctccagccctacctgtctgtgtcctccgaaggggaaagcgcccacccgtctcctggacgacgggccagtcaggtagtgttacggcatacgtaacgttacgctaccgtaaccagctaagaatcctggaccgaggactccgaggtcctcctacgactctagtcggacgcacgttacccacgacggcccagtcggactcccgagtccgtaggtcncggtacgtcgaggtcgggtcagggaacngtacgttcaccttcgacactagtcgacgacgacgtcgcgctacgtntacggtagttattcgngttaacgtttacgtttacgtcgttaccggtaagtaccgtaaatttacgtaagtacgttaccgaccggttcccgttacccgttacggaacccgtaaggtaaccgaccgttacgttacggaacggttttaacgaaaaccggtaccggttacgtaccgggttaccggtaacgtccccgtaattcccgttaacggtttctttaccccgttagtaacccgg

SEQ ID NO: 250850 - DNA, 927 bp, Homo sapiens
  misc_feature: GYAE6OF02FPFUX.44.65.F10.1.454.CMB.1.raw
  modified_base (314)..(314): a, c, t, g, unknown or other
  misc_feature (314)..(314): n is a, c, g, or t
tcagacagtatatacacgaccggtgctcgatttagctacgctctaaggggggagggaactgctcagttaggacccagacggaacatggaagcccagcgcagcttctcttcctcctgctactctggctcccagataccactggagaaatagtgatgacgcagtctcccagccaccctgtctgtgtctccgagggggaaagacgccaccctctcctggcagggcctagcaggacgtggttaccagcaacttacgcctggtacccacgtacgaaaaccgcggggaacgacgggtcctcccgacgggtccctccctanctacgtatggaactatccaacccgacggggaccacgtacgggtactcccccaaccggaggtttcccgtaagggttcggacggtacgggtacgggggtaccgggtaacgtacggggtagttacccggacgtttacccgtacgtaacccgtactaacccaaaccgttaccggaccctaacgggtaacggtaccccgtaagggtaaccgtacgtttttacgggtaccgttaagggtttttaaccttaccgtttaaggttaccccgtttaaacccgttaaacccgggtttaacgggttaaaccggttaccgggttaaccccgtttaacccgaaacgttttaaccggtttaaaccctttaacccggtttttacccgggaaccccgggtttccgggtaaaaaaccccgggttaaaccggttaaacgggggttaactttaaacccgttaaaccccgggtaaaaaccgttacccggggttaaacggttacggggaacccgtttaccgggtaaacccgtttaacccgttaaccggtaaccgtttaccccggtaaccgttttaccctaacccgggttttccctttaacccccgaacccggttttaattccccggtttaaaccg

SEQ ID NO: 250851 - DNA, 644 bp, Homo sapiens
  misc_feature: GYAE6OF02ILPWA.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcacgggcagtcaggagtgttagcagctaacttagcctacgtaccagcagaaatctggccaggcctcccgaggcctcctcactctagtggtcgctactccaccgagggccaacgtggtactccgacgtccaggttcaggtcggcgagtgggtgtggactagacgttcactactacacctatacacgtcacggtcctcgacgtactcgtagaacgtcgttttagcgttaagtttatacggttagtacgtacgtagaccgtagtcccggttaagaccgtacgtaccgggtctaaccgtacgttaccccgtacgggacccgtaaacggggttaccaaccggtaccggtaagggtaaaccggttaacgttaaaacccggttactaaccgggttcggtaaccgttaccggaaccaaccgttacccttaggtttaccccg

SEQ ID NO: 250852 - DNA, 734 bp, Homo sapiens
  misc_feature: GYAE6OF02JHCR6.44.65.F10.1.454.CMB.1.raw
  modified_base (192)..(192): a, c, t, g, unknown or other
  misc_feature (192)..(192): n is a, c, g, or t
  modified_base (208)..(208): a, c, t, g, unknown or other
  misc_feature (208)..(208): n is a, c, g, or t
  modified_base (539)..(539): a, c, t, g, unknown or other
  misc_feature (539)..(539): n is a, c, g, or t
  modified_base (546)..(546): a, c, t, g, unknown or other
  misc_feature (546)..(546): n is a, c, g, or t
  modified_base (556)..(556): a, c, t, g, unknown or other
  misc_feature (556)..(556): n is a, c, g, or t
  modified_base (721)..(721): a, c, t, g, unknown or other
  misc_feature (721)..(721): n is a, c, g, or t
  modified_base (728)..(728): a, c, t, g, unknown or other
  misc_feature (728)..(728): n is a, c, g, or t
tcagacagtatatacacgaccggtgctcgatttagctacgctctaaggggaggactgctcagttaggacccagacggaaccatggaagcccagcgcagcttctcttcctctgctactctggctaccagactaccactggagaaatgtgatgacgcagtctccagccacctgtctgtgtcctccgagggaaancgtccacctctctgcncgggccagtcagtacgtcgttaaccagtacctaacgttaggcctacgggtaacccaaccgtaaggtaaaaccccgtgggggccctaaacgggtccccgttaccccgaggggaccctttacccgtaccgtaaactttcgtaacgttacgggaaacctaaccacccgtaaaccggaaccggggtacccctaaagttccgggttaacctccccctaaacccggttggtttaacgcgggttacgggtccgtacgggtaaccgggggtcccggtaacgaaacggttcgttacgaccgttcgaccgaccgtagtccaacggggcgtccgtagaccgnggttacncgtaaggttnttacggatttacgggttaactttcgagtcgatacgtagttaactaatacgtcgtacttctaggccgtttacggggacggtaaccggtaggtacgagtacgtaacgtaaacgccgttagtacgtccgacgcctagacgtacttcgtactccgtactccgttacccngttaccnttaacg

SEQ ID NO: 250853 - DNA, 873 bp, Homo sapiens
  misc_feature: GYAE6OF02GU77L.44.65.F10.1.454.CMB.1.raw
  modified_base (196)..(196): a, c, t, g, unknown or other
  misc_feature (196)..(196): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangccaccctctcctgcagggccagtcagagtgttaccagcaacgttgcctggtaccacagaaacctgggcaggctcccgaggcctccctcatctatcggaacactccaaccgagggcccacgtcggtactccccgaccctagggttaccgacggttcggcgtacgggttcggggtacccggggtaactacgggtacggtttcccaaccgtttcttacccgaacctacgttccgaacgggtccccgggtccccttagggaccgtaacggtttccgtacggggtaaacggggtttacttttcccgtacgggttacgttaaacgggttttttaacttaaccggttcggttacctaacgggttaccgttaaggttttaaccggttagggggttttccggtacccgtttacccggtttaccgttcgggggttaaccccgggttttaccccggggaaaccggggttaaaccggggaccccgggttaaaacggggttaacgggtaaaaaaccgttaccccgggtaaaaaaccgtaaccggtttacggggttaacccgttaacccggttccgggaaaccctttaacccggtaaacgttttcccggttaacggttttaccccttaccgggttaaacccgttttaccccccgttttaccccccggtaaccctttacgttttaacccgg

SEQ ID NO: 250854 - DNA, 642 bp, Homo sapiens
  misc_feature: GYAE6OF02HABH4.44.65.F10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatgtgatgacgcggtctccagccaccctgtctgtgtctccgaggggaaancgcccacctntgctgcagggccagtcagagtgtagcagctaacttagcctcgtaccagcaagaatctggccaggcctccaggtcctcctnatctatgatcgcactccaacgnggtcacgtcggaccaacccgagacgtaggttacaggttcggcgtagggtcgggtcgagggaacagtaaccgtttcaaccttccgaccgtaccgtcacgctaagtcgtaacgacgtccgtaagtaagttattttcggacgtttagttttacttaccgttgtacctagtacgtacgttcccgtttcctaccggtacggtcccgtcttacggttcccggtttcggggggaccggggtaaccgtaggggtacgacgtacggttacggaacggttaacggacgttcgggtcggacgttaccggaccttaccgtacggttcccttacggttcctttaccg

SEQ ID NO: 250855 - DNA, 784 bp, Homo sapiens
  misc_feature: GYAE6OF02HA9Z4.44.65.F10.1.454.CMB.1.raw
  modified_base (196)..(196): a, c, t, g, unknown or other
  misc_feature (196)..(196): n is a, c, g, or t
  modified_base (232)..(232): a, c, t, g, unknown or other
  misc_feature (232)..(232): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctccgaggggaaanacgcccaccctctcctggccagggccagtcagagtnttagcagacaacttacgcctcgtaccagcaagaaatcgtcggccaggcctcccgaggccttcctcatcctagtcggtgcctatacccgaccgacgggtcccacgtggtaacctcccgacggaccgtaggttacaggtcggacgtagggtcggggtaccgtaggggactacggtacgtttaccaccgttacccgtaaccgaacccgtacgttaccgaggtaccctaacggtcccctacgggtacccgtacggttaccggttaaggttaaagttcgtttttaccggacgtttaacggtttttttaacttacccggtttcgttaaccggtaagttaccgtaaaggtttaactttaaggtaccggttaaaccggtttcccgggtaccccttttacccgggtttaacccgggaccggtaaaaccggggtaaccgtaaccgaaccgggttaggtaaacggttaaacgtttaaaacccggaccgtttaggggtaaccgtccgggttacgacccgttaacggttaccttaccgggtttacgttacccttaccgttacccg

SEQ ID NO: 250856 - DNA, 689 bp, Homo sapiens
  misc_feature: GYAE6OF02ISA7E.44.65.F10.1.454.CMB.1.raw
  modified_base (409)..(409): a, c, t, g, unknown or other
  misc_feature (409)..(409): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaagcgccaccctctcctgcgagggccagtcagtagtgttaccagcctaacttgcctcggtaccaccacgaaccgtgggcaggcctacccgaggtcctcctcacttctagtacggaactacctcccgaaccgacggggccctaacggttcggtacctacccccgacccgtagggtttccaagggtcggtaccgtacgggttcggggtacccgggaanacggtaacgttccaccgttcctaccacctagtccgacggcccggtcctggacctaggttcgtaggtaggtttatttcggactttagttttactacgtgtacacggtactaagttaatacgtgtaccgtcggtccctccgtcggaccgtaacgggactacgggacgtagggtaacttaaacgttaaacggacgttcggtacggtcctacggacccgaccttaacggttcttaccgttcctttacgtaccgtttcccttcccggacttacgttctagttaac

SEQ ID NO: 250857 - DNA, 684 bp, Homo sapiens
  misc_feature: GYAE6OF02G3469.44.65.F10.1.454.CMB.1.raw
  modified_base (198)..(198): a, c, t, g, unknown or other
  misc_feature (198)..(198): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagcccaccctgtctctgtctccgaggggaaancgcccaccctctcctgcaggccagtcagagttggtggcagcagcgtagccgtggtccagccaagaaccctggaccaacgacctccccgaggccttccctacacttacctactacccacactacccaccgacgggccacgtcgtacctcccgagcccgtaagtacttcgaggtcggacctacggtcggggtcctaggggacctaggtacgttccacttccgtacgacctataccgagcccgacgtccgtcgacgtacggtacgtacggtaagtttacgtttcgtaccgtttaacgttttaacttaccgttgtaccgtagtaccgttaagttacgttaaggttcgtaccggttcggttcccctttaccgtttcgttacccgtttcccggtaccggttaccgggtaccctacggttaccggtaacgtttaacgttaaccgaaaccggttacgtggtacggtcgtaccgacctaccgttcttacgttccg

SEQ ID NO: 250858 - DNA, 528 bp, Homo sapiens
  misc_feature: GYAE6OF02HCVNF.44.65.F10.1.454.CMB.1.raw
  modified_base (196)..(196): a, c, t, g, unknown or other
  misc_feature (196)..(196): n is a, c, g, or t
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
  modified_base (374)..(374): a, c, t, g, unknown or other
  misc_feature (374)..(374): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaccagcaacttgcctggtaccaccagaaacctgggcaggctcccaggctcctcatctatggaacatccacagggcccatggtancccacccaggttcagtggcagtgggtccggacngagttcactctcaccatcagcggctgcngtctgagattttgctagtttattactgtcagctagtataatactggcctctctacgtttcgggccgggggtacctaagggtggacgtagtaccgaaacgaccgtgtcggctggcacctctacttcgtcttcacttcctcccggtctactctacg

SEQ ID NO: 250859 - DNA, 720 bp, Homo sapiens
  misc_feature: GYAE6OF02HR94L.44.65.F10.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (311)..(311): a, c, t, g, unknown or other
  misc_feature (311)..(311): n is a, c, g, or t
tcagacagtatatacacgaccggtgctcgatttagctacgctctaaggggggaggaactgctcagttaggacccagacggaaccatggaagccccagcgcagcttctcttcctcctgctactctggctccagataccacgtggaagaaattagtgatggacgcagtctccagccacctgtctgtcgtctcgaaggggaanacgcccacccgtntcctgcgacgggcctaagtcagagttacgttaaccagactaaacttcgacctacggtaaccacaagaacctgggaccagcctacccaggtcctacctnatctaagtcggaaactacgtcccgaaccgagggtacctaacgtcggtaacctccccgaacccggttagggttacaggtggacgtaggggttcggggtacccggtactaaggtacgttaccacgtcctaccaacgtctacgaccgcggcctgactacgtcgtacgtagggttactttcgtacgttagtttatacgtagtacgtacgtacgttaagttaaagtaactaaccgcggttaccttacgttaccgttaacggggtttaccgggacgggggtaaaccaagggtcgaaacggttaacgtaaacgtaaacggtaacgttgggtacgttacgtaccggaactaacccgttagtaccgttccgttaacgttcctaaccgtttccccgtaccgtacccgtattcccggtaa

SEQ ID NO: 250860 - DNA, 833 bp, Homo sapiens
  misc_feature: GYAE6OF02F9TOO.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagatacccaccggcgaaattgtgttgacacaatctccagcccaccctgtctttgtcgtccgggggaacacgcccacccttctcttgcgacgggccgccagactgtgacgtacgacttacgccgtggtaccaacagaacgccgtaggccacggtcctaccccgaagtaccttcccgtactaacgttacctaacgtcggaaacctactacccgaaccgtaacggggaccctaacggtcggtaaccctaccccgaacccgtaggtttaccgtaagggtcggacgtaggggttccgggggtacccgggaactacgggtaccgttaccgaccttacctaccgaaccgtaacgttcgaaccgggtccggtaccctaggtacctaacggttcgtagggtaacggttttacgttttacggaaccctttaaagttttaaccgtttaccggtacctaacccgttaaaaacgtaacggttaaacggttaaacggtacgtttttaacgttaccgttacgttaagggttttaaccgggtttacccgggaacggttaacgggggtaaaccctacggtacgggttacgtaaacggtacttaaaccggaaaacggtccgttaaggtcgggtacctacgtaccgtaaccgtagttccgtttcgttacccttacggtacccttcccgtcccgtacttaccgttgacgttactaattaccgg

SEQ ID NO: 250861 - DNA, 673 bp, Homo sapiens
  misc_feature: GYAE6OF02FUGYW.44.65.F10.1.454.CMB.1.raw
  modified_base (200)..(200): a, c, t, g, unknown or other
  misc_feature (200)..(200): n is a, c, g, or t
  modified_base (409)..(409): a, c, t, g, unknown or other
  misc_feature (409)..(409): n is a, c, g, or t
  modified_base (440)..(440): a, c, t, g, unknown or other
  misc_feature (440)..(440): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaancgacccaccctctcctgcgagggccagtcagagtcgtaccagcaacttgcctggtacccacaagaaacctgggctaggcctacccgaggcctcctcatctagtggaacactcccgaccgacgggccacgtggtacctaccccgaccgtaggttcgaggtcggtacgagggtcggggtaccggactaggtacgttcacgtctccaacctntcgacggcgtccgtgcgagtcgtaggagttntttcgatttatttacgtcgtgtacgtagtacgtaatattaaacgttccgtagttcccttactacggttaccggttaccgggggaccgggggtaactaagggggtcgaaagtacgtaaaccggaacgttaacggttggtacgtcgtaccgtaccgtaaccgttacggttaccgtttcggttaccctttacgtaccgtttcccgttacccccggtattacccggtttactaacgg

SEQ ID NO: 250862 - DNA, 637 bp, Homo sapiens
  misc_feature: GYAE6OF02FWYM0.44.65.F10.1.454.CMB.1.raw
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (393)..(393): a, c, t, g, unknown or other
  misc_feature (393)..(393): n is a, c, g, or t
  modified_base (432)..(432): a, c, t, g, unknown or other
  misc_feature (432)..(432): n is a, c, g, or t
tcagacagtatatacacgaccggtgctcgatttagctacgctctaagggggaggaactgctcagttaggacccagacggaaccatggaagccccagcgcagcttctcttcctcctgctactctggcctcccagataccactggagaaatagtgatgacgcgtctccagccaccctgtctgtgtctccgaaggggaanagcccaccctctcctgcgagggccagtcagtagtgttagcagacaacttacgcctcgtaaccagcaaagaactcgnggccaaggcctccgaggtcctctatactctagtggtncactcccacgnggccacgtgtacnccagtccgtagtcagtgcgtaggtggtctagggactagtacttcacgtctaccaactanacgacgtacacgcctagtacgtagtctagtaaacgtttntttaggaccgttttaagtttacttacgttcgtaacgagtactaaagttaaattacgtacgtaccgttacgtcccctttacccggtacggaaccgaaacgggtaacctacgggtaaccgtagggtaactaaacggttaaacgaacggttacggtaggtacccgtacgtaccaacgttacgttcgttacgttccgttaccgtacccg

SEQ ID NO: 250863 - DNA, 683 bp, Homo sapiens
  misc_feature: GYAE6OF02IE5V3.44.65.F10.1.454.CMB.1.raw
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
  modified_base (366)..(366): a, c, t, g, unknown or other
  misc_feature (366)..(366): n is a, c, g, or t
  modified_base (464)..(464): a, c, t, g, unknown or other
  misc_feature (464)..(464): n is a, c, g, or t
tcagacagtatatacacgaccggtgctcgatttagctacgctctaagggggaggaactgctcagttaggacccagacggaaccatggaagccccagcgcagcttctcttcctcctgctactctggcctcccagataccactggagaaatagtgatgacgcggtctccagcccaccctgtctgtcgtctccgaaggggaaacgngccctaccctctcctcggcgacgggcctagtacaggtagttggttacncagactaacttagcctaccgtaccagacctaagaactcgcggccacggcctcccgaggcctcctcattccgtagttcggcacctactacccgaccgacggcctacgtcggtaccncccgaagccgtaaggttccgagtcggtactagggtggtcggtaggacgtaggtacgttcgaacttccgtaccaccgtagtcgaacgtaccgacgtccncggacgtacgttcgtagtaaggttactttcgactttagttttactaccttagtacgtacgtatagttaatagtacgtacgttccgtacccttcccgttacgggaccggaacggaactaccggttagacgggttaacgtaacggtaaaccgttacggtcgttacgtccggttacgacccgtaaccgttagttccgtttacgttacccgtacctttacccg

SEQ ID NO: 250864 - DNA, 687 bp, Homo sapiens
  misc_feature: GYAE6OF02FGRO3.44.65.F10.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (298)..(298): a, c, t, g, unknown or other
  misc_feature (298)..(298): n is a, c, g, or t
tcagacagtatatacacgaccggtgctcgatttagctacgctctaagggggctctggggaggaactgctcagttaggacccagacggaaccatggaagccccagctcagcttctcttcctcctgctactctggctcccagattccgaccggcgaaattgtgttgacacagtctccaggcaccctgtctttgctccgagggganagacgccaccctntcctggacgggccagtcggagttcgttactaagtcctagcctggtaaccaacagtaaacctggccaggctcccaggcttccnatctatgatgactagtccaacgtagggtccacgtcggaccaaccccgagactagggttaccaggtgctaggtcggtactggggacagtacttcacgttcacctaccgtacacgctaagtcgtaacgacgtaccgtagtaacgtagttttcgacttaagtttacttacgtagtctaggtacgtagtccgttaccgacgcggtccgtccttcgtaccggtttcgggggacccgggggtaactaagggtacgggacgtaacgtcggtaacgtacggttacgtaacggttcggttaacgggtacgtttacggaccccgtttaacccgaccggtttccggttacggtttaccctttaacggttaccccgtttacccctttaccccggtaacccg

SEQ ID NO: 250865 - DNA, 710 bp, Homo sapiens
  misc_feature: GYAE6OF02HF9YN.44.65.F10.1.454.CMB.1.raw
  modified_base (204)..(204): a, c, t, g, unknown or other
  misc_feature (204)..(204): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagacaccacttggacgaaatacggtgatcgaccgcagtcctccagccaccctgtctttgccgtaccggggaacncgccacctctcttgccaggccgccagactgttcgacgacgacttacgcctggtaccaacgagaacgtcctggcccaaggcctccccgagacctccctacgatcctatgactacgtttctaaggtacgggcccttcgtcggcctaacttccccgagtcccccgtatttccgaggttcgggaccagggttcggggtacccttagggggaccaacgggtacctttccgtaaccgttccttaccgaacccctattacccaacccgtacggtacccttaagggaccgtcccgttaggtaaacgtacgtttttcggacctttaaggttttacttacttcgtactacgtaaccggtaaagtaacggttcggaccttaccgaatttacttcgtaccgttttacccggccgtacgggtacctaaaggttcgaacttacgaactaaaccgtcgtagtcggtactggcctaactacgtcgttacgtctttacaccttacccttcccgacgtactcgg

SEQ ID NO: 250866 - DNA, 622 bp, Homo sapiens
  misc_feature: GYAE6OF02J1912.44.65.F10.1.454.CMB.1.raw
  modified_base (194)..(194): a, c, t, g, unknown or other
  misc_feature (194)..(194): n is a, c, g, or t
  modified_base (339)..(339): a, c, t, g, unknown or other
  misc_feature (339)..(339): n is a, c, g, or t
  modified_base (560)..(560): a, c, t, g, unknown or other
  misc_feature (560)..(560): n is a, c, g, or t
tcagacagtatatacacgaccggtgctcgatttagctacgctctaaggggaggaactgctcagttaggacccagacggaaccatggaagccccagcgcagcttctctcctctgctactctgcctcccagataccactggagaaatgtgatgacgcagtctcagccacctgtcctgtcgtctccgaggggaaacngcccacctctctcgccagggccagtcagcgtgtaccagcaacttaggcctggtaccaccagtaaacctggggactacggctccccaggtcctcctacatcgtatacgggaacactcccaaccgtgggccccaacgtcggttaccnccccaccgagggtttacccaggttcggaccaaggtccgggggtacccggaatacggtaacgtttccaccgttgtacccaccagtccaacggccggtcctggacccttagtcgacgacggtattttcgacttagttatactggttcaggtctaagtacttaacgacgttgcctagtcgtactacggggcgggtaccgaggtggactgtaacgaagttaccgngtacggctacggtcacctatccggtattcccgttacacgttccttcccggctaccttgtacg

SEQ ID NO: 250867 - DNA, 755 bp, Homo sapiens
  misc_feature: GYAE6OF02FUBRL.44.65.F10.1.454.CMB.1.raw
tcagacagtatatacacgaccggtgctcgatttagctacgctctaagggggaggaactgctcagttaggacccagacggaaccatggaagccccagcgcagcttctcttcctcctgctactctggctcccagataccacggggaaattgtgttgacacaatctccagccaccctgtctttgtctccgggggaacagccaccctctcttgcagggccggccagactgttgacgacgacttagcctggtaccaacagaagccgtggccaggcctcccagactccgtcactcatgattacttctaggtacgggtcctcgtggacctactcccagccccgtcttacgaggtcggcaggttcggggtcctgggggaacctagtaccgtttacacgttcctaccaaccctactccaacccgagtaccctaaggacgtcccgttaaggtaacgttacgtttttacgaccgttaagtttttactttaacctttcggttaaccttaaccgtaaacccggttaaaggtaacgggttacggttacccgtaaccttaacgttactttaccgtaccgttttacccgggacccggttaccgggtaaccgtaaacggttagggtaacttacgttaaccgaaaaccgttacgttacggtacggtaccgttacgaccctaaccgtactttaccggtacgtttaccctttaccgtaaccgtttaccccttcccggttaaccctaccgtttaccggttacggttaatttaaccg

SEQ ID NO: 250868 - DNA, 742 bp, Homo sapiens
  misc_feature: GYAE6OF02JPEJS.44.65.F10.1.454.CMB.1.raw
  modified_base (150)..(150): a, c, t, g, unknown or other
  misc_feature (150)..(150): n is a, c, g, or t
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (248)..(248): a, c, t, g, unknown or other
  misc_feature (248)..(248): n is a, c, g, or t
tcagacagtatatacacgaccggtgctcgatttagctacgctctaagggggagggaactgcgtcagttaggacccagacggaaccatggaagcccagctcagcttctcttcctcctgctactctggctccagattccacggcgaaattgngttgacacatctccagccacctgtctttgctcggggaacngccncctntctgcagggccgcagactgtacgacgactacgttacgcctgtaaccaacngaacgcctaggccacggctacccgagtacctccgtacacttactacgtcgaacttcctttacgtaacgggttacgggccttacggttcggacctaacgtccctacggtcccctcgtttacgacggtcgggacctagggttacggggtcttacgggggaacctacggtaccgtttcacggttcctaccgaacctacgttaccaacccgtacgaccccgttaaggacgacccgttaagtaacggttaacgtttttcggaaccgttttaacgttttaacgtttaccgttacgttaaccgttaaccgtaaaccggtacggttaacggttacggttacccttacgtaactttacgttacgtaccgtttccggaccgttacgggaaccgtaagtcggtaacgtacgttaaccgtaaacggtaccgtgtaccggtacgtccgtacaccggtattcggtaccttacttacgtaccgtccttacccgctacttcgacgttaac

SEQ ID NO: 250869 - DNA, 807 bp, Homo sapiens
  misc_feature: GYAE6OF02HPG8T.44.65.F10.1.454.CMB.1.raw
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (590)..(590): a, c, t, g, unknown or other
  misc_feature (590)..(590): n is a, c, g, or t
  modified_base (796)..(796): a, c, t, g, unknown or other
  misc_feature (796)..(796): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtcctccgaaggggaanacgccaaccccgtntcccgtagccgacgggccaagtccaggacgtacgttaaccagaccaaactttcggacctgggtaaccaccgaagaaacctgggactaacggtcctacccgaggtcctccgtactactacgtactacggaaccacgttacccgaaccggagggtaccctaaccggttacgggtaaccctccccgtaaccccgtagggtttaccacgggttcggtacgtacgggttcggggtacccgggaacacggtaacgttcctaaccttcccgtacaacgtactccgaacgggtccgtcccgtgtaccgtagtccgtaggtaggtttacgttttcggactttaacgttttacgtaccgttcgtacgtacgtaacgttaagtttaaanaacgtttaaccgtcgacccgtttacccgttagggttcccgggttaaccgggggaccggtaacgggttaaggtaaccgttaacgtaaccggtaaaccgttaaacgtccggttacgggtacgttccggaaccggtaaccgtaacgttccggttacgtttaccgttaccgtacgttacccggtttaccccgacccggtactttaccggnttttaaaccgg

SEQ ID NO: 250870 - DNA, 814 bp, Homo sapiens
  misc_feature: GYAE6OF02HUSTQ.44.65.F10.1.454.CMB.1.raw
  modified_base (193)..(193): a, c, t, g, unknown or other
  misc_feature (193)..(193): n is a, c, g, or t
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
tcagacagtatatacacgaccggtgctcgatttagctacgctctaagggggagaactgctcagttaggacccagacggaaccatggaagccccagcgcagcttctctcctcctgctactctggctccagtataccacgtggagaaatgtgatgacgcgtctccgagccacctgtctgtcgtctcgaagggaancgccacctctctgactagggccagtcagtagtgtancagctaagttgcctcgtacngcagaatcgngacagctccagctcgtcatcgagtcgtgctactccgacgtcggctaacgtggtaccaccgagtccgtaaggttcacggtcggtacgtaggttcggtcgacgggtaactagtacggttaccacgtcgacctacctagtccgtaacggactaccggacgttcgacgtaaacgttcgtaaacggtaacgtttaccggtttagtacgtttaaacggttttacgttaaccgtacggtttacgaacgggttaacttaaaacggtttagtttaaaaccggtaccgggtttacccggttaccccggggttaccccgtttaacccccgggttaagggtaaaccccccggttaaaagggggtaaacccctttaaccgggggtaacccgggttaaccgggtttaaaaacccgggtttttaaccgtaaaaacccggggtttaaccgggttccgggtaaccgggttttaacccccggaaaggtttaccccccggtaaccccggttttaacggtttaacccggggtttacccttttttacccccgggtaaaacccttttaccccccggg

SEQ ID NO: 250871 - DNA, 737 bp, Homo sapiens
  misc_feature: GYAE6OF02HKY43.44.65.F10.1.454.CMB.1.raw
  modified_base (201)..(201): a, c, t, g, unknown or other
  misc_feature (201)..(201): n is a, c, g, or t
  modified_base (331)..(331): a, c, t, g, unknown or other
  misc_feature (331)..(331): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcggtctccagccaccctgtctgtacgtctccgaaggggaaanacgcccacccctctacctgacgagggccagtcgagagttgtagcagctaacttacgcctccgtaccagaccaagaaatccgtaggaccaggcctacccgaggtcctccgtccaattctaagttgggtacnctaacctacccgaaccgacgggtaccctacgtacggtaccgtacccgacgtaccgtacggttaccgaggtcgacgtacggtcggggtacggtaggacgtaggtacgttacaactttccgaccaccgtactcgaccgactaccgcgtcggctacgtccggtagtaacgttagtttacgacgtttagtttaactttacgtagttactagtactaagttaacttaacgtacgtaccgtaccggttccccttacccggttaccggtaaccgggtaaacggtaccgtaaccgggtaccgtagggtaaaccggttaacgttaaaaaccggttacggttacgttaccgggtaccgttacggaaccccgtaccgttacggtttacggttaccgttaccgttacctttaccccgg

SEQ ID NO: 250872 - DNA, 657 bp, Homo sapiens
  misc_feature: GYAE6OF02IYZKT.44.65.F10.1.454.CMB.1.raw
  modified_base (215)..(215): a, c, t, g, unknown or other
  misc_feature (215)..(215): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
  modified_base (652)..(652): a, c, t, g, unknown or other
  misc_feature (652)..(652): n is a, c, g, or t
tcagacagtatatacacgaccggtgctcgatttagctacgctctaagggggaggaactgctcagttaggacccagacggaaccatggaagccccagctcagcttctcttcctcctgctactctggctcccagattccaccggcgaaattgtgttgacacaatctccagcccaccctgtctttgtcgtaccgggggaacgagccacctctcttgcngggccgccagactgtgacgacgacttacgcctacggtaccaacagacgtccgtggaccaggcctacccagacctccncatctatntatactacgtagtacgggcctcgtggactctcccacgcccggtctcgtaggtggacngggttcgggtcgtgggacgtagtacctttcaccttcgtaccacctactaccaccacgtacctacgacgtcgtagtaacgttatttcggacttaaggttttacttacgttagtacctaacgtaccgtaaaggtacggttcggtaccctaccgtaagtctttccgtaactttcccgggcgtaaccgggtacgtaaaggttcgtaatacgtaacgaaacgtaacgcggttacgtctacgccgtaactacttcgtacgtttccttaacaccgttcccttacccgacctacgttaccgtntaacc

SEQ ID NO: 250873 - DNA, 656 bp, Homo sapiens
  misc_feature: GYAE6OF02HGBZ7.44.65.F10.1.454.CMB.1.raw
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (411)..(411): a, c, t, g, unknown or other
  misc_feature (411)..(411): n is a, c, g, or t
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaacagcccaccctctcctgcgagggccagtcagacgtgttagcagccaacttacgcctacgtaccagcaagaactcgcggacacggcctcccgaggtccncctcactctagtcggtncgactccgaaccgcgggccaccgtggtacctccgacgccgtagttcaggtggcctaggggtcggtcgtaggaccgtagtcgtacacttccacgaacctntaccgacgccacggtccgtagacgtacgtcgtaacggtacgtttactttacgagtttaacgttttacttacggttactacgtaacggtactaaggttactaacggttcgtaaccgtacggtacccgtccgttacggaacccgtaacgggacgttacggtacggttaggtaacggtaaccgtaaacgttacggtacgttacgggaccgtcggtacccgtaccttacgtaccgttccgtaattcccg

SEQ ID NO: 250874 - DNA, 764 bp, Homo sapiens
  misc_feature: GYAE6OF02H4RAJ.44.65.F10.1.454.CMB.1.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
tcagacagtatatacacgaccggtgctcgatttagctacgctctaaaggggggaggaactgctcagttaggacccagacggaaccatggaagccccagcgcagcttctcttcctcctgctactctggcctccagataccactggagaaatgtgatgacgcggtctccagcccacctgtctgtcgtcctccgaggggaaagcgcccaccctctcctgcgaggccagtcagngtagttgcagcaacttgcctcgtacagcaagaatccgtggccaggcctcccgaggcctcgtcacgttcagttggtcncgtataccgacgcgacgggtccctcgtcggtaccacgtcccccgggtaacgttacggttccgtacgggtacggtacggttagggttccggggttaccggtacggggaaaccgtaggttaacgtttccgtaccgttaccggttaaccacccgtactttaccggagtcccgtagccccggttcggacgttaacggtcgttaacgtaaggtttacgttttcggtaaactttacggtttttaacttaccgttacggttacgtacggtaacctttaagggtaatttaaccgttagtacccgttaccggttaccccgttccccggttaacccgggtaaccggtaaaccgggtccctaaccgggtacggtaacgtaacggttaaaccgttaaaaccggtcgttaacggtacggtccgtaccggtccgtaaccttaccgtttcgtttaccgttaccgtttacccg

SEQ ID NO: 250875 - DNA, 682 bp, Homo sapiens
  misc_feature: GYAE6OF02GBVWD.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagngccaccctctcctgcagggccagtcagagtgttagcagcaacttagcctcgtaccagcagaatctggccaggctccaggctcctcatctataccacactccaccgagggccacgttcggtatccccgagtcccaagtactttcaaggtcggacctacggttggggtaccttagggggacctaagggtacgttcctaacttccgtacctaccctacttccgaacggacctacggccccttagacctaggttacctaggtaaagttagtttttacgacgtttaacgttttaacttacgttcgttaccagtactaaggttacttacggtacgtaccgttacgggtccctttcccgtttccgttaccgttttcccggacccgtttcggaaccctacgtacgttaccggtaactttaaccgtaaaccggtaaccgttcgggttacggtaccgtcggtacccgaccgttaacgttacgttaccgtttcccg

SEQ ID NO: 250876 - DNA, 712 bp, Homo sapiens
  misc_feature: GYAE6OF02H9XCL.44.65.F10.1.454.CMB.1.raw
  modified_base (155)..(155): a, c, t, g, unknown or other
  misc_feature (155)..(155): n is a, c, g, or t
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (285)..(285): a, c, t, g, unknown or other
  misc_feature (285)..(285): n is a, c, g, or t
  modified_base (333)..(333): a, c, t, g, unknown or other
  misc_feature (333)..(333): n is a, c, g, or t
tcagacagtatatacacgaccggtgctcgatttagctacgctctaagggggctctgggaggaactgctcagttacggacccagacggaaccatggaagccccagcgcagcttctcttcctcctgctactctggctcccagactaccacgtggaanaaatagtgatgacgcggtctccgacgccacctgtctgtntctacgagggaancgcctaccctntcctgcgacggccagtcagtagtagtagcagactaaccgttacgccgtcgtaccagtacaagtaacncgtacgaccgtacggacctcccgacggtcctacctcacttctagtgtncgtaccaccgaccggaccggcctacggttacgtacctcccaacgtccgtaacggttcccgtaggtacggcgtagggttccggggaccggtaacgtacggttaacgtccgtaccgttccgacctaccgtacgtaccggaacggtcccgccgttcgacgtacgttcgaggtaacgtttagttcgtaacggtttacgttttagttacgttattcgacgtagttacttaaacgtacgttacgtcgttaccttacgttaccggttaccgggttcggggtaccgggtaacggttacgggtaggtaacgtaacggtaaccgtaacggtacgtacgggttaccgacgttacggtaccactttccggtattttacccgtactttcccg

SEQ ID NO: 250877 - DNA, 750 bp, Homo sapiens
  misc_feature: GYAE6OF02HQ0WW.44.65.F10.1.454.CMB.1.raw
  modified_base (142)..(142): a, c, t, g, unknown or other
  misc_feature (142)..(142): n is a, c, g, or t
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
  modified_base (308)..(308): a, c, t, g, unknown or other
  misc_feature (308)..(308): n is a, c, g, or t
  modified_base (364)..(364): a, c, t, g, unknown or other
  misc_feature (364)..(364): n is a, c, g, or t
tcagacagtatatacacgaccggtgctcgatttagctacgctctaagggggaggaactgctcagttaggacccagacggaaccatggaagccccagcgcagcttctctcctctgctactctggctccagataccactggaanaaatgtgatgacgtcggtctccagccaccctgtctgtcgtctaccgagggaaancgccctacctctctgccgagggcctagtcagtagtgtacgngagactaacgttcgccttacgtaccagacaaagtaactcgtacggccacggcctaccgaggccctaccgtntacgtcgttagtcggtcacctacgtaccccgacgtacggcctaacggtcggtaccnccgacggtcctaggttcgagtacggtcgtagggtcgggtcggtacggactaggtaccttccgtactcctacctaacgtctaacggcacgtaccgttccgacgtacgtacgttgtaacgtaagtttacgtttacgttactttaggtttaaacttcgaccggttactaacgggtattaaaggttacgtaaccgttaggttaacccgttcccgggttccccctttaaccgggcccggtaaaccgggtaaacggtaaacccggtcggtaaccggtaaggggtttaaccttaaaccgttaaacgggtaccgtttggggaaccccgtttaagaccccggtacgtttaaccctacgggtttaccggtaccttttccggaacctttaccccggg

SEQ ID NO: 250878 - DNA, 771 bp, Homo sapiens
  misc_feature: GYAE6OF02HGCO0.44.65.F10.1.454.CMB.1.raw
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtcgtctccgaggggaaancgcccaccctctcctgcacgggccagtcagagttgttagcagactaacttcggcctcgtaccagccaagtaaatcgtacggaccgaggacctccccgaggtcctcccgtacacgttactaggtcgggctaccgactaccccgaccggacgggtccctaacgttcgggtaccctcccgacgtccgtaggttcacggtcggacgtagggttcggtacgtaggggacgagtacgttaccacgttcctacaccgtatccgacgtcctacggtccgtacggtactacggttctaaggtaacgtttactttacggtacgttttaaacgttttactttaccgtaccggttataaacgttacgtaaaagtttacgttaaacgttaccgtaaccggttcccggttaccccgtttcccgggtaaccgggtaaacggtaaaccgggtaacctaccgggtaacggtaacgggttaaagttaaacccggttaaaacggtaccgtttgggtaaccgggtaacccttacgggtaacccctaacggttccgttaacccgttttccgttaaccgtttcccgttaaccccgg

SEQ ID NO: 250879 - DNA, 674 bp, Homo sapiens
  misc_feature: GYAE6OF02IK2AV.44.65.F10.1.454.CMB.1.raw
  modified_base (195)..(195): a, c, t, g, unknown or other
  misc_feature (195)..(195): n is a, c, g, or t
  modified_base (304)..(304): a, c, t, g, unknown or other
  misc_feature (304)..(304): n is a, c, g, or t
  modified_base (590)..(590): a, c, t, g, unknown or other
  misc_feature (590)..(590): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccatggagaaatgtgatgacgcggtctccagccaccctgtctgtgtctccgaggggaaangcccaccctctcctgcagggccagtcagtagtgttagcagactaacttacgcctcgtaccagcaagaaatctggccaggcctcccgaggcctcctcattctagtggtcnctactcccgaaccagggcctacgtcggtactcccagcctagggttcaggtcggactagggttcgggtccgtaggggactaaggtacgttacccgaccttccgtaccgacccgttagaacgtaccgtaatcggttaaccacgtccgttaagaaaggtttattttcgacgtttaaggtttttaacttcgttgtacgtaggtcctaggttccgtaccctcggaaccggttccgtacgtaccggttacggttccggggggaccggggtaaccgtaagggtacgaacgtanaccgtaaggtaccggtaagttcgggtacgtaccgtcgaacccgtcgttaacgttcccgttgttaacccttctaccgttcccccg

SEQ ID NO: 250880 - DNA, 722 bp, Homo sapiens
  misc_feature: GYAE6OF02I44W7.44.65.F10.1.454.CMB.1.raw
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (537)..(537): a, c, t, g, unknown or other
  misc_feature (537)..(537): n is a, c, g, or t
  modified_base (592)..(592): a, c, t, g, unknown or other
  misc_feature (592)..(592): n is a, c, g, or t
  modified_base (705)..(705): a, c, t, g, unknown or other
  misc_feature (705)..(705): n is a, c, g, or t
  modified_base (711)..(711): a, c, t, g, unknown or other
  misc_feature (711)..(711): n is a, c, g, or t
tcagacagtatatacacgaccggtgctcgatttagctacgctctaagggggaggaactgctcagttaggacccagacggaaccatggaacgccccagcgcaggcttctcttcctcctgctactctgctccagactaccactagggataaatgtgatacgacgtcacttcaccgacgccctacccgttgtccgtgtcgtactacgaaaggggaaacncgcccgtaccctcttaccncggacgaaccgggccaacgttcgagtaacgtcgttaaccgacgtacgaaccgttggacctaggacccaacgaaccgtaacgtggacctacggctacccgaggtctcccacgtatcgtaagtacggaaaccaacctaccgaaccggtacgaccgttaacgtaccggtaacctaccccggtaaccgtacggttaacgtacggtcggaccgtttacggggccgggtaaccggtaagtaaccggttacgtaccgttaccgtaccttacgaaccgtactacgcgtaccggccttagaccttacggtntacgattacgttagctttaagttactacgttcgagtacgtcgtaataccgttaanacgttcggcctagtcgtaacggttccgggacgggtactaacggtacgaagtaccggaactaacggagtcgtacgtcgaaccgtcaggttatcctgtacgttactaccggtacncccgtntacgtctaacg

SEQ ID NO: 250881 - DNA, 826 bp, Homo sapiens
  misc_feature: GYAE6OF02HH9ZS.44.65.F10.1.454.CMB.1.raw
  modified_base (197)..(197): a, c, t, g, unknown or other
  misc_feature (197)..(197): n is a, c, g, or t
  modified_base (382)..(382): a, c, t, g, unknown or other
  misc_feature (382)..(382): n is a, c, g, or t
tcagacagtatatacacgaccggtgctcgatttagctacgctctaagggggaggaactgctcagttaggacccagacggaaccatggaagcccagcgcagcttctcttcctcctgctactctggctcccagataccactggagaaatagtgatgacgcggtctccagccaccctgtctgtgtcctccgaaggggaanacgcccaccctctcctgcgacgggccagtcagacgtgttacgcagctaacttacgcctacgtaccaggacaagtaaacgtcgtacggacctacggtcctccccgaggtcctacccgtctacttcgtaagtgggtcgaacctacctaccccgaacggtacgggacccttacgttccgggttaaccnccccgtacggtaccccgttaggggtttccaacggggttcggacgggtagggtttaccggggttcggtaggggtaaccgtaacggttaacggtttccaaccgttaccctacgtaaaccccgtcgttaaccgaacgtccggaaccgtcccggttaagacggtaacgtttaccggttaaggttaaacgtttcgttttacggaccgttttaaagttttaccgttttaccgagtttaaccgtacggtaactaggtttaacgtaacggttatacccgggtttcccggtacccccgtttacccggtttaacccggggaaacggtaaccgggtaaccgttaaccggaccgggttacggtaaacgtttaaacccgttaaaccggttcgtaacgggtcccggttaacgtaccgtaccgtacctttaggttcccgttacgtttccgtcgtacccc

SEQ ID NO: 250882 - DNA, 681 bp, Homo sapiens
  misc_feature: GYAE6OF02F3LPT.44.65.F10.1.454.CMB.1.raw
tcagacagtatatacacgaccggtgctcgatttagctacgctctaagggggctctggggaggaactgctcagttaggacccagacggaaccatggaagccccagcgcagcttctcttcctcctgctactctggctcccagagatcaccggagatattgtgttgacacagtctccaggcacctgtctttgctccgagggagagacgccacctctcctggtacggccaggtcggagtgttgactaagtacctacgcctacggtaaccaacacgaaacctggaccaggcctccgaggcctcctacattctagtgatcgactactaccaacgagggtcacgtcggaccacccgagacgtacggtacaggtcgacgaggtggtcgtagggacctaggtacctacactctacgtaccgtcgaacgacgaagtcgtaacgaccgtacgtagtaagttacgttttagtaccgttaagttttacttacgttacgtacgacgtacgtacgtacccggtttccaacccggtacggtaccccgttcttacccggttaccgggtttaccgggggaccgggggtaaccgtaggggttacggaacggttacctacggaaccggtaacggtaaggtcggccggtacgtacgaccgtacgttaacgttcgttacgtccgtttaccgtcgtttaccccg

SEQ ID NO: 250883 - DNA, 823 bp, Homo sapiens
  misc_feature: GYAE6OF02G3Z6S.44.65.F10.1.454.CMB.1.raw
  modified_base (200)..(200): a, c, t, g, unknown or other
  misc_feature (200)..(200): n is a, c, g, or t
tcagacagtatatacacgaccggtgctcgatttagctacgctctaaggggggaggaactgctcagttaggacccagacggaaccatggaagccccagcgcagcttctcttcctcctgcctactctggctcccagataccactggagaaatagtgatgacgcggtctccagcccacctgtctgtgtctaccgaggggaaancggcccacccctctcctggcacgggccaggtacaggagtgttagcagacaacttagccctcgtaccagacagaactcgtacggaccctacggcctaccccgaggtccctccgtacctaattccgtaacggttcggggtacgtaccctaaccgttccccgaaacccgggaccggggtacccctaacgggttaccggggttaaaccctcccccgtaaccgggttccccgtaacggggttttccaaacggggttcgggtccgttaaccggggggtttcgggggttaccggtacggggggtaaccctaacggtaacccgtttaccgtacccctttaccgtacccggtacccggttaacccacggtaaaccgtaactttacggtaaccgaaccggttcccgttaaggttaaaggtttcttttacggtaacgttttagttttaacgttacgttagtactacgtaccgttaagtctttacggtacgtaccgttacgggttaccctttcccggttaacttcccggtttaccgggcccgttacgggcccttacgtacggttacctaacgttacgtaaaccggttatccggtacgtcgtacctacgcctagttccttacgttccgttcttacc

SEQ ID NO: 250884 - DNA, 712 bp, Homo sapiens
  misc_feature: GYAE6OF02IQY4R.44.65.F10.1.454.CMB.1.raw
  modified_base (91)..(91): a, c, t, g, unknown or other
  misc_feature (91)..(91): n is a, c, g, or t
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
tcagacagtatatacacgaccggtgctcgatttagctacgctctaaggggggaggaactgctcagttaggacccagacggaaccatggaanccccagcgcagcttctcttcctcctgctactctggcctccagataccactggagaaatagtgatgacgcggtctccagccaccctgtctgtgtctccgaggggaaancgccaccctntcctgcagggccagtcagagtgttagcagcaacttacgcctacgtaaccagacaagtaaactcctcgggacctaagggcccttaccccgaacgggtcccttaccctacctaacgttaccgttaacgtcggggtacggtacctaccgttaacccccggaaccggaccgggggtacccctaacggttcggtaaccctcccgaacggtaccgtaggtttacgacggtggaccgttaggggttcggggttccgtagggggactacggtagtttaccgacctccctacaaccgtactacgacgtccgaacgtccctagactacgtctaagtattagtttcgtacgttagttttactagtcgttacgacgtactaagttaataacgtcgtacgtccgtacccgttaccgttcggaaccggaggaacctacgtacgtacggtaactaacggttaaacgtacgtcgggtacgtacctggtaaccacttacgtcgtaccgtttactcgtaccc

SEQ ID NO: 250885 - DNA, 791 bp, Homo sapiens
  misc_feature: GYAE6OF02GHMAH.44.65.F10.1.454.CMB.1.raw
  modified_base (143)..(143): a, c, t, g, unknown or other
  misc_feature (143)..(143): n is a, c, g, or t
  modified_base (150)..(150): a, c, t, g, unknown or other
  misc_feature (150)..(150): n is a, c, g, or t
  modified_base (197)..(197): a, c, t, g, unknown or other
  misc_feature (197)..(197): n is a, c, g, or t
tcagacagtatatacacgaccggtgctcgatttagctacgctctaagggggaggaactgctcagttaggacccagagggaaccatggaagccccagctcagcttctcttcctcctgctactctggctccagataccaccgganagattgngttgacgcagtctccagccaccctgtctgtgtctccgaaggggtaancggccaaccctctccgtgccagggccaggtcggagtgttgctaagtacctagcctagggtaccaacgacgtaaacctggccaggctacccgaggccttcctcatactacgatcgctactccagtccaacggccgacgtcggacacgttcccaacgtacgtcggttacacggttcgacgtaggtcggggtcgtaggggactaggacctttcaccgtctacgacgactacgtcaacgggcgacgttagggacgttccgtaggtaacggtactttcggtacgtacctttacggttttaacttaccgttggttaacccgtaggtacccggttaaagggttacgtttccgggggtttaggttaaccccctaccggtttacccgtttacggggttaaccgggttacccgggtaaaccggtaaaccggggtaaacccgtaaaggggtttaaccgggtaaccgttaaaccggaaaacccggtttaccgtttcgggtaaccggttaaccccgttagggtaaacccgttaaccccgtacggtttaacccggtttcgggttttaaccccctcgttttaacccccgtccccggtttaaacccccgg

SEQ ID NO: 250886 - DNA, 656 bp, Homo sapiens
  misc_feature: GYAE6OF02IMD9A.44.65.F10.1.454.CMB.1.raw
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
  modified_base (376)..(376): a, c, t, g, unknown or other
  misc_feature (376)..(376): n is a, c, g, or t
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
tcagacagtatatacacgaccggtgctcgatttagctacgctctaagggggaggaactgctcagttaggacccagacggaaccatggaagccccagcgcagcttctcttcctcctgctactctggcctcccagataccactggagaaatgtgatgacgcagtctccagcccaccctgtctgtgtctccgaggggaaagcgcccaccctctcctcgcacgggccagtcagagtgttagcagcaacttcgccccgtacagcaanaatcgcggccaggcctccnggcctctcattctagtggtcactatcccgaccgacgggccctacgttcgtacctccccaccgtacggttcaggtcggctcgggtcgggaccgganggtacgtcactcgtaccactatccanccgagcctgccngctagtattagtactttacgtacttaactttacgttactacgtaactaacgtaagttaactaaacgttacgtttacgtttaccttaacgttaacgtttacgggttttaaccggaccggggttaaaccgggaaccgtaaacggttacgtaacggtaagtaaacggtaaccgtaaaacggttaacgtcggttcggtaactacggtacccacgttattaccgtttacgttacccttacgttaccg

SEQ ID NO: 250887 - DNA, 809 bp, Homo sapiens
  misc_feature: GYAE6OF02HHK3E.44.65.F10.1.454.CMB.1.raw
  modified_base (199)..(199): a, c, t, g, unknown or other
  misc_feature (199)..(199): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggaagaaatagtgatgacgcagtctccagccaccctgtctgtcgtctcgaaggggaaancgcctaccctctcctgcgacgggccagtcagtagtcgtaccagacctaacgttcgaccgtacggtaccaaccgaagtaaaccgtggggaccacgggccctaccgaggtcctcctacacttcgtaagttacggaacctacgtaccccgaacggaccgggtccctaacggttacggtaaccctacccccgtaacccgggtaggtttaaccggacgggtccggtaccggtacgggggtttcgggggaacccgggtaactaacggggttactttacccgtaaccgtttacccttaaccaccgtacgtaccgaaccggcccgggttaccctcgaaccgtcggtcgtagggttaacggtttaacgtttttcggaacgttttagttttacgttaccgttaggaccgttacgaagttaaacgttaagttaacggttaccgtaccgttacccggtcccgtttacccggtaccgggaaaccggtaacgggtaccctaaacgggtacggttaaggtaaacgtaaacgttaaccggtaacgttcggtacggacgtcggtaaccctacgtacttcggttactttccgttacgtacccgttccgtaccctcttacgtcgttaac

SEQ ID NO: 250888 - DNA, 664 bp, Homo sapiens
  misc_feature: GYAE6OF02GYA3Y.44.65.F10.1.454.CMB.1.raw
  modified_base (347)..(347): a, c, t, g, unknown or other
  misc_feature (347)..(347): n is a, c, g, or t
  modified_base (377)..(377): a, c, t, g, unknown or other
  misc_feature (377)..(377): n is a, c, g, or t
  modified_base (439)..(439): a, c, t, g, unknown or other
  misc_feature (439)..(439): n is a, c, g, or t
  modified_base (622)..(622): a, c, t, g, unknown or other
  misc_feature (622)..(622): n is a, c, g, or t
tcagacagtatatacacgaccggtgctcgatttagctacgctctaagggggaggaactgctcagttaggacccagacggaaccatggaagccccagcgcagcttctcttcctcctgctactctggcctcccagataccactggagtaaatgtgatgacgcggtctccagccctaccctgtctgtgtccgtaccggaagggggaaagcgccctacccctctccgtggccgaagggccaggtcgaaggagttgttagacaggctaaacgttcgccctacggtaccagacaagtaactcgtacggccgacggtcctcccgaagtcctcctactacttacgtagtcggtcncacctaccgaccgaggcccaggtcgtaccnccgacgtccgtaaggtcaggtcgtcgaggtcgggtagtcgggaagagttcgtacaccgtacnccgtaactcacgtacgctaccgcgtcgctagtacggtagtaacgtttattgtaactttagtttagtacgttagtaccgtgtaactagttaaacgtagtacggtacgtccgggtcccttacccggttgaacccgtaaggaccgtacgaggtaggtaacaaacggtttaaacgacgtggtaacgngtaaccgactacgtcgttattccgttacttaccgttacccgg

SEQ ID NO: 250889 - DNA, 837 bp, Homo sapiens
  misc_feature: GYAE6OF02HXKRG.44.65.F10.1.454.CMB.1.raw
  modified_base (203)..(203): a, c, t, g, unknown or other
  misc_feature (203)..(203): n is a, c, g, or t
  modified_base (405)..(405): a, c, t, g, unknown or other
  misc_feature (405)..(405): n is a, c, g, or t
  modified_base (525)..(525): a, c, t, g, unknown or other
  misc_feature (525)..(525): n is a, c, g, or t
tcagacagtatatacacgaccggtgctcgatttagctacgctctaaggggctcgtgggagaactgctcagttaggacccagacggaaccatggaagccccagcgcagcttctcttcctcctgcctactctggctcccagataccactggacaaatgtgatgacgtcggtctccagccacctgtctagtgtctccgaggggaancgcccacccgtctcctcgacgacggtaccacgtcgaaggtcgttacgttaaccaggtacctaaacgtttaacgccgttacgtaaccccgaactacggtaaaacccgttcgggaccgtacggaccgttcccgacgtaccggttaccctacgtaacttaccgttagtaaccggtaactacgtacccgtaaccggccggtaaccnccggttacggtacccttaccccgaaccgttaccgggtaccgtaggtccgggtaccgtacgggtccgggtaccgggacgtacgtacggttaccctacgtactacccgaactacgtacccgnggtacccgtccgtacgaccgtagtccgtaacgtaggtttaacgttcggttaaccgtttaagtttacttacccgttagggttaccctaaacggttactaacgttttaaacggtaaccgttacgttacccgggtaaccgttacccgtttaccccgggtacggtaaaccccgtaagggtaacccgttaacggttacccggtttaaacggaaacttaaaccggttaactttacggggacttccggaaccgttacgaaccttaacgtcgttaccgtacgtttaccgtcttaacccggtttcccgttaccgccttacg

SEQ ID NO: 250890 - DNA, 742 bp, Homo sapiens
  misc_feature: GYAE6OF02IE7M8.44.65.F10.1.454.CMB.1.raw
  modified_base (200)..(200): a, c, t, g, unknown or other
  misc_feature (200)..(200): n is a, c, g, or t
  modified_base (696)..(696): a, c, t, g, unknown or other
  misc_feature (696)..(696): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtcctcgacgccacctgtctgtcgtcctacggaagggaancgccctacccttctccgtgcgacgggcctagtcgagtacgttgtacgcgacgactaacgttaccgcctacgtaccgacgcgaaagtaactcgtcggccgaacggcctacccgagtccttacctctacttacgtacgtggtcgaccttaacgccccgaacggtaccgggaccctacggttacggtacctacccgaacgtcccgtaaggttaccgagggtcgacgttaggggtacgggtacgagggaactaggttacgtaccgtactcctaccctaacgtactccgacgtaccgtacggtacctaccggtactaacgttacgtaagttaacgttacgtttacggttacttaaggttttaacttaacggttcgtaactaacgtacgtaaacttaacggttaacgtcggtaccctaccgggttaccctttaccccgggtaccgaaccgggtaaacggaccgtaacggtacgtacggtaacggtaaacgttacggtaacgnggttacgacgtcgtaacacgttactcctacgttcccgtattacccg

SEQ ID NO: 250891 - DNA, 740 bp, Homo sapiens
  misc_feature: GYAE6OF02GR135.44.65.F10.1.454.CMB.1.raw
  modified_base (136)..(136): a, c, t, g, unknown or other
  misc_feature (136)..(136): n is a, c, g, or t
  modified_base (143)..(143): a, c, t, g, unknown or other
  misc_feature (143)..(143): n is a, c, g, or t
  modified_base (195)..(195): a, c, t, g, unknown or other
  misc_feature (195)..(195): n is a, c, g, or t
tcagacagtatatacacgaccggtgctcgatttagctacgctctaagggggaggaactgctcagttaggacccagacggaaccatggaagccccagcgcagcttctcttcctctgctactctggctccagataccnctggaanaaatagtgatgacgcagtcctcagccacctgtctgtgtctccgaaggggaancgcctaccctctcctcggcgagggcctaagtcgaaggtcgttacgttaccgagacctaacgtttacgccgttagggtacccaaccgaagtaaaaccggtcgggacacggccgtacccgacggtccttccgtactacgttcgtaacgttaccggaaactccgttaccccgaccggaccgggtccctaacgtccgggtaacctccccgaaccgtacggtcgtacggtggtacgttacgggtccggggtaccgggaacgtacgtacggttacgaaccttcttacccgactaacgtccgacggtccggacctcggtacgttagtccgtacggttaggttacgtttacgtcgtttaaggtttacttacgtcggttacgacgtacttaacgtacttaacgacgttaccggcccgtttaccgaccggtaaccgaacggtaccgtagtaccgtacgtaaacggttaacttaaacggtacgtacgtacgcttaccgcgtactacttctcgttaccgttctaccgttcccgtcccgtactacgttcgattaaccg

SEQ ID NO: 250892 - DNA, 774 bp, Homo sapiens
  misc_feature: GYAE6OF02JLOYC.44.65.F10.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (227)..(227): a, c, t, g, unknown or other
  misc_feature (227)..(227): n is a, c, g, or t
  modified_base (273)..(273): a, c, t, g, unknown or other
  misc_feature (273)..(273): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactgggagaaattagtgatgacgcggtctccagccacctgtctgtgtctccgagggaaancgccaccctntcctgcgagggccagtcagngtgtagctagactaactcgccgtacgtacagcagaactcgcgaccnggtcctcccgaggtcctcctacgacttcgtagtcggtcgtacctaccgtacccgaccggtacggaccctacggtacgttaccgtaccccgacggtaccgttaaggttccgaacggtcggactaccgggtcgggttacggtaggggtacacgttacgttaccacgttcccgtacgaccgtattaccggagaccgtaccgtaccgtacgtaccgtacgtaccttaaggaacgtttacgtttaacggtacgtttaagttttaccgtttaaaccgttggttccctaaagtaccggttaagtttaaaccgttaacgttcgtaaccggtttcccggttaacccttcccgggtttaacccgggaccgtaaaacggtaccgtaaccggtaccgttacggggaaaacttaacccggttaaaaccggagggtttaccggtaccggtaaccgttaccggtaaccgttaaccggttaccgttacgtttacggttacccgtttacgtaacccgg

SEQ ID NO: 250893 - DNA, 744 bp, Homo sapiens
  misc_feature: GYAE6OF02GHG1I.44.65.F10.1.454.CMB.1.raw
  modified_base (199)..(199): a, c, t, g, unknown or other
  misc_feature (199)..(199): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtcgtctaccgaggggaacncgcccacctctccgtgcgagggccagtcagtagtcgtaccagactaacgttcgcctaggtaccacgtaacgaaccgtgggacacggcctacccgaggtcctccgtactagtcctacgtacggaaactccgtacccgaaccgacgggtccctaacgttccggtacctccccgaccgtaggttcacggtcggacgtaggtccggggtaccggactaggtacgttccaacgttctaccaccgtagtaccgtacggtcccgtccgtacgtacgtacggtttacgtacggtacggtttattttcggtaacgtttagtttacgttacgtacgttacgtacgtaccgttaagttacttaacgtaccgttccggttacccttacgttaccggtttaccgggttaccgggggtaaccggggtaccttaagggggtactaaccggttaactaaccgtaaaccggttagtcggttacggacctacgggtacctaaccgttcgttccgttacggttcctaaccgtccgttacccgtacccgtacttccgtacgtacg

SEQ ID NO: 250894 - DNA, 795 bp, Homo sapiens
  misc_feature: GYAE6OF02G90BK.44.65.F10.1.454.CMB.1.raw
  modified_base (189)..(189): a, c, t, g, unknown or other
  misc_feature (189)..(189): n is a, c, g, or t
  modified_base (201)..(201): a, c, t, g, unknown or other
  misc_feature (201)..(201): n is a, c, g, or t
tcagacagtatatacacgaccggtgctcgatttagctacgctctaaggggggaggaactgctcagttaggacccagacggaaccatggaagccccagcgcagcttctcttcctcctgctactctggcctcccagataccacgtggagaaatgtgatggacgcagtcctccagcccacctgtctgtctcnccgaggggaacncgccctacctctccgtgcgacggccagtcagtagtggtaagaacttacgttagccttagtatacgaactacgacaccgtgtccgacggtccctcccgaggtccttcccgataactctaacgtcgataccgacctaacgtccgaaaggtccgggcccggcggtaccacccgttacccgaaggtccgtacgggtaccaggtaccggcgtaggggtcgggtaacctcgaaacgggtcctaggtacccttaacgccttaccacccacgtaacgccgaaccggtctaacgtccgtggaaccgttacgggtctaaaggggtcgttttacttttacggcgtttaaacctttttagttcccgtaggtttaacaaacggtttacggtaaaacgtttaaccttaaacggggttccttaaccccgggtttcttaacccggttaccggggttttacccgggtacggggggtaaccggggttaaaaccggaggtcgggttaaataaccccggggttaaaccaaaggggtcccggttggtttaccccggggaattaacccgcccggtttaaccgtaaggtttttacccggccgtttacctaaccccgg

SEQ ID NO: 250895 - DNA, 776 bp, Homo sapiens
  misc_feature: GYAE6OF02JSAP2.44.65.F10.1.454.CMB.1.raw
  modified_base (161)..(161): a, c, t, g, unknown or other
  misc_feature (161)..(161): n is a, c, g, or t
  modified_base (198)..(198): a, c, t, g, unknown or other
  misc_feature (198)..(198): n is a, c, g, or t
  modified_base (244)..(244): a, c, t, g, unknown or other
  misc_feature (244)..(244): n is a, c, g, or t
  modified_base (715)..(715): a, c, t, g, unknown or other
  misc_feature (715)..(715): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtcgatgaccgnagtctccagccaccctgtctgtgtcctcgaggggaangccaccctctcctagccgagggtccagtctaggagttcgttaaccngtcctaacgttacgcccgtggtaacccaacgtaacggaaacctcgggactagggacccttccgaaggtcctaccgtctacgtcgtacgtgggtactacctactccccgaacgtcggggtccctaacggttggtacccgtacccgacgggcccgttaagggttccgacgggtcgccggtaagggttcggggtaccttacggggactaacgttaacggttcctaaccgttcgtaaccctaccgtaaatcggaccgtaccgtaccggtacgtcgtaaccgtacggttaccggtaacggtaactttccgtttacgtacgtttaacgttaccgttaggttacgtaccgtacgagttaacgttaagtaacggttaccgttaccgtaccggtcccgtttaccggcgtacccgggtaaagtacccgacggttacgtacgggtaacctacgttaaaccgtccgggtacgcggtttacccncggttacccgaatttcggttacccgtttaagttccccttgttaccccttaccggtttaccc

SEQ ID NO: 250896 - DNA, 780 bp, Homo sapiens
  misc_feature: GYAE6OF02JEYLY.44.65.F10.1.454.CMB.1.raw
  modified_base (224)..(224): a, c, t, g, unknown or other
  misc_feature (224)..(224): n is a, c, g, or t
  modified_base (316)..(316): a, c, t, g, unknown or other
  misc_feature (316)..(316): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctccgaggggaagcgccaccctctctgcgagggccagtcagngttgttagcagacaacgttagccctggtaccagcaagaaactcctggacccaggcctaccccgaggtccttcccgtcacttcgtagtcgggngacctacgtcccgaaccgacggggtacccacggtttcgggtaacctcccccgaaggtccccgtagggttttaccaacggggttggaccgtaggggtttacggggtaccgttacggggaacctaagggttacgttccaaacccgtttctaacccacccgtagttaccgacgaccgtaccgtacccgtaggtaacccgtacggtttaccgttaagggttaaacgttacgttttttacggaaccgttttaaggttttaacctttacggttccgttacggacgtaccgtttaggttaaacttagttaccggtacgttccgttacccctttacccggttaccgggtaaccgaaaccgggtactaaccggttaccggtaggttaaacgtaaccggtttaaaccgaacggttcggtacggtaccgtacgtaccctaaccggtacttaccgttcggttaccttaccgtaccg

SEQ ID NO: 250897 - DNA, 715 bp, Homo sapiens
  misc_feature: GYAE6OF02HZ8HD.44.65.F10.1.454.CMB.1.raw
  modified_base (143)..(143): a, c, t, g, unknown or other
  misc_feature (143)..(143): n is a, c, g, or t
  modified_base (327)..(327): a, c, t, g, unknown or other
  misc_feature (327)..(327): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (457)..(457): a, c, t, g, unknown or other
  misc_feature (457)..(457): n is a, c, g, or t
tcagacagtatatacacgaccggtgctcgatttagctacgctctaaggggggaggaactgctcagttaggacccagacggaaccatggaagccccagcgcagcttctccttcctcctgctactctggcctcccagataccacnggaagaaactagtgaactgtcggccggtctaccagcccaccctgtctggtcgtacctccggaaggggaaagtcaccccctcccttacgccctagggactacggggccaaggttccaaggagggttctagaccgaacaccgttaaacgtttccgccgtaccggaacaggtcaaggtaaacttcgngtaccgacgcccttaccggaccctcgtcatacgtgtcggnacctcgcccgtaacgcggacctacgggttanacctccggaacgtcctaagggttctacggacggtcgagggttcggggtactacgggaanaccggacgtttctaccgtacggactaccgaatcccgagccgactcgtacgacgtacgcgttaagtacgttacgttagtacttacgtttaacttacgtcgtttacgagtactaaggtaatacggtacgtaccgtccggtaccttcgtacccggaacggtaaacgaccgtaacgtcgtaacgggaacgttaacgtaacggtaacgtggtaacgtacgtacgtacccgtactaccggttactaccgttactaacgttcccg

SEQ ID NO: 250898 - DNA, 834 bp, Homo sapiens
  misc_feature: GYAE6OF02FQV04.44.65.F10.1.454.CMB.1.raw
  modified_base (200)..(200): a, c, t, g, unknown or other
  misc_feature (200)..(200): n is a, c, g, or t
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtcgtctccgaaggggtaaancgcccaccctctcctgacgacgggccagtcagtagttgttagcagcaacttacgcctaccgtaccaggaccaagtaaactcgtacggtaccaacgggtcctaccccgagggtcccttacccgtccgtaacttcgtaacgttcgggtacgacctaaccgttaccccgaaccggtaccggggtaccctaaccggttacggtaaccgttaccccgacggtacccgtaacggttccgaagggttcggaccgttaggggtcgggttaccggtacggggaactacggttacgttacctaccgtaccgtaccaaccgtacttacgacggtctaacgtccgtacgcttacggtacgttacggaaacgtttacgtttacgaacgttttacggtttaacttacggttacgttaaccggaacgttaccgttaaggttaaacgttaaaccgtaccggttaccgtacccgttaccgttacggtttaacccgggtttaccggggaaccgggggttaaacgtaacgggggttacgggaccgttaacggtaaacccggtaaaccgggtaacggtttacgggtaaccgggttacctacgggtacccctaacggttacgtacccggttttacgttacccttacggtaccccg

SEQ ID NO: 250899 - DNA, 808 bp, Homo sapiens
  misc_feature: GYAE6OF02G9QA8.44.65.F10.1.454.CMB.1.raw
tcagacagtatatacacgaccggtgctcgatttagctacgctctaagggggaggaactgctcagttaggacccagacggaaccatggaagccccagcgcagcttctccttcctcctgctactctgctccagataccactggaagaaatagtgatgacgcggtctccgacgccacctgtcttgtcgtccgtacgaaaggggaaacgcgaccctacccttctcctggacgaccgggacctaggtaccgaggtagttacggttagcacgacgtaacttacgtccttaccgtaacacgtacgtaagaaacttcgacgggaccgacggtacctaccgtggtccctacctactacttacgtaagtcggtagtacctaccgacccgtaccgtacgggaccctacggttacgtaccgtacccgaaccgtccgttacgggttccgacgggtacgcggtacggttcggggtcgtacgggactaaggtacggttcctaactccgtacctacaacgttcaacggactaccgtaccgtacgacgtaacggtgtacggtaacgtttacgtttacgtagtttaacgtttacgtttactagttacgttacgtattaaacgttaataacgttaacgttccgtacctttacggttccgtttaacgggtttacccggggggaaggttaacccggtaagggttacccgggaagtaacccgtttaaacgggaaacggtttaccggtacgttaaccgggacctttaacggtacccgtttaacggttttacgtttaaccggtttacccgtttcaaccccgtttttccccgg

SEQ ID NO: 250900 - DNA, 658 bp, Homo sapiens
  misc_feature: GYAE6OF02IKC9Q.44.65.F10.1.454.CMB.1.raw
  modified_base (201)..(201): a, c, t, g, unknown or other
  misc_feature (201)..(201): n is a, c, g, or t
tcagacagtatatacacgaccggtgctcgattttagctacgctctaaaggggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagngcccaccctcctcctgcgacgggccagtcgagagttgttagcgacgctaacttacgcctcgtaccagcaagaaatccgtcggccgaggcctcccgacggcctcctcacttcgtagtcggtcgctactcccgaccgacgggcctacgtacggtacctcccgaccggccgttaggttcgacggtggccgtagggttcgggtcgtggggaactaggtacgttcaccttccgtacaccactccagccgtacgtccgtcgactacggtacgtaagtaagttattttcgtacgttaatttacgttatgtacgtagacgtagtaattagacgtacgtccgttcccgtacccgtacggaaccggtaacggactaacgtacgtacggtaacgttaacggtaacgtaacgtcggtacggtacgtacgtaccctaccgttagttaccgtttcttacccgttagtcccg

SEQ ID NO: 250901 - DNA, 804 bp, Homo sapiens
  misc_feature: GYAE6OF02HWHEZ.44.65.F10.1.454.CMB.1.raw
tcagacagtatatacacgaccggtgctcgatttagctacgctctaaggggggaggaactgctcagttaggacccagacggaaccatggaagccccagcgcagcttctcttcctcctgctactctggctcccagactaccacgtggagaaatagtgatcgacgcggtcctaccagcccaccctgtctgtgtcctacgaaggggaacgcgacccacccttctcctgccgacgggccagtcgaggtagttgttacgcagtacctaacgttcgcccttaccggtaccagtacaaacgtaactccgaggtccaacggcctaccccgtaggcccttaccgtactacgttaccgtagttcggacgtaccctacgtaccccgaaccggtaccgggacccgtaaccggttacgggttaacccaaccccggtaccggtacccggtaacggttttccggaacggggttcggtaccggtaacggggtttcggggttacggtaacggggtaacgtaacggttaccgttaccctaacccgttacccttaacccgaacctaacgtaccggtaaccgtaccgtacccgtaccgtacgtaacgtacggttacgtaacggttaacgttaaagttttccgtagtttaacgtttacgttacggtacgttacgaacgtacgttaattaacgttaaggttaccgtacgtacccgtacccgttccgtaaccggaaccgtaacggaccgtacgtacgtagtaacgtaacgttaacggtagtcggtacggtactacgtacgtacgtacttcgtacgttacgtactaccc

SEQ ID NO: 250902 - DNA, 725 bp, Homo sapiens
  misc_feature: GYAE6OF02F5RGY.44.65.F10.1.454.CMB.1.raw
  modified_base (147)..(147): a, c, t, g, unknown or other
  misc_feature (147)..(147): n is a, c, g, or t
  modified_base (163)..(163): a, c, t, g, unknown or other
  misc_feature (163)..(163): n is a, c, g, or t
  modified_base (205)..(205): a, c, t, g, unknown or other
  misc_feature (205)..(205): n is a, c, g, or t
  modified_base (519)..(519): a, c, t, g, unknown or other
  misc_feature (519)..(519): n is a, c, g, or t
  modified_base (709)..(709): a, c, t, g, unknown or other
  misc_feature (709)..(709): n is a, c, g, or t
tcagacagtatatacacgaccggtgctcgatttagctacgctctaagggggaggaacgtgctcagttaggacccagacggaaccagtggaacgccccagcgcagcttctctctcctgctactctggctcccagactaccacgtgganaaatagtgatcgacgnagtctccgacgacccacctgtctgtcgtctacgaggggaaancgccgacctctcctgaccacgggtaccagtcacggtatcgttaaccacgtactaaccgttacgcctacggtaacccacgaaacgtaaccgtgggacctacgccctccgaggtccccttcctacttacgtactaagtacggaaccactccaacggtacggctaccgtagtaacctcccacggtacgttacagggtacggtcgtacggttccggggaccggtaagacgttcgtcgtaacctccgacacgtcgtacgccggccgtcgtcacgtagtcgagtacgttacgtttgaccggttatttcgtacggtctacncggttacgaaattactaagtaccgtcaaccgttccttacggtaccggttacgggggtaaccggtaacgtaacgggtaggtaacgtaacgtaaaccgggtaactacggttcggtaccgtaccggttacgaacctaacggttcttaacccggttcgttaacccttacctttccggttaaccccgtccgggtnttacccggtatttacg

SEQ ID NO: 250903 - DNA, 781 bp, Homo sapiens
  misc_feature: GYAE6OF02JOIYY.44.65.F10.1.454.CMB.1.raw
  modified_base (201)..(201): a, c, t, g, unknown or other
  misc_feature (201)..(201): n is a, c, g, or t
tcagacagtatatacacgaccggtgctcgatttagctacgctctaagggggaggaactgctcagttaggacccagacggaaccatggaagccccagcgcagcttctcttcctctgctactctggctccagataccacgtggacgaaatgtgactgacgcagtctaccagccacctgtctgtcgtaccgtacggaggggaancgtaccctacccgtcctcgacggccgacggtccctagtcgagtacgttcgtaaccgagtacctacgtacgcctaggtaccaacgtaacgaacgtcggcacggtccgtacccgaggtcctaccgtactactctagaccggaactaccgtaccgaaccgtaacggtccaacgttaccggtacccgtacccgtaaccgtaggtaccgtacggtcgtacggtaccgggttacggggacccggtaagtacccgggttacttacccggttaacgccccttaacgtaccgtaccgtaacggtaccggtccgggttaccctcggacgggtttaaccgtcggtaacggttacggtttacgtttacggtaccgtttacgttaacgtttcggtacgtaaccgtaccggtacggtacgtacgtaccggttaccgtacggttacgggtaaccgttaggtaacccggtcgggtaaccggggtaacctacgggtacgtcgtacgtaaccgtaacgaccggtacgtcggtaccgcgttacgtaccacgtacgttaccgtcgttaccgttacgtcccttaccgtccctagtcctacg

SEQ ID NO: 250904 - DNA, 719 bp, Homo sapiens
  misc_feature: GYAE6OF02JJDTV.44.65.F10.1.454.CMB.1.raw
  modified_base (137)..(137): a, c, t, g, unknown or other
  misc_feature (137)..(137): n is a, c, g, or t
  modified_base (445)..(445): a, c, t, g, unknown or other
  misc_feature (445)..(445): n is a, c, g, or t
  modified_base (540)..(540): a, c, t, g, unknown or other
  misc_feature (540)..(540): n is a, c, g, or t
  modified_base (619)..(619): a, c, t, g, unknown or other
  misc_feature (619)..(619): n is a, c, g, or t
tcagacagtatatacacgaccggtgctcgatttagctacgctctaagggggaggaactgctcagttaggacccagacggaaccatggaagccccagcgcagcttctcttcctcctgctactctggctccagataccnctggagaaatgtgatgacgcggtctccacgcctacctgtctgtcgtctccgaaggggaaactcgcccaccttcgtaccgtcgaccgtacgggtccctaaggttacaacggtaggttagttaacggacgtacgtacctaaaccgttacggacccttacggtacccaagtaactaaacgaaacttccggacgggaccaccggtaacgtacccgacgttacctcgtactacttaccgttaggtcgtactaccgtaactccccgtaacggccgaccttacggtacgttacctcccgagtaccgtaggtacgnggtaccgacggttcgggtacggtggtacggaacgtacgtacgttacacgtccactacgactcgacgtgacgtctagccgtactagtagtaagttntacggtacctttagttatttccgatcgtaacgtattacgtagtaagtccctacgttcgtaccgtccgtacggtaaaccncgggtaaccgtagacgtacgtaacgtaacttaaaccggtggtaccgtccggtaacgccgtaacggtcgtaccgtttcgttccggtattaccccgttaccg

SEQ ID NO: 250905 - DNA, 751 bp, Homo sapiens
  misc_feature: GYAE6OF02IO508.44.65.F10.1.454.CMB.1.raw
  modified_base (177)..(177): a, c, t, g, unknown or other
  misc_feature (177)..(177): n is a, c, g, or t
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
tcagacagtatatacacgaccggtgctcgatttagctacgctctaagggggaggaactgctcagttaggacccagacggaaccatggaagcccagcgcagcttctcttcctctgctactctggctccaagataccactggagaaatgtgatgacgcggtctcagccacctgtctgtntcnccgagggaaaccgtccncctctcgngcgacggcagtnagtagtagtaacgaacttacgtagtccgtaggtaactacaaacgtacgtaaccgtacgtcggaccgtaacggcccgtacccgtacggtcccttacctacgtaacgttacttaacggtacgtacgtcgtaacctaacgtaaccgaacggtccgggtcccggtaccggtacctaccgtacccggtaagtacccggttaaggtacgtaagggtcggaacgttagggttccggtacaacggtaacggtaaccgtaacgtaaccttacgaaccttaccgtaccgtaaacgtaacgtccggaacgtaccggtaaccgtaacggtaaccggtaaccggtaaacgttacgttacgtaacgtttaacgttaacgttacgttacgtaaaccgtaacgtaccgtacgtaccgtacgtaccggtacgtacgtacgttaccggtacgacgtacggacgtacgcgtacgtacgtacctacgaacgtacgtcgacggtactaccgtaccgtacgtacgtccgtacgttacttccgtacctccgtacccg

SEQ ID NO: 250906 - DNA, 508 bp, Homo sapiens
  misc_feature: GYAE6OF01C5MVV.15.49.E05.1.454.CMB.1.raw
  modified_base (206)..(206): a, c, t, g, unknown or other
  misc_feature (206)..(206): n is a, c, g, or t
  modified_base (362)..(362): a, c, t, g, unknown or other
  misc_feature (362)..(362): n is a, c, g, or t
  modified_base (400)..(400): a, c, t, g, unknown or other
  misc_feature (400)..(400): n is a, c, g, or t
  modified_base (502)..(502): a, c, t, g, unknown or other
  misc_feature (502)..(502): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccaggggaaangccaccctctcctgcagggccagtcagagtattgacagcaagttagcctggtaccagcagaaacctggccagactccagactcgtcatctttgctacatctgccagggccacgtggcatcccagccacgttcagtggcaggtgggtctgggacagngttcatttctcaccatcagcagcctgcagtctgaagtnttttgctagtttattactgtcagcagtataatgactgcctcgtacgttcggccaacgggaccaaggtacggaaatacgaaacgactggtaggctagacaccntcgtcg

SEQ ID NO: 250907 - DNA, 487 bp, Homo sapiens
  misc_feature: GYAE6OF01B1QFW.15.49.E05.1.454.CMB.1.raw
  modified_base (396)..(396): a, c, t, g, unknown or other
  misc_feature (396)..(396): n is a, c, g, or t
  modified_base (481)..(481): a, c, t, g, unknown or other
  misc_feature (481)..(481): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatcttgctacatctgccagggccactggcatcccagccacgttcagtggcagtgggtctgggacagagttcattctcacatcagcagcctgcagtctgaagtnttttgctagtttattactgtcagcagtatatgactgcctcgacgttcgcaggaccaaggtcgaatcaaacgactgtcgctgcacntcgtcg

SEQ ID NO: 250908 - DNA, 513 bp, Homo sapiens
  misc_feature: GYAE6OF01BNHUK.15.49.E05.1.454.CMB.1.raw
  modified_base (507)..(507): a, c, t, g, unknown or other
  misc_feature (507)..(507): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcaggtgggtctgggacaggagttcattctcaccatcagcagcctgcagtctgaagtattttgctagtttattactgtcagcagtataatgtactggcctccgacgttcggcctaagggaccgaaggtaggaaatacgaaacgtactgtacggtctagacacctntcgtcg

SEQ ID NO: 250909 - DNA, 504 bp, Homo sapiens
  misc_feature: GYAE6OF01BUIJ8.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagtatttgctagtttattactgtcagcagtataatgactggcctccgacgttcggaccgaagggaccaaggtgaaatacgaaacgactggtcgtctagacacctgtctcg

SEQ ID NO: 250910 - DNA, 595 bp, Homo sapiens
  misc_feature: GYAE6OF01C0PIQ.15.49.E05.1.454.CMB.1.raw
  modified_base (206)..(206): a, c, t, g, unknown or other
  misc_feature (206)..(206): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaancgccaccctctcctgcagggccagtcagagtattgacagcaagttagcctggtaaccaggcaagaaacctggaccagacctcccagactcgtcatctttgctacatctgccagggtccacgtgcactcccagccacgttcagtggcaggtcgggtctgggactaggtacgttcactttcctacacctatcagccagtcctgactagtctagtaacgtattttcgacgttagttttactacttgtacgagtactaagttataagttggtaaccttcgggtacccctaccggtaccggttccggaccggtaaacgggacccgtaaagggtacggaaagtaaccgaaacggtaacgtaggtacggtacgtcgacctaccgtagtcggttacg

SEQ ID NO: 250911 - DNA, 506 bp, Homo sapiens
  misc_feature: GYAE6OF01ANXSD.15.49.E05.1.454.CMB.1.raw
  modified_base (205)..(205): a, c, t, g, unknown or other
  misc_feature (205)..(205): n is a, c, g, or t
  modified_base (370)..(370): a, c, t, g, unknown or other
  misc_feature (370)..(370): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactccagactcgtcatctttgctacatctgccagggccacgtggcatcccagccacgttcagtggcaggtgggtctgggacagagttcattcncaccatcagcagcctgcagtctagatatttgctagtttattactgtcagtcagtatatgactggcctcgacgttcggacgaacgggaccgtaaggtcgaatacgaaacgtacgtagtcggctgaccactgtcgtcg

SEQ ID NO: 250912 - DNA, 787 bp, Homo sapiens
  misc_feature: GYAE6OF01B3N3H.15.49.E05.1.454.CMB.1.raw
  modified_base (205)..(205): a, c, t, g, unknown or other
  misc_feature (205)..(205): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagcccaccctactcctcgtcgacggaccggaccgtacgtacgaaggtaagtttagtacgaacgacgaacgttaaggtaccgtccggttaccggtaaccgacgacgaaaaccgtaaccggtccggaccgaacgtacccctaccgaacgtaccgtccgtactacttttcgttcgtacctactacttcgtccgaccgggaccggaccctacggtcgacctaccctaccgaccgtaccgttaccgtacgtagggtccgacgtaggggtcggtcgggtacggacgaggttcgtacttcgttaccaccactctacgacgacgaccgtcgtcgacgtacgttcgaaggttaagttttcgttcgtacgttttaagttttacttacggttcgtaacgcgtaacgttaacgttaaattacggtacgttaccggtacccggttaccccgtacgggttaccgggttaccccggaaaccgggtaaacccgggaaaccggttaaggggtaaaccgttaaaccgtaaaacccggtaaaaccggttcggttacggggtaccgtaccggtaccggaacccctaacgttcggtttacccg

SEQ ID NO: 250913 - DNA, 671 bp, Homo sapiens
  misc_feature: GYAE6OF01CG4UM.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagacgcccaccctctcctgcagggccagtcagagtatgacagcaagttgctggtaccagcagaaacctggaccagactcccagactcgtcatctttgctacatctgccagggccacgtggcactccccagccctacgttcaggtcggactagggtcgggtcgtggggactaggtacgtttcatttccgtaccaaccgaattccgaagccgtaacggtcccttggacctaaggtccttaggaaacgttagtttttcggacgtttagtttttaacttacgttgtaccgagtacctaagttaataagttcggtaaccgttcgggtaccccttacccgggtaaccggtttaccgggacccgtaaaacgggggtaaccctaaagggggttaaccggaaaacgttaacccggaaaacggtaacccgttagggttacgggaccttacggaccctaacccgtagttccgtttacg

SEQ ID NO: 250914 - DNA, 534 bp, Homo sapiens
  misc_feature: GYAE6OF01CA8PL.15.49.E05.1.454.CMB.1.raw
  modified_base (206)..(206): a, c, t, g, unknown or other
  misc_feature (206)..(206): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
  modified_base (507)..(507): a, c, t, g, unknown or other
  misc_feature (507)..(507): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaanagccaccctctcctgcagggccagtcagagtatgacagcaagttagcctggtaccagcagaaacctggccagacctcccagactcgtcatcttgctacntcngccaggccatggcatccagccacgttcagtgcagtgggtctgggacagagttcattcncacatcagcagcctgcagtctaggaatatttgactagttttatacgtgtacagctaagtactaagtgtaacctggtaccctcggtaccgttccgggaccgaaacggggaccaaagggtggaaactacaaaacgacgttggnggtacctaggaccaacctgtccgttcg

SEQ ID NO: 250915 - DNA, 561 bp, Homo sapiens
  misc_feature: GYAE6OF01CR66Y.15.49.E05.1.454.CMB.1.raw
  modified_base (209)..(209): a, c, t, g, unknown or other
  misc_feature (209)..(209): n is a, c, g, or t
  modified_base (378)..(378): a, c, t, g, unknown or other
  misc_feature (378)..(378): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgagggggaaaancgccaccctctcctgcagggccagtcagagtatgacagcaagttgcctggtaccagcaagaaacctggccagacctccagactcgtcatctttgctacatctgccagggccacgtggcactcccagcccaacgttcagtggctaggtggctgggacagacgttcattcncaccatcagcagcctgcagtctagaagttatttcgactagtttattactgtacagtactaagttataatgtaactcggtaccctaccggtacgttcggtacccgaaacgggaccgaaagggtacggtaaaatccgtaaaacgaccgtaggtaccggtacgtacgaccaacctagttcttacgg

SEQ ID NO: 250916 - DNA, 508 bp, Homo sapiens
  misc_feature: GYAE6OF01A7MY6.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaacctggccagactccagactcgtcatctttgctacatctgccagggccactggcatcccagccacgttcagtggcaggtgggtctgggacaggagttcattctacaccatcagcagcctgcagtctgaagtatttgctagtttattactgtcagctagtataatgactcggcctcgacgtcgaccgacgggaccaaggtacgaatacgaaacgtactgtacggtctagacacctatcgtcg

SEQ ID NO: 250917 - DNA, 597 bp, Homo sapiens
  misc_feature: GYAE6OF01AIOKY.15.49.E05.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaangccaccctctcctgcagggccagtcagagtatgacagcaagttagcctggtaccagcagaaacctggccagacctcccagactcgtcattcttgctacntctcgccagggccactggcactcccagcctacgttcgaggtcggcagggtcgggtctggggaacaggtacgtttcactttccnccaacctntaccagccacgtcctgacctacgttctagtaagttagttttgacgtttagttttacttacgttcgtactagtacgtaaggttataagtacgtaccgtcggtaccctaccggtaccggttccggaaccgtaacgggaccgtaagggtacgaaactaccggaaacgtacgtaggtacggaccgtacgacctacctagttcgtacg

SEQ ID NO: 250918 - DNA, 504 bp, Homo sapiens
  misc_feature: GYAE6OF01AGW94.15.49.E05.1.454.CMB.1.raw
  modified_base (206)..(206): a, c, t, g, unknown or other
  misc_feature (206)..(206): n is a, c, g, or t
  modified_base (498)..(498): a, c, t, g, unknown or other
  misc_feature (498)..(498): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtattgacagcaagttagcctggtaccagcagaacctggccagactccagactcgtcatcttgctacatctgccagggccactggcatcccagccacgttcagtgcagtgggtctgggacagagttcattctcacatcagcagcctgctagtctagagtatttgctagtttattactgtcagtcagtataatgactggcctcgtacgttcggacgaacgggaccaaggtacggtaatacgaaacgacgtagtcgtctgaccacntcgtcg

SEQ ID NO: 250919 - DNA, 498 bp, Homo sapiens
  misc_feature: GYAE6OF01A3KNI.15.49.E05.1.454.CMB.1.raw
  modified_base (492)..(492): a, c, t, g, unknown or other
  misc_feature (492)..(492): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatcttgctacatctgccagggccactggcatcccagccacgttcagtggcagtgggtctgggacagagttcattctcaccatcagcagcctgcagtctagagtattttgctagtttattactgtcagcagtataatgactgcctcgacgttcggaccgaggaccgaaggtgaatacgaaacgactgtcggtctgacacntcgtcg

SEQ ID NO: 250920 - DNA, 494 bp, Homo sapiens
  misc_feature: GYAE6OF01CFVRA.15.49.E05.1.454.CMB.1.raw
  modified_base (205)..(205): a, c, t, g, unknown or other
  misc_feature (205)..(205): n is a, c, g, or t
  modified_base (487)..(487): a, c, t, g, unknown or other
  misc_feature (487)..(487): n is a, c, g, or t
tcagtctacgtagccacgaccggtgctcgatttagagcgactagcaatacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagtattttgctagtttattactgtcagctagtataatgactgcctcgacgttcgcaacgggaccaggtgaatacaacgactgtggctgacaccntcgtacg

SEQ ID NO: 250921 - DNA, 528 bp, Homo sapiens
  misc_feature: GYAE6OF01CLHQU.15.49.E05.1.454.CMB.1.raw
  modified_base (205)..(205): a, c, t, g, unknown or other
  misc_feature (205)..(205): n is a, c, g, or t
  modified_base (378)..(378): a, c, t, g, unknown or other
  misc_feature (378)..(378): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagacctcccagactcgtcatctttgctacatctgccagggccacgtggcactcccagcctacgttcaggtcggcaggtcgggtctgggacagtagttcattcncaccatcagcagcctgcagtctagaagtattttgactagtttattactgtacagtctagtatatgactggcctcgacgttccggacgaacgggaccgaaggtacggaaatacgaaacgtacgtggtacgctacgaccacctgttcgttcg

SEQ ID NO: 250922 - DNA, 524 bp, Homo sapiens
  misc_feature: GYAE6OF01CP8XA.15.49.E05.1.454.CMB.1.raw
  modified_base (206)..(206): a, c, t, g, unknown or other
  misc_feature (206)..(206): n is a, c, g, or t
  modified_base (372)..(372): a, c, t, g, unknown or other
  misc_feature (372)..(372): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtattgacagcaagttagcctggtaccagcagaaacctggccagactcccagactcgtcatctttgctacatctgccagggccactggcatcccagccacgttcagtggcaggtgggtctgggacagtagttcattcncaccatcagcagcctgcagtctgaagtattttgctagtttattactgtcagctagttataatgactggccctaccggacgttccggaccgaaacgggaccgaaagggtcggaaatacgaaacgtaactgtaggctacgacacctgtcgttcg

SEQ ID NO: 250923 - DNA, 605 bp, Homo sapiens
  misc_feature: GYAE6OF01BRPC8.15.49.E05.1.454.CMB.1.raw
  modified_base (209)..(209): a, c, t, g, unknown or other
  misc_feature (209)..(209): n is a, c, g, or t
  modified_base (398)..(398): a, c, t, g, unknown or other
  misc_feature (398)..(398): n is a, c, g, or t
  modified_base (444)..(444): a, c, t, g, unknown or other
  misc_feature (444)..(444): n is a, c, g, or t
tcagtctacgtagccacgaccggtgctcgatttagagcgactagcaacacgtacgaaagggggaggaactgctcagttaggacccagacggaaccatggaagccccagcgcagccttctcttcctcctgctactctggctcccagataccactggagaaatagtaatgacgcagtctccagccaccctgtctgtgtctccgaggggaancgccaccctctcctgcgagggccagtcagagtattgacaggcaagttgcctggtaccagcagaacctggccagacctccagctcgtcatctttgctacatctgccagggccacgtcggcactcccagtcctacgttccaaggttcgggactaggtcgggtctaggggactagggtagtttcacgtttcnccgaaccgatacacgtccacgtcctcgactagttcctaggtaagtnttttacgacttaggtttattactgtacgtagtctaagttactaagttacgacttcggaccttacccggtacggttaccggtaccgtaacgggaaccctaacgggttacgaaacgttaccggaaacgtacgtggacgtcgtacggactacctagtcgttacg

SEQ ID NO: 250924 - DNA, 498 bp, Homo sapiens
  misc_feature: GYAE6OF01DJPK6.15.49.E05.1.454.CMB.1.raw
  modified_base (372)..(372): a, c, t, g, unknown or other
  misc_feature (372)..(372): n is a, c, g, or t
  modified_base (491)..(491): a, c, t, g, unknown or other
  misc_feature (491)..(491): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcactcccagccacgttcagtggcaggtgggtctgggacagagttcattcncacatcagcagcctgcagtctagaagtatttgctagtttattactgtcagctagtatatgactgcctcgcgttcgacagggaccaaggtgaatacgaaacgacgtgacggtctagcacngtcgtcg

SEQ ID NO: 250925 - DNA, 529 bp, Homo sapiens
  misc_feature: GYAE6OF01DI2S3.15.49.E05.1.454.CMB.1.raw
  modified_base (206)..(206): a, c, t, g, unknown or other
  misc_feature (206)..(206): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaanagccaccctctcctgcagggccagtcagagtattgacagcaagttacgcctggtaccagcagaaacctggccagacctcccagactcgtcatctttgctacatctgccgaggccacgtggccactcccagcctacgttcaggtggctaggtcgggtctggggacngtagtttcagttcacacntcgagcacgcctgctagtctagtagtntttagcttatttatactgtcagtctatatatgtactcgtcctccgtacgttcgaccgaggaccaagggtacgaatacgaacgtacgtgtacggctacgacctctagtcgtacg

SEQ ID NO: 250926 - DNA, 569 bp, Homo sapiens
  misc_feature: GYAE6OF01DUYSM.15.49.E05.1.454.CMB.1.raw
  modified_base (205)..(205): a, c, t, g, unknown or other
  misc_feature (205)..(205): n is a, c, g, or t
  modified_base (421)..(421): a, c, t, g, unknown or other
  misc_feature (421)..(421): n is a, c, g, or t
  modified_base (560)..(560): a, c, t, g, unknown or other
  misc_feature (560)..(560): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaangcccaccctctcctgcagggccagtcagagtattgacagcaagttagcctggtaccagcaagaaacctggaccagactcccagactcgtcatctttgctacatctgccgacgggccacgtggcactcccagcctacgttcaggtggctaggtgggtcgtgggacaggtagttctatttcacaccatccaggccagtcctgctacgtctgaacgttnttttcgacttaagttttatacgtgttacagtactagttaattaagtcgtacttcggcccgttacggtacggttccgaccggtaaaggaccgtaagggtacgaaatacgaaacgtaacgtgtacggtcctagccctaacncgttgtacg

SEQ ID NO: 250927 - DNA, 737 bp, Homo sapiens
  misc_feature: GYAE6OF01CC16R.15.49.E05.1.454.CMB.1.raw
  modified_base (209)..(209): a, c, t, g, unknown or other
  misc_feature (209)..(209): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaattgacgcagtctccagccaccctgtctgtgtctccgaggggaaagngcccacccgtcgtcctgcgacgggccagtcgagagtatgacagcaagttacgcctggtaccagccaagaaaccctggaccctagacctcccgagactcgtcatttcgtttcgcctacacttcctggccgaggggccctacgtggccactcccagtccctacgttcaggttcggactagggtcgggtctaggggactaggtacgtttcacgtttccacaaccgacgtccgacggccgtaacggtccctacgaccgtaggttaccttaaggtaaacggtttactttttacggaccgtttaagtttttacgtttaccgttgttacccaggttaacctaagttaacgttaaagttcggtaaccgttcgggtaccccgttaccgggtaaccgggtttacccgggaacccggtaaaccggggtaacccgttaaaggggttaacggttaaaacttaaccggtaaaaacccgggttacgttacggggttaacggtaccgttacggacccgttaacccgttaggttccgtttaccgg

SEQ ID NO: 250928 - DNA, 556 bp, Homo sapiens
  misc_feature: GYAE6OF01CEPVG.15.49.E05.1.454.CMB.1.raw
  modified_base (205)..(205): a, c, t, g, unknown or other
  misc_feature (205)..(205): n is a, c, g, or t
  modified_base (418)..(418): a, c, t, g, unknown or other
  misc_feature (418)..(418): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaangccaccctctcctgcagggccagtcagagtattgacagcaagttagcctggtaccagcaagaacctggccagacctcccagactcgtcatctttgctacatctgccagggccacgtggcactccccagcccgtacgttcaggtcggctaggtcgggtctgggacagtacgttcagttcaccaccatcacgcacgcctgctagtctagaagttntttgcttagtttacttactgtacagtctagtatagtgactcggtcctccggtacggttcggaccgtaacgggaacctaagggtacgtaaacgtacgaaacgtacgtagtcggtactacgaccgtactagtcgttaccg

SEQ ID NO: 250929 - DNA, 562 bp, Homo sapiens
  misc_feature: GYAE6OF01D0IC6.15.49.E05.1.454.CMB.1.raw
  modified_base (206)..(206): a, c, t, g, unknown or other
  misc_feature (206)..(206): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaanacgccacctctcctgcagggccagtcagagtattgacagcaagttgcctggtaccagcagaacctggccagactccagactcgtcatctttgctacatctgccagggccactggcactcccagcctacgttcagtcggcagtgggtctgggactagagttcagtttctcaccatcagcagcctgcacggtctcgtaagttattttcgcgtaagttttacttacttggtactagactaggttaattaacgtgactcggtccctccggtacggttccggaccgaacgggaaccgtaagggtacggaaaatacggaaaaccgtaacgtggttacgcttacggcctaacctgtcgttacg

SEQ ID NO: 250930 - DNA, 545 bp, Homo sapiens
  misc_feature: GYAE6OF01DN37E.15.49.E05.1.454.CMB.1.raw
  modified_base (206)..(206): a, c, t, g, unknown or other
  misc_feature (206)..(206): n is a, c, g, or t
  modified_base (339)..(339): a, c, t, g, unknown or other
  misc_feature (339)..(339): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaanagcccaccctctcctgcagggccagtcagagtattgacagcaagttagcctggtaccagcaagaaacctggccagacctcccagacctcgtcatctttgctacatctgccagggccagtggcactcccagtcncgttcagtggctaggtgggtctggggacaggtagttcatttctacaccatcagcagcctgctagtctagaagtattttgctagttttattacgtgtcagtactagttataagtgtactggtacccttcgacggttccggaccgaagggacctaagggtacgaaatacgaaacgtacgtggtacggtctacgacaacctgtcgtacg

SEQ ID NO: 250931 - DNA, 528 bp, Homo sapiens
  misc_feature: GYAE6OF01BKSNH.15.49.E05.1.454.CMB.1.raw
  modified_base (375)..(375): a, c, t, g, unknown or other
  misc_feature (375)..(375): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcaagaaacctggccagacctcccagactcgtcatctttgctacatctgccagggccacgtggcactcccagccacgttcagtggcaggtgggtctgggacagagttcattcncaccatcagcagcctgctagtctagaagtattttgctagtttattctgtcagtcagtatatgtactggcctccgtacggttcggaccgaacgggacctaagggtacggaaatacgaaacgtacgttaggtcggactagaccacctgtcgttcg

SEQ ID NO: 250932 - DNA, 533 bp, Homo sapiens
  misc_feature: GYAE6OF01BIOW2.15.49.E05.1.454.CMB.1.raw
  modified_base (205)..(205): a, c, t, g, unknown or other
  misc_feature (205)..(205): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
  modified_base (527)..(527): a, c, t, g, unknown or other
  misc_feature (527)..(527): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagactcccagactcgtcatctttgctacatctgccagggccactggcatcccagccacgttcagtggcaggtgggtctgggacagagttcatttcncaccatcagcagcctgcagtctagaagtnttttgacttagtttacttactgtcagtctaagttataatgtactcggtcccgtccgtaccggttcggaccgaagggacctaagggtacgaaatacgaaacgacgtggtacggtctacgaccacctntcgtcg

SEQ ID NO: 250933 - DNA, 582 bp, Homo sapiens
  misc_feature: GYAE6OF01EXDBY.15.49.E05.1.454.CMB.1.raw
  modified_base (207)..(207): a, c, t, g, unknown or other
  misc_feature (207)..(207): n is a, c, g, or t
  modified_base (407)..(407): a, c, t, g, unknown or other
  misc_feature (407)..(407): n is a, c, g, or t
  modified_base (573)..(573): a, c, t, g, unknown or other
  misc_feature (573)..(573): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaggggaaangccaccctctcctgcagggccagtcagagtattgacagcaagttagcctggtaccagcagaaacctggccagacctccagactcgtcatctttgctacatctgccagggccacgtgcactcccagccacgttcagtcggcaggtcgggtctgggatagagttcattctcacatcagcagcctgctagtcctaggaagttnttttcgcttagtttaatttacgttcgtacgagcgtaagttaattaagtagaaccgttcggtacccttccgggtaaccgttcgggacccgtaaacggggaaccgtaaacgggtaggaaactacgaaaacggtaccgttagtacggtaccgttacgaccctaaccgtnttccgttcg

SEQ ID NO: 250934 - DNA, 525 bp, Homo sapiens
  misc_feature: GYAE6OF01DW2M3.15.49.E05.1.454.CMB.1.raw
  modified_base (206)..(206): a, c, t, g, unknown or other
  misc_feature (206)..(206): n is a, c, g, or t
  modified_base (518)..(518): a, c, t, g, unknown or other
  misc_feature (518)..(518): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaangcccaccctctcctgcagggccagtcagagtattgacagcaagttgcctggtaccagcagaacctggccagactcccagactcgtcatctttgctacatctgccagggccactcggcactcccagcctacgttcagtggcaggtgggtctggggacagtagttcattctacaccatcagcagcctgcagtctgtagtatttgcttagtttattacgtgtcagtactagtataatgtacgtcgtcctcgtacgtcggaccgaagggacctaagggtacgtaaatacgaaacgacgtggtacgctacgccactntcgtacg

SEQ ID NO: 250935 - DNA, 568 bp, Homo sapiens
  misc_feature: GYAE6OF01BF8XW.15.49.E05.1.454.CMB.1.raw
  modified_base (207)..(207): a, c, t, g, unknown or other
  misc_feature (207)..(207): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaggggaaanagcccaccctctcctgcagggccagtcagagtattgacagcaagttagcctggtaccagacagaaacctggccagacctcccagactcgtcattcttgctacatctgccagggccagtggcactcccagccacgttcagtggcaggtgggtctgggacagagttcattcctcaccatcagcacgcctgctagtctaggaacgtattttgcttagtttattacgtgtacgagtactagttaataagtacgtaccgtcggtcccgtaccggtaaccggttcgggaccgtaacggggtaaccgaaagggtacggaaataccgaaaacgtacgtagtacggtactacgaccacctacgtcgttcg

SEQ ID NO: 250936 - DNA, 554 bp, Homo sapiens
  misc_feature: GYAE6OF01B0645.15.49.E05.1.454.CMB.1.raw
  modified_base (208)..(208): a, c, t, g, unknown or other
  misc_feature (208)..(208): n is a, c, g, or t
  modified_base (350)..(350): a, c, t, g, unknown or other
  misc_feature (350)..(350): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagcccaccctgtctgtgtctccgaggggaaangccaccctctcctgcagggccagtcagagtattgacagcaagttagcctggtaccagcagaaacctggccagactcccagactcgtcatctttgctacatctgccgagggccactggcactcccagcctacgttcagtggcnggtgggtctggggacagtagttcatttcacaccatcagcagcctgctacgtctaggtaacgttagttttcgcttaagtttattacgttagtcaggtctaagtattaagtgtaccgtggccctccggtacggttccggaccgaacgggaccgtaaggtacggaaactacgaaacgacgtggtcggtctcgacacctagtcgttcg

SEQ ID NO: 250937 - DNA, 543 bp, Homo sapiens
  misc_feature: GYAE6OF01EZ12L.15.49.E05.1.454.CMB.1.raw
  modified_base (376)..(376): a, c, t, g, unknown or other
  misc_feature (376)..(376): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccacgtggcatcccagccacgttcagtggcagtgggtctgggacagagttcattctcaccntcagcagtccctgcagtctagagtattttgacttagtttatttactgtcagtctaagtataatgactcggcctccggtacgtcggtaccgaaacgggtacccgtaaagggtcgtaaagtaccgaaaacggaaccgtggtacgggtctacgaccacctatccgttacg

SEQ ID NO: 250938 - DNA, 770 bp, Homo sapiens
  misc_feature: GYAE6OF01DIM03.15.49.E05.1.454.CMB.1.raw
  modified_base (215)..(215): a, c, t, g, unknown or other
  misc_feature (215)..(215): n is a, c, g, or t
  modified_base (436)..(436): a, c, t, g, unknown or other
  misc_feature (436)..(436): n is a, c, g, or t
  modified_base (756)..(756): a, c, t, g, unknown or other
  misc_feature (756)..(756): n is a, c, g, or t
tcagtctacgtagccacgaccggtgctcgatttagagcgactagcaacgacacaaagggggaggaactgactcagttaggacccagaccggaaccagtggaagccccagccgcagcttcctcttccctcctgctactctggctcccaggactaccactggagaaatagtaatgaccgcagtctccagcccaccctgtctgtgtctccgagggaancgcccaccctctcctgcagggccagtccagacgtatggaccaggactaaggttagccgtggtacccagccagtaaaccgtggaccaagaccctacccagtacctcgtccacttccgtttcgctacgatcgtcgaccgtacgggccctaacgtgggacctaaccgtaccccagtaccctacgtttccgacggttcggacggtaggtcgggtccgtagggacnggtacgttcgaacgtttccgacgaaccgtacgtaccgtagaccgtacggcccgttagggacccgtaacgggttaccgggtaacggttaacgtttacgttttacggaccgtttagtttttaaccgttttcgtacggttaccgtaacggtaccgtaaggttaaccgttagtaccggttaccgttcccggttacccttacccgggttaccggtaccccgggtaaccgaaaaccggggtacccgtaaacgggttaccggaaaccttaccggtaaacccggtaacggtccgggttaccggacggtacccgtaccgaacccggttnttcccggttacccg

SEQ ID NO: 250939 - DNA, 562 bp, Homo sapiens
  misc_feature: GYAE6OF01ES3LP.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccatggcatcccagccacgttcagtgcagtgggtctgggacaggagttcattcctcaccatcagcagcctgctagtctagaagtattttcgactagttttacttactgttcagtctaagttataagttgtacgtcggtcccgtccgaccgttcgggacccgtaaaggggaaccctaaggggtacggaaattacgaaaaccggtaaacgtcggtacggtaccgtacggacctaaccgtacgtcgttcg

SEQ ID NO: 250940 - DNA, 724 bp, Homo sapiens
  misc_feature: GYAE6OF01DDBPO.15.49.E05.1.454.CMB.1.raw
  modified_base (207)..(207): a, c, t, g, unknown or other
  misc_feature (207)..(207): n is a, c, g, or t
  modified_base (316)..(316): a, c, t, g, unknown or other
  misc_feature (316)..(316): n is a, c, g, or t
  modified_base (377)..(377): a, c, t, g, unknown or other
  misc_feature (377)..(377): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaancgcccaccctctcctgcgagggccagtcagagtatgacagacaagttagcctggtaccagcaagaaacctggaccagacctcccagacctcgtcattcttgctacatcncgccagggccacgtggcaactcccagcctacgttcgaggttggactagggttcgggtacgnggggaacagggttagttcctaactttccacctaacctacgtaccgacgaccgtacgtccgtacgtcgtaacggttcgtaaggtaaacggttacgttttttacgggaaccgtttaaggttttttaactttacgttacgttaccggtaagtaacgttaaggttaaacttaaaggttcggtaacccggttcgggttaccccgtttacccgggtaaccggtttaccccgggaaaccgggtaaaaccggggtaaccgtaaaagggggtaacggtaaaacgttaaccggaaaaaccgggtaacgttacgggtacggtaccgtacggtaacctacccgtagtttcccggttacg

SEQ ID NO: 250941 - DNA, 520 bp, Homo sapiens
  misc_feature: GYAE6OF01DU03P.15.49.E05.1.454.CMB.1.raw
  modified_base (206)..(206): a, c, t, g, unknown or other
  misc_feature (206)..(206): n is a, c, g, or t
  modified_base (412)..(412): a, c, t, g, unknown or other
  misc_feature (412)..(412): n is a, c, g, or t
  modified_base (449)..(449): a, c, t, g, unknown or other
  misc_feature (449)..(449): n is a, c, g, or t
  modified_base (514)..(514): a, c, t, g, unknown or other
  misc_feature (514)..(514): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaanagccaccctctcctgcagggccagtcagagtattgacagcaagttagcctggtaccagcaagaaacctggccagactcccagctcgtcatctttgctacatctgccagggcctacgtggcactcccagcctacgttcaggtggctaggtcgggtctgggacagtagttcattccacaccatcgagcacgcctgcagtctagaagtnttttgcttagtttacttactgtctagctagtatagtnacgtcggcctcgtacgtcgacgaaggaccgaaggtacgaatacgaaacgactgcgtctcgacacntcgtcg

SEQ ID NO: 250942 - DNA, 740 bp, Homo sapiens
  misc_feature: GYAE6OF01C7TWF.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagcgccaccctctcctgcagggccagtcagagtatgacagcaagttcgctggtaccagcagaacctggccagacctccagactcgtctattctttgctacatctcgccacggccactggcactccagcctacgttcagtcgcgtaggtcggtcgtgggactaggttacgttcgtactttcccgtacgaacctagtccaacggtacccgtaacgtcccgttacgaccgttaacgttaccggtaaggttaaacgttttacgtttttcggaaaccgttttacgggttttttaactttaacccggttaggttaccgtaaacgggttaacctttaaaggttaaacgttaaacgttcggttaaacccgttcggtacccccggttaccggggtaacggtttaccccggggaacccggtaaaacgggggtaacccgtaaaacggggggtttaacgaaaaccgtttaaacccggaaaccgggttaacgttacggggtaccggtaaccgttaccgacccgtaaacccttggtttacccgtttaccg

SEQ ID NO: 250943 - DNA, 631 bp, Homo sapiens
  misc_feature: GYAE6OF01EEUE0.15.49.E05.1.454.CMB.1.raw
  modified_base (206)..(206): a, c, t, g, unknown or other
  misc_feature (206)..(206): n is a, c, g, or t
  modified_base (387)..(387): a, c, t, g, unknown or other
  misc_feature (387)..(387): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaancgccaccctctcctgccagggccagtcagagtattgacagcaagttacgcctggtaccagcaagaaacctggccagacctccagactcgtcatcttgctacatctgccagggccacgtcggctactcccacgcctacgttcagtggcgagttcgggtctgggactacgtagttctagttcnctacactcgacgcacgtcctacgcgtacgtcgtaagtaacgttagttttcgaccgttttagtttactttacgtacgttaccgtagtacgtaagttaacttaacgttcgtaacgttccggtacccgttaccggtaaccggttccgggaaccgaaggggtaacccgtaagggggtacgtaaacgttaccgaaaacggaccgttacggacggtaccgttacgaccccgttaagtccttcgttaccgg

SEQ ID NO: 250944 - DNA, 512 bp, Homo sapiens
  misc_feature: GYAE6OF01ATTMU.15.49.E05.1.454.CMB.1.raw
  modified_base (205)..(205): a, c, t, g, unknown or other
  misc_feature (205)..(205): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagactcccagactcgtcatctttgctacatctgccagggccactggcatcccagccacgttcagtggcaggtgggtctggacagngttcattctcacctntcagcagcctgcagtctagagtntttgctagtttntactgtcagctagtataatgactcgtccgtcgtacggttccgacgaaagggaccgaagggtgaaactacgaaacgtactgtaggtctggacacgatcgtcg

SEQ ID NO: 250945 - DNA, 626 bp, Homo sapiens
  misc_feature: GYAE6OF01DQ14S.15.49.E05.1.454.CMB.1.raw
  modified_base (207)..(207): a, c, t, g, unknown or other
  misc_feature (207)..(207): n is a, c, g, or t
  modified_base (348)..(348): a, c, t, g, unknown or other
  misc_feature (348)..(348): n is a, c, g, or t
  modified_base (392)..(392): a, c, t, g, unknown or other
  misc_feature (392)..(392): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggaagaaatagtaatgacgcagtctccagcccaccctgtctgtgtctccgaggggaancgccaccctctcctgcgagggccagtcagtatatgacagctaagttagcctggaccagcaagaacctggccagactcccagtacctcgtcagttcttcgactacatctcgccaggccagtcgcactcccgagcctacgttnagtgctaggttcgggctgggactgtagttcagttcctcggactntccgtagctacgtcctgaccgtagtcgtagtaagttagttttcgaaccgtttaagttttacgtacgttgaccgtaagtcttaaacgtaacgtttaacgtcgtaccggttaccggtcccttaccgggttaaccgttaccgggaaccgttaaacggggaaacccgttaagggtacgaaacttaacggaaacggtacgttaggtcggaccgttacgacctaacttagttcgttaccg

SEQ ID NO: 250946 - DNA, 666 bp, Homo sapiens
  misc_feature: GYAE6OF01B6SY2.15.49.E05.1.454.CMB.1.raw
  modified_base (206)..(206): a, c, t, g, unknown or other
  misc_feature (206)..(206): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaancgccaccctctcctgcagggccagtcagagtatgacagcaagttagcctggtaccagcagaaccgtgccagactaccagactcgtcatctttgactacactctcgccgacgggccacgtcggcactcccacgccctacgttcaggtcggctaggtcgggtcgtaggggaactaggtacggtttccactttccgtaccaaccgtaactcgacgaccgtacgtcctacggacctacggttaccgtaggtaagttacgtttttacggacgtttaacgttttatttaacgttcgttacgtacggtacgtaaggttaacttaagtacggtaccgttcggtaccccgttaccggtaccggttacccggaaccggtaaacgggtaaccgtaaagggttaacgtaaacgtaacgtaaaacggttacgtacggtacggtacgtacgacctaaccgtacgttcgttaccg

SEQ ID NO: 250947 - DNA, 695 bp, Homo sapiens
  misc_feature: GYAE6OF01ACGFM.15.49.E05.1.454.CMB.1.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaangccacctctccngcagggccagtcagagtatgacagactaagttagcctggtacccagaccgacgaaacctggccacgacctccccgagactcgtacattcttagctacatctcgaccgagggccaacgtcggactactcccgacgtccgtaacgtttcgaaggttcgggacctagggtcgggttacctggggtaacctaggtacgtttccagtttccctacaaccctagtaccgaggccgaacggtccccgtaggtaccgtacggtaccttaaggtaacgtttagtttttcgaccgtttaggttttaccttaacgttcgtacgtaacgtacgtaaggttaaccttaagtaccggtaccgttcgggaccccgttacccggacgggttacccggaaccggtaaacggggaacccgtaaaggggtacgaaaactaccggaaacgtaccgttagggacgtccgtaagaacccgtacctaaggttcgtttaccg

SEQ ID NO: 250948 - DNA, 636 bp, Homo sapiens
  misc_feature: GYAE6OF01B01NG.15.49.E05.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaangccaccctctcctgcagggccagtcagagtattgacagcaagttagcctggtaccagcagaaacctggccagacctccagctcgtcatctttgctacntctgccgagggccacgtggcactcccgacgccacgttcagtcggcaggtcgggtcgtcggggaactagtacggtttcagtttcctactacccactcacggtccgacgtcccgtgcctagtctagtaagttagttttgaccttaggttttactttacgttgtccgtagtacgtaagttacttaagttacggtacgttacggcccgttaccccggtaggtttcccggggacccgtaaacggggtaccctaaagggggttacggaaaacgttaccgtaaaacccgggaacgttgggtacggaccgttacggacccgtaaccctagttccgttaccg

SEQ ID NO: 250949 - DNA, 646 bp, Homo sapiens
  misc_feature: GYAE6OF01EQGJN.15.49.E05.1.454.CMB.1.raw
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagcgcccaccctctcctgcagggccagtcagagtatgacagcaagttagcctggtaccagcagaacctggccagactccagctcgtcattcttgctacntctgccngggccactggcactcccagcctacgttcgagtcggacgtaggtcgggtcgtggggacaggtacgtttacgatttccgtaccacctatacgacgccacggtccctggacctaggtcttaggtaacgttagttttcgacgtttaagttttatttacgttcgttacctagacgttaagttacgtttaagtcggtaccgttccgggtacccgttaccggtaaccggtttccgggaacccgtaaacggggtacccgtaaaggggttacgaaaacgtaaccggtaaaacggtaccgttagggtacggtaccgtacgtacccgtaacccgtagttccgttacg

SEQ ID NO: 250950 - DNA, 758 bp, Homo sapiens
  misc_feature: GYAE6OF01DCQP6.15.49.E05.1.454.CMB.1.raw
  modified_base (215)..(215): a, c, t, g, unknown or other
  misc_feature (215)..(215): n is a, c, g, or t
  modified_base (472)..(472): a, c, t, g, unknown or other
  misc_feature (472)..(472): n is a, c, g, or t
tcagtctacgtagccacgaccggtgctcgatttagagcgactagcaacacacgaaagggggagaactgctcagttaggacccagacggaaccatggaacgccccagcgcagcttctcttcctcctgctactctggctcccagactacccagtggaagaaatagtaatgacgcagtcctccagcccacctgtctgtcgtccacggaaggggaaacnccgccctacccgtctcccgtgacgacgggcctagtcaaggtagtacttagacagacgtaaaggttccgccgtaggtaacccaggaccgaaacggaaacccgtcgggacccaacgtaccctacccaggtaccttcgtactactttccgtttacgcctaacacgttccgacggacccgtaccgggaccctaccggttggaccctaaccgtccccgaagtcccgtaacgttcgagggtcgggacgtaggttcgggtacgnggggtaactaggttaccgttctaccgttccgtacgaacctagtaccgacgaccgtacgtcccgtagtaaccgttacggtcgttaaacggaagttttcgttttacgacgttttaaagttttacgtcgtagttacccgaaggttacttaaggttaacttacggtcgtaccgttcggtaccccgtaggtaacccggtacgggaacgtaaacgggaaccgtaagggaacgtaaacaaccggtaaacgttcgtagggtcccgacggactacccgtacgttgtcggttaacc

SEQ ID NO: 250951 - DNA, 569 bp, Homo sapiens
  misc_feature: GYAE6OF01C6Z53.15.49.E05.1.454.CMB.1.raw
  modified_base (207)..(207): a, c, t, g, unknown or other
  misc_feature (207)..(207): n is a, c, g, or t
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
  modified_base (402)..(402): a, c, t, g, unknown or other
  misc_feature (402)..(402): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaggggaaangccaccctctcctgcagggccagtcagagtattgacagcagttagcctggtaccagcaagaacctggccagactccagctcgtcatcttgctacntctgcagggcccactggcactcccagccacgttcagtggcaggtggtctgggacaggtacgttcattcncaccatcagcaggcctagcagtctgtaagtnttttgcttagttttacttacgtgtacagtactaagttactaatgtacgttcggtcccgtaccggtacgtttaccgggaccgtaaacgggtaccgaaaggggtacggaaactaaccgtaaaacgaaccgttggttaccggacgttacggactacccagttccgttacg

SEQ ID NO: 250952 - DNA, 536 bp, Homo sapiens
  misc_feature: GYAE6OF01D4VBV.15.49.E05.1.454.CMB.1.raw
  modified_base (517)..(517): a, c, t, g, unknown or other
  misc_feature (517)..(517): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagcgccaccctctcctgcagggccagtcagagtatgacagcaagttagcctggtaccagcagaaacctggccagacctcccagactcgtcattctttgctacatctgccgagggccacgtggcactcccagcctacgttcagtcggcgaggtcgggtcgtgggacaggtacgttcacttctccaccatcagcagcctgctagtctagaagttattttgcttagtttattactgtacagtctagtatatgtactcggtcctccgtacgttccggaccgaacgggaccgaaggtacggtaatacgaaacgagtgngtctcgacactgtcgttcg

SEQ ID NO: 250953 - DNA, 730 bp, Homo sapiens
  misc_feature: GYAE6OF01CN49Y.15.49.E05.1.454.CMB.1.raw
  modified_base (225)..(225): a, c, t, g, unknown or other
  misc_feature (225)..(225): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggaagaaatagtaatgacgcagtctccagcccaccctgtctgtgtctaccgaaggggaaagagcccaccctctccngcgagggccagtcagagtatgacagacaagttacgcctaggtaccagacgaagaaaccgtggaccaacgacctacccgagacctcgtactattcgtttgctacatctgccgacgggccacgtgcactcccacgcctacgttcgagtcggacgtagggttggggtcgtacggggaacgtaggtacgttacgtactttacctaccaacccacgttaccgaacggcctacggtacccttaggtaccgtagtttaccgtaggtaaaaggttttgttttttagaaccgttttagtttttaaaccgtttacgttacggtaaccgaacggtaccttaaagggtttaaattaaagtaccgggttaccgtaccggggtcccccgtttacggaacccgggtttacccggaaccgggaaaccggggtaaacccgtaagggggttaaacgaaaaacgtaaccaaaaccgggttacgttcgggaacggtcctacgacccgaaaccttgttcgttaccg

SEQ ID NO: 250954 - DNA, 619 bp, Homo sapiens
  misc_feature: GYAE6OF01C8M97.15.49.E05.1.454.CMB.1.raw
  modified_base (206)..(206): a, c, t, g, unknown or other
  misc_feature (206)..(206): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagactaccactggagaaatagtaatgacgcagtctccagccaccctgtctgtgtctcgaggggaaanacgccaccctctcctgccgagggccagtcagagtattgacagcaagttacgctaggtaccagcaagaaaccgtggaccaagacctaccccagacctcgtcagttcttgactacatctgccagggcctagtggcactccagcctacgttcgaggtgcgtaggtcgggtctagggacaggtattcgaatttccgacaccactacgacgacacgctcgctagtcgtagtaagtagtttacgacttagtttattactacgtcaagactaagtacgtaagtcgtacgtacgtacccgtaccggtaccggtttaccggaccgaaaccgggtaaccggtaaggtaaacggtaaacgttaacggtaaaaaccggtaacgttaggtacggtacgttacgaccttaacccgtcgttcttacgg

SEQ ID NO: 250955 - DNA, 777 bp, Homo sapiens
  misc_feature: GYAE6OF01AOC7E.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaaggggaaagacgcccaccctctcctgccgagggccagtcagatattgacagctaagttcgcctggtaccagcaacgaaacctggaccagaccctcccagacctcgtctattctttcgctacactcgtcgaccgacgggtcccacgtcggtacctacgtcccgaacgtccgtaacggtttcgaaggtccgggtacgagggtttcgggtccgtagggacctaggtacgtttcgactttccaccgaacctagtccgaacgtccgaccgtaccgttcggaccttacggttaccttaagggttaaacgtttacgtttttacgaccgttttaaaggtttttaaccttacgtttcggtaccgaaggttaccttaaagggtttaacctaaaggtttccggtaaccgggttcggtaccccgtttaccgggttaacccggtttaccggggaaccgggtaaaacggggttaaacccggtaaaaggggttaaccggtaaaaccgttaaacccggtaaaaccgggttacggttaaccgggtacggttaccctacgggaccccgtaaccgtttaccgttcgtttaaccccgg

SEQ ID NO: 250956 - DNA, 615 bp, Homo sapiens
  misc_feature: GYAE6OF01EOPED.15.49.E05.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaangcccaccctntcctgcagggccagtcagagtatgacngcaagttgcctggtaccagcagaaacctggaccagactcccagactcgtcatctttgctacntctgccagggccacgtggctactcccagccacgttccaggtcgccgtagggtcgggtcgtcggggactaggtagttctagtttaccctctacctatcctagacctagccttagcctaagtccgtagtaagttatttttcggacgtttagttttaacttacgttcggttacacgtactagttaaactaagtcgtaacgttcggtacccgttccggtaccgggttaccgaaccggtaaacgggtaaccgtaagggtacggtaaacgtacgaaaacgtacgtggtacggtcgtacgactaaccgtagtcgtacg

SEQ ID NO: 250957 - DNA, 778 bp, Homo sapiens
  misc_feature: GYAE6OF01AXUZ6.15.49.E05.1.454.CMB.1.raw
  modified_base (205)..(205): a, c, t, g, unknown or other
  misc_feature (205)..(205): n is a, c, g, or t
  modified_base (313)..(313): a, c, t, g, unknown or other
  misc_feature (313)..(313): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccacctgtctgtgtctccgaggggaaangccaccctctcctgcagggccagtcagagtatgacagcaagttagcctggtaccagcaagaaacctggaccagacctcccaggacctcgtcattcttgactacattcncgccgagggccacgtggaccactcccagccctaacggtttcaggtcggcgtagggtcggggtctaggggaactaggtacgtttccaacgtttcctaccgaaccctagttaccgaacgtaccgtaacggtcccgttacggaccgttaacggttacgttaacggtaaacgtttaacgttttttacggaaccgttttaaacggttttttaacgtttaaccggtttcggtttaaccgtaacggtttaaccgttaaaggttttaaacgttaaacggtttccggttaaacccggttcccgggttaccccgtttaccccggggttaacccggtttaaccggggaacccggtaaaccggggtaaacccgttaaaacgggggttaaacggtaaaacccgttaaccggtaaaaacccggtaacggttcgggtaccggtaccgtacggtaaccctaaccgttacgttccgttaccg

SEQ ID NO: 250958 - DNA, 846 bp, Homo sapiens
  misc_feature: GYAE6OF01A12GC.15.49.E05.1.454.CMB.1.raw
  modified_base (111)..(111): a, c, t, g, unknown or other
  misc_feature (111)..(111): n is a, c, g, or t
  modified_base (186)..(186): a, c, t, g, unknown or other
  misc_feature (186)..(186): n is a, c, g, or t
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
  modified_base (774)..(774): a, c, t, g, unknown or other
  misc_feature (774)..(774): n is a, c, g, or t
tcagtctacgtagccacgaccggtgctcgatttagagcgactagcaacacacaaagggggaggaactgctcagttaggacccagacggaaccatgggaaagcccccgagcncgacgtcttctccttccctccgtgcctactcgtcggtcctcccgatacctaccagtaggaaagtaaattagtaancgaccgctacgttccaccgacgacccctccgttgttcgtggtcgttaccaccgggaaaggggaaacnccgtacccctaccctcgttccgnggacggaccgggcctagtcgaaggtatttacgtacgaacgacgtaacgttaaaggtttccgaccggttacggtaaccgacgacgaaaaccgtaacgtcggaccagtaccctaccaaggtccttcgtacacttttcgtcgactactatcgtcgccgacggctaggcgacacctaccgacgtacctacggtacgagggtcgacgttaggggtcggttcgagggaacgtacggtcgtttacactttccgacctaaacgtacgtacggaacgtccgtaacgtcccggtacgtaccttaggttacctaagggttaaacgtttcgttttacgaaccggtttttaagttttaaccttcggttaacgtacgttaacggtaccgtttaaaggttaacttaacggtaccgggtaccgttaccgggtacccccggttaacgggttacccgggttacccggaaacccggggtaaaccggtaaccgggttaaacgggtaaaccggttaaanaaaccccggtaaaacggtcgggttagttacgggtaccgtacccggaccctaccttaggtttccttaacccgg

SEQ ID NO: 250959 - DNA, 586 bp, Homo sapiens
  misc_feature: GYAE6OF01B0E5Q.15.49.E05.1.454.CMB.1.raw
  modified_base (579)..(579): a, c, t, g, unknown or other
  misc_feature (579)..(579): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagacgcccaccctctcctgcagggccagtcagagtatgacagcaagttagcctggtaccagcagaaacctggccagacctcccagactcgtcatcttgctacatctcgccagggccacgtggccactcccagcctacgttcagtggctaggtcgggtctagggactaggtacgttcattccgtacaccctagtccagccacgtcctagacctagtactaggtaagttacttttcgacgtttagttttacttacgttgtaccagtctaagttaataagtcgtacgttcggtccctaccggtaccgttacggaccgtaaacgggtaccgtaagggtacgaaactacgaaacggacgtggtacggctacgaccacgtntcgtacg

SEQ ID NO: 250960 - DNA, 683 bp, Homo sapiens
  misc_feature: GYAE6OF01B6ZB7.15.49.E05.1.454.CMB.1.raw
  modified_base (205)..(205): a, c, t, g, unknown or other
  misc_feature (205)..(205): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaancgccacctctcctgcaggccagtcagagtatgacagcaagttagcctggtaccagtagaacctggaccagacctcccagacctcgtacattctttgacctactatcctaccgagggtccacgtggccactccccgagccctagttcgagtcggcgtagggtcgggtactggggaacctaggtagtttccgtaattccctacaacccgattcgacgtaccacggccctggcgtaacggtctaggttaaacgttacgtttttacggacttaaggttttaacttacggttacgtacgtaacggtacgtaagttaactaacgtacggtacgttccggtacccgttaccggttaccgggttaccggaaccggtaaacgggaacccgtaaaggggtaacggtaaacgtaaccggtaaaacgtacggttacggtacgggtaccgtacgtaaccgtaaccgttatccggtttaggtcctttaaccg

SEQ ID NO: 250961 - DNA, 603 bp, Homo sapiens
  misc_feature: GYAE6OF01DUUGB.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaggggaaagcgcccaccctctcctgcgagggccagtcagagtatgacagctaagttacgcctggtaccagacaagaacctggaccagacctccagactcgtcattcttgctacatcgtcgccacgggcctacgtcggcacgtcccgagcccacgttacgaggtcggcgtaggtcgggtcgtgggacagtacgttcacgttctacgactatcacgcacgtccgtgctagtcgtagtaagttatttgacttagtttaacttcgtatacagtctagtatagtacgactcggtcccgtaccggtacggttaccggaccgtaaacggggaacccgtaaagggtaacggtaaactacgtaaaacgggtacgtcgggtacggtacgtacgaaccacccgtattccgttaccg

SEQ ID NO: 250962 - DNA, 654 bp, Homo sapiens
  misc_feature: GYAE6OF01DA53Q.15.49.E05.1.454.CMB.1.raw
  modified_base (207)..(207): a, c, t, g, unknown or other
  misc_feature (207)..(207): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccacgtggagaaatagtaatgacgcagtctccagccaccctgtctgtgtctccgaggggaaanacgccaccctctcctgcagggccagtcagagtatgacagcagttagctggtaccagcagaacctggaccagacctccagactcgtcattctttgctacatctcgccaggccacgtgcacgtcccagcctacgttcaggtcggctagggtcgggtcgtgggactaggtcgttctattcctaccacctagtaccaggtaccacgtcctcggcgtaacgttccgtaaggtaacgtttacgtttttacgaccgttttaagttttacttacgttgttaccgtaggtaaccttaagttaacttaaagttcgaacccggtttcgacccgtttaccggtaccgggtttacccggaccggtaaacggggtaacccgtaaagggtacggtaaaatacccggaaaacggttaccgtaggtacggacgttaccgaccgtaacccttagttccgtttacg

SEQ ID NO: 250963 - DNA, 683 bp, Homo sapiens
  misc_feature: GYAE6OF01DHK58.15.49.E05.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagactaccactggaagaaatagtaatgacgcagtctccagccaccctgtctgtgtcnccgaggggaaancgcccaccctctcctgcgacggggtccaggtcagaggttattgaccagacaaggttacgccgtaggtacccagccgaacgtaaacccgtggacccaggacctacccacgactcgtactacttctttcgcctacatcgtcgccgtaggcctacgtggccactcccacgtccacgttcacggtcggcgtacggtgggtctaggggactaggtcgttactacttctccgaactgtaccgacggtcacgtaccgtagtacgtacgttacgtaaggtaacgttatttacggtatttaaggtttacttacgttggtacctagggtaactaaggtttactaacgttcgtaccgttccgtacccgttcccggttacgggtacccggtaacggaaccgggtaacgtaacggggtaacggtaaacacgtaaaaccggtacgtaacgggtacgtaccgtaccggaccaaccggttgtccgttaccg

SEQ ID NO: 250964 - DNA, 796 bp, Homo sapiens
  misc_feature: GYAE6OF01C5F6I.15.49.E05.1.454.CMB.1.raw
  modified_base (100)..(100): a, c, t, g, unknown or other
  misc_feature (100)..(100): n is a, c, g, or t
  modified_base (410)..(410): a, c, t, g, unknown or other
  misc_feature (410)..(410): n is a, c, g, or t
  modified_base (783)..(783): a, c, t, g, unknown or other
  misc_feature (783)..(783): n is a, c, g, or t
tcagtctacgtagccacgaccggtgctcgatttagagcgactagcaacacacaaaggggggaggaactgctcagttaggacccagacggaaccatggaanccccagcgcagcttctcttcctcctgctacctgtcgccaccgagactaccagtaggaaataaataagtaacgacgacgactacgtccaccgaccgcccctaccgttgtcgtgtacgtccgaacgggaaaaggggaaacgccgtaccctacccgttcctcgaggaccgggacgggacctaggtacgaaggtattacgtacgaacgacgtaacgttaagttaccggtacgtaaccggaaccgaagaaccgaaacggtaaccggcgaaccgactaccctaccgacgtacctcgtaacttctttctagacctanacgtcgcgaccggacgccagtcgacacctaccgaagccttacggtagaggtcgagtgggtacggtacggagtaacgtagtcttacgtacttaccggactaacgtactaccggaacggttccgaaccgtccggtaacgtacggtttaaacgtagggtttaaacgttaaacgtttttcggtttaacgtaaaccgtttttaaggtttacttacgggacgtaacgtaagttaacgttaaagttaacggtaaccgttccggaaccggttcccgttaacccggttacggaaccggggttaccggaaacggtaaacccgggtaagaaacgggttaaccgaaaacctaacgggtaacgtggtacggcacgtaactacccgnttacgttctaccg

SEQ ID NO: 250965 - DNA, 761 bp, Homo sapiens
  misc_feature: GYAE6OF01BLJGJ.15.49.E05.1.454.CMB.1.raw
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggaagaaatagtaatgacgcagtctccacgccacctgtctgtgtctccgaggggaagcgccaccctctcctgcagggccagtcagagtattgacagactaagttacgccgtaggtaccagacaacgaaacctcgggaccacgacctacccagtacctcgtacctacttcgtttacgaccttaactagttccgtcggacccgaacggggccctaacgttcgggacctaaccgtccccgaacgtccccgtaacggttcgaagggtcggacgtagggtttcggggtcggtacggggaacgtacggttacggtttacctacgtttccgtacctaacccgtagtaccgaacggccgtaaccggtcccgtaggtaccgtacggttaccgtaaggttaaagtttcgttttacgaacgtttttaagttttaacttacggtacgtaccgtacgtaacttaagttaacgtacgttacggtaccggttaccggttacccgtacccgggttacggttacccgggaaccggaaaccggggtaacgtaaaggggtaacggtaaaacctaccggtaaaacgtacggttaggacgtacgttacccacttaacgtcgttccgttaccg

SEQ ID NO: 250966 - DNA, 719 bp, Homo sapiens
  misc_feature: GYAE6OF01AZSQL.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaaggggaagacgcccaccctctcctgcagggccagtcagtagtattgacagcaagttacgccgtaggtaccagacgaacgaaacctggacctagacctcccaagtacctcgtacattctttcgacctactactcgtcggcccgacgggccctaacgtcgggacctacctaccccgacgtccctaacggttcgacggtcggaccgtagggttacgggtcgtacgggacgtaggttacgttactatttacccgtaccaacctacgtacgacgaccgtacggtccctacggacgtacgttacgtaggtaagtttacgtttttacggacgtttaacgttttaacttacgttgttaccgtaagactaagttaattaagtcggtacgttaccggtcccgttaccggtaaccgggttaccgggaacccggtaaacggggtaaccgtaaagggtaacggtaaaactaaccgtaaaacggttaccgtaggtacggtaccgttacggaacctaccgttaagttcgttaccg

SEQ ID NO: 250967 - DNA, 822 bp, Homo sapiens
  misc_feature: GYAE6OF01C768F.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagactaccactggaagaaatagtaatgacgcagtctccagcccacctgtctgtgttctcggaaggggaaacgcgcccacccgttctcctgccgaacggggcctacggtacaggtaagttattagacaggacctaagtttcgcctaggtaccagacaacgaaaccgtggaccaacgcctacccgaagtacctcgtacctaatttccgttacgctaacctagtctacgccgacgggacctacgacggtccaaccgtcccacggtacctacggtttaccgagggttcggaccgtaggggtttccgggtcgacgggaactcggttaaagtttctaactttcaaccctactacgtaccacggaccgtacgtacccgtgtaaccgtacgttaacgtaacggttacgttagttttaacggtaccgtttaagtttttaacttacgtttcggtaactaacggttagttaaacggtttaacgtaacgttaccggtacggttacccggttacccgggttacccggttaaccgggtttaacccgggaaaccggggtaaacccgggttaaaacccgggtaaaggggttaaaaacgggggtaaaccttaaaacccgggtaaaaaggttaccgggtttaacgggacccggtttacggaacccgttaaccgttaacccgtagtttcggtttaaccccgg

SEQ ID NO: 250968 - DNA, 624 bp, Homo sapiens
  misc_feature: GYAE6OF01AVONV.15.49.E05.1.454.CMB.1.raw
  modified_base (203)..(203): a, c, t, g, unknown or other
  misc_feature (203)..(203): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccacctgtctgtgtctcgaggggaanagccacctctcctgcagggccagtcagagtatgacagcaagttgcctggtaccagcaagaaacctggaccagacctcccagacctcgtcattctttgctacatctgccagggccagtggcactcccagtcctaacgttcaggtcgacgtagggtcgggtactaggggaactaggtacgtttcaactttcctaccaacctactcgacgtccacgtccctagccgtacgtctaggtaagttgttttacgactttagttttaactttacgtcgtacgtagtactaaggttaactaagttcgtaacgtcggtacccgttaccggtaccggtttccgggaaccgtaaacgggaaccgtaaggggtaacgtaaagtaccggaaaacgtacgtaggtacggtacgtacgacctacctagttccgtacg

SEQ ID NO: 250969 - DNA, 622 bp, Homo sapiens
  misc_feature: GYAE6OF01BMZ24.15.49.E05.1.454.CMB.1.raw
  modified_base (207)..(207): a, c, t, g, unknown or other
  misc_feature (207)..(207): n is a, c, g, or t
  modified_base (317)..(317): a, c, t, g, unknown or other
  misc_feature (317)..(317): n is a, c, g, or t
  modified_base (456)..(456): a, c, t, g, unknown or other
  misc_feature (456)..(456): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaggggaaangcccaccctctcctgcgagggccagtcagagtattgacagcaagttcgcctggtaccagcaacgaaacctggacctacgacctcccgagacctcgtcattctttgctacnctcgtcgccgacgggtccacgtggccactcccgacgtcctacgttcgaggtcggactgggtcgggtcgtagggactagtacgtttctattccgtaccaacctatcgacgcaaccgtcctagcagttctaggtaacgttnttttggactttagggttttaacttaccgtagtactaagtcgttaagttattaacgtcgtaccgtccgtaccgttccggtaccggtccgggaacgtaaacggggacctaagggtacgaaacgtaccgaaacgtacgtaggacggtctacgaccgtaactgttcgtcg

SEQ ID NO: 250970 - DNA, 599 bp, Homo sapiens
  misc_feature: GYAE6OF01DPWOU.15.49.E05.1.454.CMB.1.raw
  modified_base (350)..(350): a, c, t, g, unknown or other
  misc_feature (350)..(350): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaggggaaagacgccaccctctcctgcagggccagtcagagtattgacagcaagttagcctggtaccagcaagaaacctggccagacctccagctcgtcattcttagctacactctcgccgtaggccacgtggccactcccagcctaacgttnaggtcggctagggtcggtctaggggactaggtacgtttcaagtttcctacgaacctagtccgagccgacgccttagaccgtagtctaggtaagtacgtttttgacttagttttacttacgtgtacagtctaatataagtcgacgttggccctcggtaacggttccggaccgaaacgggaaccgtaaggggtaagtaaacgtaacggaaaacgtacgtgggtacggccttaggacccacgtatcgttacg

SEQ ID NO: 250971 - DNA, 679 bp, Homo sapiens
  misc_feature: GYAE6OF01AYKBF.15.49.E05.1.454.CMB.1.raw
  modified_base (205)..(205): a, c, t, g, unknown or other
  misc_feature (205)..(205): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccacctgtctgtgtctcgaggggaaacngccacctctcctgcagggccagtcagagtatgacagcaagttgcctggtaccagcaagaacctggaccagactcccagtactcgtctatctttgcttacatcgtgccgaggccagtgccatcccagccacgttcgagtcggactaggtcgggtctacgggactaggtacgtttcaacgtttctacacctacttcgacgtaccgtacgccttacggaccgtagttacgtaggtaagtttaacgttttcgacgtttaaggttttactttacgtacgttaccgtaagtacgtaagttaagttaaacggttcgtaacggttccgggtacccgtttacccggaaccggttttacccggggacccggttaaacggggtaaacccggtaaagggttaaccggtaaacgttaacccggtaaaacggtaaccggttagggtaacgggaccgttacggacccgaaccttaacgttccgtaccgg

SEQ ID NO: 250972 - DNA, 817 bp, Homo sapiens
  misc_feature: GYAE6OF01D78IP.15.49.E05.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaanagccaccctctcctgcaggccagtcagagtatgacngcaagttgcctggtaccngcagaacctggccagactcccagactcgtcatctttgctacatctcgccagggccacgtcggcactcccacgccgtacgtttcgaaggtcggacctagggttcgggttaccgtaggggaacctaggtacggtttaccagttttccctaccgtaacccttagttaccgaaacggccgtacgggtcccccgtttaggacccgtaacggttcccgttaagggttaaacggttttacggttttttccggaacgttttaaacggtttttttaaccgtttacggttaccgtttaccgtaaccggtaacgtttaaacgggtttaaactttaaaccggtttcggtaaacccgggttttcggggaaccccccgttttacccggggttaaacccgggttttcccggggaaacccgggttaaaaccgggggtaaaccccggttaaaaaggggggttaaccggtaaaaacccggtttaacccggaaaaacccggttaaccggttagggtaaaccgggtcccgttaaaccgggtaccctaaaccccgttagtttccccggttttaacccgg

SEQ ID NO: 250973 - DNA, 718 bp, Homo sapiens
  misc_feature: GYAE6OF01BVJWG.15.49.E05.1.454.CMB.1.raw
  modified_base (210)..(210): a, c, t, g, unknown or other
  misc_feature (210)..(210): n is a, c, g, or t
  modified_base (473)..(473): a, c, t, g, unknown or other
  misc_feature (473)..(473): n is a, c, g, or t
  modified_base (708)..(708): a, c, t, g, unknown or other
  misc_feature (708)..(708): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggcctcccagactaccactggaagaaatagtaatgacgcagtctccagcccacctgtctgtcgtctacgaagggaaancgccctaccctctccgtgcgtacgggccagtcaagtagtaattcggaacagacgtaagttccgactaggtacagactaaacggaaacctggtacccacgtaacctccaagtaccttccgtatacttcgtttcgaccttactcggttccgtcgaccgggtaaccgggtccctaaggtccgacctacccgtaccggaccgtacccggttacgtaggtacgtacgggtcacggggtttcgggtacgtagggactaacggttacttntaactttcccgacctaactacgtacacggacgtaacgccgtaacacgtacggttacgttaacggtaagtttacgtttaccgttaacgtttacgtttaacctttagttacgtacttaacgtaagttaagttactaaggtacgtacgttcggtacccgtaccggtacggtacgaaccggtaaaggtaacgagtaagtaacgtaacgtaaacgtcgtaggtacgtcgaccgattaccngttcgtaacg

SEQ ID NO: 250974 - DNA, 724 bp, Homo sapiens
  misc_feature: GYAE6OF01DGKNO.15.49.E05.1.454.CMB.1.raw
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagactaccactggaagaaatagtaatggacgtagtactccacgccgaccctcgtctgtgtctccgacgggaaaggaacgccacccctcctcctcgcgacggggaccgacgtacgaagagttagttagacaacgagtaaacgttagtccgnggttaacccganacgacgaaactccggccgaacgactcccaacgactaccgtcctagttcctttcgtactacatctcggccgaggccgactggcnctaccgcncgtacgttcgagcggtgagtcgggtgtcggacgtagagttactgttaccgtcaaccgtagtacacgacgtacgccgttacgacgtacgtcgtaacggtaacggttattttcgttacgttacgttttaacgtttacgttacgttacgtagtaaccgttaagtttaacgtaagtttacggacgttacggtaccccggttaccggtaccggttcccgggtacccgggaaacgggtaacccggtaagggtaaccgggttaaaacgaaccgtaaaacggttaacggtacgttacgggaccgttaccggacctaaccgttaacgtcgttacgttaccc

SEQ ID NO: 250975 - DNA, 532 bp, Homo sapiens
  misc_feature: GYAE6OF01B9P7H.15.49.E05.1.454.CMB.1.raw
  modified_base (105)..(105): a, c, t, g, unknown or other
  misc_feature (105)..(105): n is a, c, g, or t
  modified_base (205)..(205): a, c, t, g, unknown or other
  misc_feature (205)..(205): n is a, c, g, or t
tcagtctacgtagccacgaccggtgctcgatttagagcgactagcaacacacaaagggggaggaactgctcagttaggacccagacggaaccatggaagccccancgcagcttctcttcctcctgctactctggctcccagataccactggagaaatagtaatgacgcagtctccagccaccctgtctgtgtctccaggggaaanagcccaccctctcctgcagggccaagtcagagtattgacagcaagttagcctggtaccagcagaaacctggccagactcccagactcgtcatctttgctacatctgccagggccaatggcatcccagccacgttcagtggcagtcggggtctggggacaggtagttcgatttctcaccatcagcagcctgcagtctgaagtattttgcagtttattactgtcagcagtataatgactggacctcggacgttcggaccgtaacgggaccgaaaggtacggaaagaactaaaaccgaaaccgtgtacggtctagacacccgattcttcg

SEQ ID NO: 250976 - DNA, 759 bp, Homo sapiens
  misc_feature: GYAE6OF01DLEQT.15.49.E05.1.454.CMB.1.raw
  modified_base (155)..(155): a, c, t, g, unknown or other
  misc_feature (155)..(155): n is a, c, g, or t
  modified_base (216)..(216): a, c, t, g, unknown or other
  misc_feature (216)..(216): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggcctcccagataccactggaanaaatagtaatgacgctagtctccagcccacccgtgtctgttgtacctccggaaggggaacncgcccacccgtcctccgtgcgacgggccagtacaggtagtagtgaacagacgtaaggttcgaccgtaggtaccacgacaaacggaaccgtcggaccaacgacctacccgaacgtacctcgttacactttcttacggacctactacgtccgtacgccggtacggacctacgtcgacctaccgtaccccgagacccgttacgttcgacggttcgggacgtacgggtcgggtacggtacggtaacgtacggttcgtttaaccttacgttacctacccaccgtaacttacgaccggtaccgtacggtccgtcgaagttacgttacgtacggttaagtttagtttacgtacgtttagttttacgttacgtgtaccgtaagtaccgttaagttaacgttaggtaccgtaccggttaccggttaccccgtacgggtacccggttaccggaacggttaaccgggtaaaccgtaaacgggtaacgtaaaagtaaccggtaaacgtaccggttacgtacggtacgtaccgtaccaacgttcgttcgttacccg

SEQ ID NO: 250977 - DNA, 817 bp, Homo sapiens
  misc_feature: GYAE6OF01DHXZJ.15.49.E05.1.454.CMB.1.raw
  modified_base (212)..(212): a, c, t, g, unknown or other
  misc_feature (212)..(212): n is a, c, g, or t
tcagtctacgtagccacgaccggtgctcgatttagagcgactagcaacacacaaaggggggaggaactgctcagttaggacccagacggaaccatggaagccccagcgcagcttctcttccctcctgctactctggctcccagataccactggagaaatagtaatggacgcagtctccagcccaccctgtctgtcgtctaccgaggggaaanacgcccaccctctccgtgcgacgggccagtcagtagtattcgactaggactaaggttacgccgttacgggtaccaagaccgaacggtaaaacccgtcggacccaacggaccctaccccgaacggttacctccggttacctacgttttaccttttacgaccttactacttccgtacggacccggacgggcccctaacggtcgggtacctaaccgtaccccgaaccggtcccgttaaccggttaccgtacgggttacgggaccggttaggggttaccggggttccgtacgggggtaaactacgggttacgtttacgtaaccgttttacccaacccgtaaccgtctacccgaggacctaccggtccgtacgaccgtaagtttaccgtaggttaagtttcgtttttagaactttacggttttacttcggttacaacgttacggaacttaagtaacgttacgtacggtaccggttacgtacccggtttacggtaccgggttaaccgaccgggtaaacgggtaaccgtaaaggggttaaaggaaacctaccgggtaaaacggtacgtcggtacgggtaactaccgacccgttaacctattcccggtttaac

SEQ ID NO: 250978 - DNA, 718 bp, Homo sapiens
  misc_feature: GYAE6OF01BIRRE.15.49.E05.1.454.CMB.1.raw
  modified_base (206)..(206): a, c, t, g, unknown or other
  misc_feature (206)..(206): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaangcccaccctctcctgcagggccagtcagagtattgacagcaagttagcctggtaccagcaagaacctggccagacctccagacctcgtctattcctttgctacatctgccgacgggcccacgtggcctactcccacgcccgtacgttcgaggtcggaccgtagggttcggggtcgtaggggactagggtacgtttcctacgtttcccaccaaccctatccgaacgtcgacgtcccgttagaccgtacgttcgtaacggtaagtttagtttttacggacttttaaggttttactttaccggttgttaccgtaacgttacgtaaggttaacttaaggtaccggttaccgtttcccggtaccccgttacccgggttaaccggttacccggggaacccggtaaacggggtaacccggttaaacgggtaacgggtaaaaccgtaaccggaaaaccggttaccggttaggtaccgggtaccttaccggaacccttaaccgtccgtttaccgtttaccg

SEQ ID NO: 250979 - DNA, 634 bp, Homo sapiens
  misc_feature: GYAE6OF01EP37X.15.49.E05.1.454.CMB.1.raw
  modified_base (206)..(206): a, c, t, g, unknown or other
  misc_feature (206)..(206): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagccaccctgtctgtgtctccgaggggaangcccaccctctcctgcagggccagtcagagtatgacagctaagttagcctaggtaccagcaagaacctggaccagacctccagacctcgtacattcgtttcgccttacgacttcgtcggacccgtacgggccctacgtcggaccctaccgttccccgaacgtaccctacggtttccagggtcgggacgtaggtcggggtctaggggaaccaggtacttcatttcnccacctntccaggcacgtcctggactaggttactagtaagttattttgacttaggtttactacgtgtaccagtctaaggtaattagtacggtactcggtcccgttaccggtaccggttacggaccgtaaacgggtaccgtaagggtacgtaaactacggtaaacggacgtaggttacggcttccgaccacgtagtccgttacg

SEQ ID NO: 250980 - DNA, 656 bp, Homo sapiens
  misc_feature: GYAE6OF01EV689.15.49.E05.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (290)..(290): a, c, t, g, unknown or other
  misc_feature (290)..(290): n is a, c, g, or t
  modified_base (296)..(297): a, c, t, g, unknown or other
  misc_feature (296)..(297): n is a, c, g, or t
tcagtctacgtagccacgaccggtgctcgatttagagcgactagcaacacacaaagggggaggaactgctcagttaggacccagacggaaccatggagccccagcgcagcttctcttcatcctgctactctggctcccagataccactggagaaatagtaatgacgcagtctccagccaccctgtctgtgtctccaggggaaangccaccctctcctgcagggccagtcagagtattgacngcaagttacgcctggtaccagcagaacctggccagctcccagactcganatcttnntctacactctcgccgacggccacgtcgcgactaccgacgacccgtacgttacgtacggtcggcgtacggtcggtcggtcgggtacgacggtacgttacgtacttctaccacctactacgacgacgacgtaccgtcgcagttcgtcggaagtattttcgtcgtacgtttttaatttaccttcggttctacggtctacggttaagttaacttacggtaccgttacgggtcccgttacccggtaccgggtttacccgggtacccgctaaacgggggtaacccgtaaaacggggttacgggtaaaacgttaccgaaaaccggtaaaccgttacggttacgggtaccgttcggtaccgtacccg

SEQ ID NO: 250981 - DNA, 610 bp, Homo sapiens
  misc_feature: GYAE6OF01AJ0NP.15.49.E05.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (420)..(420): a, c, t, g, unknown or other
  misc_feature (420)..(420): n is a, c, g, or t
  modified_base (445)..(445): a, c, t, g, unknown or other
  misc_feature (445)..(445): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaangccaccctctccngcagggccagtcagagtattgacagactaagttacgccgtggtaccagacaacgaaacctggaccagacctcccagtacctcgtcattctttgctacatcgtcgccgacggggcccacgtcggacctactccccgagtccctacgttcgaggttcggctagggtgggtcgtggggacaggtacgtttcatttccgtcacctntcagcagtcctgcagtctagagttntttgcttagtttactcgtagtcgtagactaagtatagtcgacgttcggcccgttacggtaccggttccggaccgtaaacggggaacccgtaaagggtacggtaaaataccggaaaaccgttacggttggacggttaccgtacgaaccctacgtcgtcgtttaccg

SEQ ID NO: 250982 - DNA, 763 bp, Homo sapiens
  misc_feature: GYAE6OF01AFXMJ.15.49.E05.1.454.CMB.1.raw
  modified_base (462)..(462): a, c, t, g, unknown or other
  misc_feature (462)..(462): n is a, c, g, or t
tcagtctacgtagccacgaccggtgctcgattttagagcgactagcaacacacaaagggggaggaactgctcagttaggacccagacggaaccatggaagccccagcgcagcttctcttcctctgctactctggctcccagactaccactggaagaatagtaatcgacgtcagtctccagcccacctgtctgtcgtctaccgaaggggaactcgccctaccctctcctggcgagggcccaggtcagtagtacttagaccagtacgaagtttacgccttcggtaaccagaccgaacgtaaaccgtcgggaccacgtaaccctaccccgtagaaccgttccgtctacgtttaccgtttcgacccgttaatccgtcgtaccgcggtaaccgggcctacgtcggctaccgtccgaaccgtccgttaccgttcgaggtcgtacgtacgggtcggtcgtacggaacgngttaccggttatacgttcccgacttaaccccgagttccgaacggtaccgtacggtcccgtagaaccgttacgttacgtagttaacgtttctttacgacttttaaggtttacttccggtataacgtaacgttacgtaatttaccgtaagttacccggtagttacccgtacccgttcccggttaaggtaccgggaacccgtttaaagggaccggttaaaggtacgtaaacccgttaaaccggtaacggtaccgttaccggttacgtaaaccgttcggtaaccctctacgtttccggttacccg

SEQ ID NO: 250983 - DNA, 723 bp, Homo sapiens
  misc_feature: GYAE6OF01B177F.15.49.E05.1.454.CMB.1.raw
  modified_base (154)..(154): a, c, t, g, unknown or other
  misc_feature (154)..(154): n is a, c, g, or t
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
tcagtctacgtagccacgaccggtgctcgatttagagcgactagcaacacacgaaagggggagaactgctcagttaggacccagacggaaccatggaacgcccagcgcagcttctcttcctcctgctactctggctccagactaccactggaanaaattagtaatgacgactacgtctccagccacctgtctgtcgtcacgaggggaacncgccacctctctgcgaggccagtcagtagtatagancgactaagttcaccgtggtaaccaggacctaacggaaaccgtcggacctaacgacccgtaccgacgtaccgttcgtactacgttcgtttacgactacgatcgtacgccgacggtcctacgtgcctaacgcccagtaccttacggttcacggtcgacgtagggtcggtacggaaggtctaggtcgtactacttacgactaccgtaatcgaaccgcgtacgtccgtacgtacgtacgtaaggtacgttaagttacgttttacggtactttaacgtttacgtttacgtaacggtctaacgggtaactaagtttaacgtacgttaccggtacgttcccgtaaccgttacccgggtaaccgtaacgggtacccggtaaacgggtaaaccgtaacgggtaaaccggtaaaccgtaacggtaaaaccggttcgggtacctacgggttaacggccctaacggtaacccgttacgttccggttacg

SEQ ID NO: 250984 - DNA, 803 bp, Homo sapiens
  misc_feature: GYAE6OF01CYZCS.15.49.E05.1.454.CMB.1.raw
  modified_base (219)..(219): a, c, t, g, unknown or other
  misc_feature (219)..(219): n is a, c, g, or t
  modified_base (745)..(745): a, c, t, g, unknown or other
  misc_feature (745)..(745): n is a, c, g, or t
tcagtctacgtagccacgaccggtgctcgatttagagcgactagcaacacacaaagggggagaactgctcagttaggaccagacggaaccatggaagccccagcgcagcttctcttcctcctgctactctggctacccagaataccacgtggaagaaaatagtaaatgacgacagtctccaacgccctaccctgtctgtgtcgtaccagggggaaaacncgcccaccctgtcccagaccgagggtcctaggtacaaggaagttacgttgaacaggaactaaacggtttcgaccgtaggtaaccgaagtaccgaaggtaaaacccgtgggaacccaacgtacctaccccgaaggtaaccttcggtacctagttttacctttggaccttaactacgttcgtaccggaccggtacgggaccctaacgttcggacctacctaccccgaacggtaccctaacgtttcgaacggttgggacgtaagggttcgggtccgaagggggtactaagggttacgttccctaattcccgtacgtaaacctacttaacccgacggtacgaccgggttaccctaggaccgtaagtttaacgacgggttaaagttacggttttagtacctttaaagggtttttattaccgttacggtactagaacgtaagtttaacgaagttcgagttaccgggtacctacccggttaacgggttcgaaacccgaaggggtaaccgtaagggttaaacgaaaccggttanaaaacccgggttaactgggtaccgaacggttacgaccctacgttaaactggtttaacc

SEQ ID NO: 250985 - DNA, 603 bp, Homo sapiens
  misc_feature: GYAE6OF01A72IZ.15.49.E05.1.454.CMB.1.raw
  modified_base (461)..(461): a, c, t, g, unknown or other
  misc_feature (461)..(461): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaagagccaccctctcctgcagggccagtcagagtattgacagcaagttagcctggtaccagcaagaacctggaccagacctccagctcgtcattcttgctacattctgcccagggcccacgtcggacctactcccgacgccgaacgtttcgaggtgggactagggtgggtctggggaacagggtacgtttcacgtttcaccacatcacgcacgtcctagctagtctaggaagttgttttgacgttagtttacttacgtnttacagtctaaggttataagtcgtacgttacggccctaccgggtaccgttaccgggtacgaaacgggttaccgaagggtaacgtaaagtacctaaacgggtacgtcgggtacggacgtcgaacccgacttacgtcgttccgg

SEQ ID NO: 250986 - DNA, 647 bp, Homo sapiens
  misc_feature: GYAE6OF01A1J5L.15.49.E05.1.454.CMB.1.raw
  modified_base (321)..(321): a, c, t, g, unknown or other
  misc_feature (321)..(321): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtcctccgaggggaacgacgccaccctctcctgcgagggccagtcagagtatgacagactaagttacgccgtggtaccagaccacggaaaccgtggaccagaccctacccagcctcgtcattcttgctacntcgtcgccgacgggcccacgtcgaccacctcccgacgtccgtacgttcgaggtcggcgtagggtgggtacgtgggactaggtcgttcaacttcctacgacctattaccgacggaccacggccttacggcttacggtactaagggttaactttgttttacgtacgttttaagttttacttcggtagtacctagtacgtaagtttaactacgtacggttaccgtcggtccccgttacggtacccggttaccgggaccgtaacgggaacgtaagggtacgaaactacggtaaacccgtagtcggtacgtctcgacctactgtccgtacg

SEQ ID NO: 250987 - DNA, 847 bp, Homo sapiens
  misc_feature: GYAE6OF01E0BFT.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctgctcccagataccactggagaaatagtaatgacgcagtctccagccaccctgtctgtgtctccgaggggaagacgcccaccctctcctcgcgagggccagtcaggtattattgacaggtacaagttacgccgttaggtaccagtaccaacgaaaaccgtcgggaccctagacctacccgaacggtaccttacgtcatttccgtttagacctactacttccgtcggtcccggacgggtcccacggtacggacctaccgtaccccgtacggacctaacggttccgaggtcgggacgtagggttcgggttacgtaggggtaacctaggttacggtttctaacgttcccgtacaaccctagtaccgaacgtcctaacggtcccgtaggtacgtaacgttccgttaaggtaaaacggttttcgttttaacggttaacgtttaacggttttttaaccgtttaacgtttacggttaccgtaacggtaactttaaacgttaacgtttaagttaccgggttaccggttacccggtacccggtttaccccgggtttaccgggttaaccccggggaaacccgggttaaaccgggggaaacccgggttaaaacgggggtttaaccggtaaaaaccggttaaccggtaaaaaaccggttaccgggttaacgttacggggttacccgtaacggtaacccgaccctttaaaccggtttcggtttaacccg

SEQ ID NO: 250988 - DNA, 664 bp, Homo sapiens
  misc_feature: GYAE6OF01BZ8OT.15.49.E05.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagccacctgtctgtgtctccgaggggaancgccaccctntcctgcgagggccagtcagagtatgacngcaagttgcctggtaccagcaacgaacctggccagactcccagactcgtcattcttgctacntccgtgccgagggcccacgtggacctactcccagccctacgttcagggtcggacgtagggtcgggtccgtaggggaactaggtagtttcactttccgacacctatacgacgcgtacgtcctagctagtcgtagtaacgttcgttttagacctttagtttacttacgtgttacgacgtactaagttaactaacgttcggtaccgttcggtacccgttcccgggttaaccggttccgggtaacccggtaaacgggggtaaccccgtaaagggggtaaccgtaaaacgttaacccggtaaaccggtaacggttcgggttacggtccttaccggaccctaaccggttacgttccctttaccgg

SEQ ID NO: 250989 - DNA, 675 bp, Homo sapiens
  misc_feature: GYAE6OF01A87YF.15.49.E05.1.454.CMB.1.raw
  modified_base (529)..(529): a, c, t, g, unknown or other
  misc_feature (529)..(529): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgagggaagcgccaccctctcctgcagggccagtcagagtattgacagcaagttagcctggtaccagcgaacgtaacccgtcggaccagacctcccagtacctcgtctacttccgtttgacctactagttccgtacggcccggtacgggaccctaacggtcggaccaccgttccccacgtacccgtacggttacgaggtcgggtacgtacggttcgggtacgtagggactaggttacgttactacgtttcctacctaacctacgtacacgtacgaccgtacgtcgacgtacgtacgtaggtaacgttcgtttagacgtttacgtttattaccgngttactgacttagtagtacgtgtaccgtcgtacccgtacggttacccggtcgggaacccggtaacgggtaaccgtaagggtaccgtaaacgtaaccggtaaacggtcgtaggtacggtccgtaccggactccggtatcgtttaccg

SEQ ID NO: 250990 - DNA, 601 bp, Homo sapiens
  misc_feature: GYAE6OF01E3ALJ.15.49.E05.1.454.CMB.1.raw
  modified_base (311)..(311): a, c, t, g, unknown or other
  misc_feature (311)..(311): n is a, c, g, or t
  modified_base (441)..(441): a, c, t, g, unknown or other
  misc_feature (441)..(441): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagcgcccaccctctcctgcgagggccagtcagagtattgacagcaagttacgcctggtaccagcagaaacctggccagacctcccgagtactcgtcatcttgctacntctgccgaggccactggcctactcccgagtccctacgttcgaggtcggcgtaggtcgggtcgtggggacaggtacgttcagtttccacacctatcgacgccgacgtcctgactacgttcgtaggaagttnttttcgacgtttaagttttattacgttgtaccagtctaagttataagtagtaccgtcggtcccttaccggtacggttccggaccgtaaacgggtaaccgtaagggtacggtaaataccgaaaccgtacgttggacggtactacgacccacctgtcgttcg

SEQ ID NO: 250991 - DNA, 688 bp, Homo sapiens
  misc_feature: GYAE6OF01B38TC.15.49.E05.1.454.CMB.1.raw
  modified_base (210)..(210): a, c, t, g, unknown or other
  misc_feature (210)..(210): n is a, c, g, or t
  modified_base (251)..(251): a, c, t, g, unknown or other
  misc_feature (251)..(251): n is a, c, g, or t
  modified_base (647)..(647): a, c, t, g, unknown or other
  misc_feature (647)..(647): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagactaccactggaagaaatagtaatgacgcagtctcagcccacctgtctgtcgtctccgaaggggaaacncgcccaccctctcctgcgacggccagtcagtagtattgacngacaagttcgcgtacggtaccagacaacgaaccgtcggaccacgacctacccgaagtccttcgtctagtttccgttcgaccttacacgttccgtcgaccgacgggccctacgtcggactaccctacccgacggtaccctacgtttacgacgggtgggaccgtaggggtttcggggtacgtacggggaactaggttacgtttacacgttttaccaccggtaacctagttcccgagtaccgaccgtccttacggacgtaggtttaccgtaaggtaacctttgtttacgtacgtttaattttacgttacgtcggtacaaggttataacgtttagtaagtcggtacttcccggtcctaccgggtaccggtacgacgaaacggtacgtaagggacctaaanacggtaacgaggttgacgtacacgacctaactcgttctacg

SEQ ID NO: 250992 - DNA, 923 bp, Homo sapiens
  misc_feature: GYAE6OF01CPRXF.15.49.E05.1.454.CMB.1.raw
  modified_base (224)..(224): a, c, t, g, unknown or other
  misc_feature (224)..(224): n is a, c, g, or t
  modified_base (542)..(542): a, c, t, g, unknown or other
  misc_feature (542)..(542): n is a, c, g, or t
tcagtctacgtagccacgaccggtgctcgatttagagcgactagcaacacacgaaaggggggaggaactgctcagttaggacccagacggaaccatggaacgccccagcgcagcttctcttcctcctgctactctggcctcccagactaccactggaagaaataagtaatcgacgcagtctccacgccctccttgtctgtacgtccgtaccggaaggggaaacnccgtccctacccgtcctcctcggaccgacgggtccacggtacaaggtaacgttactacggaactacggaacgttaaggttaccgtacggttacggtaaccgaacggtaacgaaacggtaaacccgttcggaaccctaacgacccgtacccgaacgttccgttaccgtaccgttactttaccggttttcaccttaacctcgttaccgccggtaccgacgggaccctacgggtacggcctaaacccgtcccgtaccgtaaccgttcgttaacggtacgggtcgacggttacggggtttacgggtcgagggggtaacccgngtttaaccgttccgttaacgtttacccaaccgttaccaacgttacccggaagtccccggagtttacccgaggttaccttaacggtttacgtaaccgttttaaggtttacgttttacctaacgtttttacgtttaccggtttactaacgttacgtaaggtaaccgttaagtttaacccgggtaagtccgggttacccggttcccggttaacccgggttacccgttaaccgggggttacccggtaaaacccggggtaacgggggaaacccggttaacgggggttaaaacgtaaaccccgtttaaagggggtaaaacccggttgtaaccggtccccgggtaaccgttaccgtacccaaacggtttccccgtttgggtttaaccc

SEQ ID NO: 250993 - DNA, 900 bp, Homo sapiens
  misc_feature: GYAE6OF01EZ9P0.15.49.E05.1.454.CMB.1.raw
  modified_base (245)..(245): a, c, t, g, unknown or other
  misc_feature (245)..(245): n is a, c, g, or t
tcagtctacgtagccacgaccggtgctcgatttagagcgactagcaacacacaaaggggggaggaactgctcagttaggacccagacggaaccatggaacgccccagcgcaacttctcttcctcctgctactctggcctcccagactaccacgtggaagaaatagtaatgacgcagtcctaccacgcccacccttgtctggtcgtccgtaccggaaggggaaacgccgcccctaccctcctccgngacgacgggacctaggtcgaggtagttacttacgacgtacgacgtaaggttaccgaccgttacggaacccagtaccgaaacggtaacccgtcgggacccaaccggtaccctaccccggtaacgtaccgttccgttacttaaccttttccgtttacgtaacccttacgtaccgttcccggtaccggaccccgggtaaccgggtccctaaccgggtaccgggtaccccttaacccgtaccccggtaaccgtacccgttaccggtttacggaacggtcgggtacggtacgggtttcggggtaccgggtacgggtaacgtacgggtttaacgttaccttaaccggtttccctaacccgtaaccgttacgtaccgaacccggtaccgaaccggttccgtacggtacgttacggtacggtttaagtaaacgttttcgtttaacgttaccgttttacgttttacgtacgttacggtaacacgttaacgtattaacggttaactcgggtacccggttaccggtaccccggtttaaccggtaccgggtacccggttaaacggggaaccggttaaaccggtaagggtaaacgtaaaccgtaaaccgtacggtacggtgttaaaccggccttacgaccgttaaccgtcgtttaggttccgttaccc

SEQ ID NO: 250994 - DNA, 796 bp, Homo sapiens
  misc_feature: GYAE6OF01AP8SI.15.49.E05.1.454.CMB.1.raw
  modified_base (115)..(115): a, c, t, g, unknown or other
  misc_feature (115)..(115): n is a, c, g, or t
  modified_base (132)..(132): a, c, t, g, unknown or other
  misc_feature (132)..(132): n is a, c, g, or t
tcagtctacgtagccacgaccggtgctcgatttagagcgactagcaacacacaaagggggaggaactgctcagttaggacccagacggaaccatggaagccccagcgcagcttcncttcctcctgctactcnggctcccagactaccactggacgaaatagtaatgacgcagtcctccagccacctgctgtcgtctaccgaggggaaactcgccctaacccgtctcccgtagccgtacggggcccagtccgaagtacgtattcggactaagcctaaagtttacgccttaggtaacccaggaccaacggtaaaccgtggacccacggtaccctcccgaacgtaccgtccgtacgtaacgtttcctttacgaccttaaccgactttccgtacggtaccccggaacggggtacccttaaccggtggtaacccaaccgttaccccgaacggtacccgtaacggtttaccgacggtacgggacctggggtacgggttactacgggaactaacggtacgtttacctagttaccgacctaaccgtcgtacgtacggactacggtcctaggactacggtacctaacggtaagttacggtttaccacgtttaaagtttaccgttacgtacgtacgtaacgtacctaaggttacttaaaggtccgtaaccggttacgtaccccgttacgggtacccggttaccggaaccgtaaaccggggtaacgtaaacgggtacgaaaccgttaaggaaaccgtactacgggtacgtacctacccgggaaaccttacctaacgtttcgtaacgg

SEQ ID NO: 250995 - DNA, 1003 bp, Homo sapiens
  misc_feature: GYAE6OF01EB5L0.15.49.E05.1.454.CMB.1.raw
tcagtctacgtagccacgaccggtgctcgattttagagcgactagcaacacacaaaggggggaggaactgctcagttaggacccagacggaaccatggaagccccagcgcagcttctcttcctcctgctactctggctcccagataccactggagaaatagtaatgacgcagtctccacgccaccctgtctgtcgtctcgagggaagcgccacctctccgtgcgacgggccagtcagagtagttcgacagactaagttacgcctcggtaccagacaacggaaccgtcggaccaacgtacccacccgaagaccgttccgtactacgtttccgttttacgtccttaacctagttcccgtacggacccggaccgggaccctacgttcgggacctacccgtaccccgaaccggtaccccttaaccggtttcggaacggttcggggtaaccggtacgggggtttcggggttacggtaccggggggaaacgttaagggttacccggttttaacctaccgttttttaacccggacccttaaacccgttacgttcccggaaccggtacccggtacccggttacccggttcgggtaacccgttaacgggttaccggttaacggtttaaacgtttttaacggtttttacgggttaacccgttttttaaaggtttttttaaccgttttaaaccgtttccgggtttaacgttaacggggttaacttttaaacggtttaacgtttaaacggttaccgggtttaaacccgggttcccggggtttaaccccccgggtttacccggggtttacccgggggtttaaaccccccgggaacccgggggggtttaaaaacccgggggtaaaacccgggttaaaacggggtttaaaaccgggtaaaaaccggtttaaaaccccgggaaaacccggggtttaaccggttacggggggttacccgggtaacccggttacgggtaaccccctaaacccgggtttaacccgtttccgggttttacccg

SEQ ID NO: 250996 - DNA, 726 bp, Homo sapiens
  misc_feature: GYAE6OF01APR68.15.49.E05.1.454.CMB.1.raw
  modified_base (181)..(181): a, c, t, g, unknown or other
  misc_feature (181)..(181): n is a, c, g, or t
tcagtctacgtagccacgaccggtgctcgatttagagcgactagcaacacacgaaagggggaggaactgctcagttaggacccagacggaaccatggaagccccagcgcagcttctcttccctcctgctactcgtggcctcccagataccacgtggaagtaaatagtaatgaccgcagtcnccagcccacctgtctgtctctaccgaagggaacgcgccctaccctcgtcctgcgacggcctagtcagagttatgacgagtactaaggttacgccgtacggtaacccgagacgaacgaaacccgtcggaccctacgaacccgttacccgaacgtaccgtaccgtacgtacgttttccgtttcgtacctaacctcgttaccgtaccggacccgtaccgggccctacggtcggacctaccgtcccgacgtacccgtacggtagacggtggtacggtacggtcgggtcgaagggtacgtacggttacgttcttaaccgttctaccacctacgtcgacgaccgtccgcgtagtcgtagtacgtaagtagtttagtttacgtacgtttagtttactagttcgattacggtataaggtactcggtacgtccgttaccggtcccgttaccggtaccggtaccgggaacggtaacccgggtaacgtaagggtaaccgtaaacgaaacggtaccggtaagtcgacgtaccgtacgaactccgttcgttgttaccc

SEQ ID NO: 250997 - DNA, 899 bp, Homo sapiens
  misc_feature: GYAE6OF01C37F6.15.49.E05.1.454.CMB.1.raw
  modified_base (246)..(246): a, c, t, g, unknown or other
  misc_feature (246)..(246): n is a, c, g, or t
  modified_base (885)..(885): a, c, t, g, unknown or other
  misc_feature (885)..(885): n is a, c, g, or t
tcagtctacgtagccacgaccggtgctcgatttagagcgactagcaacacacgaaagggggaggaactgctcagttaggacccagacggaaccatcggaagccccagcgcagcttctcttcctcctgctactctggcctcccagactacccatggaagaaataggtaatgaccgcagtcctccagccccaccgttgtctgtacgtccgtaccgaaggggaaactccgcccctacccctctacccgngccggtacgggcctaggtcgagtagttacgttagactagacgtaacggttacgccggtacggtacccaggtaaccaacggtaacccgtccggacccgaacgtacccctaccccgaagtaccgttccgtaccttacgtttccgtttacgccttaacgacgttccgtacggacccggtaacggtacccgtacgtccggtacccaccgtaccccgtcggtaacccctacggtttaccgtacggggtcgttacccggttaaggggttcggggtaccgttaacggggaacccgtaggttttaacggtttacctaactttcccgacccgttaaactccgttaccggaaccgtaccgtacccggttacgtcccgggttaaccgttacggttaccgggttaaagttttaacggggttttcctttttaacggggtaacccttttaaagggttttttaccgttacgtaaccgggttaacaacgggtttacttaaacggttaacgttaacgttccgggtaacccggttttacccggtcccggtttaaccccgggtaccgggtttaacccgggaaccgggaaacggtaccgggttaaacggtacgtaaaacccgtacggtaaaccgcgttacggagtcccgtcacgttacncgggtttccttacg

SEQ ID NO: 250998 - DNA, 761 bp, Homo sapiens
  misc_feature: GYAE6OF01BFGER.15.49.E05.1.454.CMB.1.raw
  modified_base (207)..(207): a, c, t, g, unknown or other
  misc_feature (207)..(207): n is a, c, g, or t
  modified_base (388)..(388): a, c, t, g, unknown or other
  misc_feature (388)..(388): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaggggaaanacgaccctaccctctcctgaccgtaggggcctaggtacagtagtagttagaccagacgtaaggttaggccccgttaggtaacccaggacccaacgaaacccgtcggacccaacgaccctaccccaggtacctcgtactactttcgtttcgactacctattcgccgaccggtacgggacccncgtcggcctaccgtacccgaccgcccttaacggttcagggtaccggcgtagggtcgggttacggacggaacgtaggtacgttctatttcccgaccaactacgtacacgttaccgacgttccgtaggtcctagttaccggtaagttaacgtttacggttttctaagtttacgtttacgttcgtacgtaccgtaagtacgtaacggttaactaagggttcgaacccggttccgggttaacccttcccggggtaccggttacgggaaccccgggttaaaccggacgggtttaaacggtaacgtaaaaccgtttaccggaaacggtacgtaggggtcccgtacgttaacccgaaccgtcttacggtccggttttacg

SEQ ID NO: 250999 - DNA, 692 bp, Homo sapiens
  misc_feature: GYAE6OF01A2GEC.15.49.E05.1.454.CMB.1.raw
  modified_base (206)..(206): a, c, t, g, unknown or other
  misc_feature (206)..(206): n is a, c, g, or t
tcagtctacgtagccacgaccggtgctcgatttagagcgactagcaacacacgaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaancgccaccctctcctgcgagggccagtcgagagtatgacagactaagttacgcctaggtaccagcaacgaacctggaccagacctccagtacctcgtactattacctttgacctactacttccgtacggacccgacgggcccctaggtcggaccctacgtaccccggacgtcccgaacgtttcgagggtcggacgtagggtcgggttacacggggtaacaggtactttcgtacgttccgtacccacgtacgtacgacggccgtacgccgttagacctacgttcgtaaggttaatttacgttttgacttttagttttacttacgtacgtacgacgttagtaagtaagttacgtggtaaccgttccgggtacccgttacccgggtaccggttaccggaaccggtaaaccgggtaacgtaaacgggtacgtaaacgtaccggtaaacgtacggttcggacgtccgtaacgacctactaccgttctaccgg

SEQ ID NO: 251000 - DNA, 823 bp, Homo sapiens
  misc_feature: GYAE6OF01DQEDL.15.49.E05.1.454.CMB.1.raw
  modified_base (245)..(245): a, c, t, g, unknown or other
  misc_feature (245)..(245): n is a, c, g, or t
tcagtctacgtagccacgaccggtgctcgatttagagcgactagcaacacacgaaagggggaggaactgctcagttaggacccagacggaaccatggaacgccccagcgcagcttctccttcctcctgctactctggcctcccagactccactggaacgaaattagtaatggaccgctaacgttcctaccaacggccccaacccttggtcctcggttcgttacccgtaccggaagggggaaaacnccggaccccctacccttcccgtcccgtaggacccggacggggcccctaaggtacccgaaggttacgttaacgttaggaacccgtagtaaccgttaaggtttaccggaccgttaccgggtaacccgaaggcctaaaaccggtaaaccccgttcgggacccacggtaaccctcccccgaagtacccgttccgttactaacgtttcctttagcccttaacgacctttccgccggacccggaacggggtcccctacggtacggacccctaaccgtacccgaacggtcccttaaccgttgaagggttcccggaacgtcgggttcgggtacgtacggggaaacctgggtttactccgttacgttactaccgaccgtataccggacgtacgacgtcctgaccgttaaagttcgttaggtacgtttatttcggacttttagttacttcgacgttacgatacgtaattaacgttacgtcgtaccggttcgtacccgtcggtaacggtccggacggttaacgaccggttaaggaaactacgtaacgaaccggtgtggtacgttccgaactccaaacgttcttgtaccg

SEQ ID NO: 251001 - DNA, 809 bp, Homo sapiens
  misc_feature: GYAE6OF01EAQ2E.15.49.E05.1.454.CMB.1.raw
  modified_base (214)..(214): a, c, t, g, unknown or other
  misc_feature (214)..(214): n is a, c, g, or t
tcagtctacgtagccacgaccggtgctcgatttagagcgactagcaacacacaaagggggaggaactgctcagttaggacccagaccggaaccatggaacgccccagcgcagcttctcttcctcctgctactctggcctcccagactaccactggacaaatagtaatgacgcagtctccagcccaccctgtctgtcgtctaccgaaggggaacncgccctaccctctaccgtgcgacgggcctagtcagagttatcgacgatagttacgccgtcgtacacgacgtacgaacgtacgtccggacctacgtacccacgaacgtccttagtttactactttcgttaccgtactaacgtctccgaccggaacggtccgtaccgtacgcggacccttacccggaccgtaccggtaccgttacgtacggcggttccggagggttacgggttccggggtaacggacggtacggtaacgtttaccggttacttacgttaccccgtaaccggactacgtaccgtacgacccggttaccgtccggttacgtccgttaacggttaccgttaagggtttaaccgttttgtttaaccggttaagttttacggtttaacgttacggtaggttaaccgtacgtacgttaaaggttacttaggttaaccgttcccggtaccggttcccgtacggttacccgggacggtaaacccgggtacgggtaaaccggtaaggtaaacccggttaactaaaccggttacccggttaaggtccggttaccgtaaccgtacccgttaaccggtaccttccggtttcgttacccg

SEQ ID NO: 251002 - DNA, 493 bp, Homo sapiens
  misc_feature: GYAE6OF02I6E47.15.49.E05.1.454.CMB.1.raw
tcagtctacgtagccacgaccggtgctcgatttagagcgactagcaacacacaaaggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatcttgctacatctgccagggccactggcatcccagccacgttcagtggcagtgggtctgggacagagttcattctcacatcagcagcctgcagtctgaagtatttgctagtttattactgtcagcagtataatgactgcctccgacgttcgccagggaccaaggtggaaatcgaaacgactagtcggctgacacatctcg

SEQ ID NO: 251003 - DNA, 488 bp, Homo sapiens
  misc_feature: GYAE6OF02JDTI0.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtggtctgggacagagttcattctcaccatcagcagcctgcagtctgaagtatttgctagtttattactgtcagcagtatatgactgcctcgacgttcgccaggaccaggtggaaatcgaaacgactgtgctgcactatctcg

SEQ ID NO: 251004 - DNA, 504 bp, Homo sapiens
  misc_feature: GYAE6OF02JRY13.15.49.E05.1.454.CMB.1.raw
  modified_base (205)..(205): a, c, t, g, unknown or other
  misc_feature (205)..(205): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagactccagactcgtcatcttgctacatctgccaggccactggcatcccagccacgttcagtgcaggtggtctgggacagtacgttcattcncacatcagcagcctgctagtctgaagtntttgctagtttattactgtcagctagtatatgactgcctacgtcgttcgaccaggaccgtaaggtcggaaatacgaacgtactggtacggctagaccactatcttacg

SEQ ID NO: 251005 - DNA, 545 bp, Homo sapiens
  misc_feature: GYAE6OF02F23PD.15.49.E05.1.454.CMB.1.raw
  modified_base (206)..(206): a, c, t, g, unknown or other
  misc_feature (206)..(206): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttgcctggtaccagcaagaaacctggccagacctcccagactcgtcatcttgctacatctgccagggccatggccatcccagccctagttcagtggcaggtgggtctgggacagtacgttcattcacaccatcagcagcctgctagtctagtagtattttgcttagtttactactgtcagtctagtataatgacgttcggcctccggtacggttaccggaccgtaagggaccgaagggttaggaaacttaccgaaacgtaacgtaggtacggacgtaccggacaccgtacgtcttcg

SEQ ID NO: 251006 - DNA, 490 bp, Homo sapiens
  misc_feature: GYAE6OF02I4YE8.15.49.E05.1.454.CMB.1.raw
  modified_base (368)..(368): a, c, t, g, unknown or other
  misc_feature (368)..(368): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatcttgctacatctgccagggccactggcatcccagccacgttcagtgcaggtggtctgggacagagttcattcncaccatcagcagcctgcagtctagagtatttgctagtttatactgtcagctagtataatgtactgcctcgacgttcgaccaggacaaggtgaaatcgaaacgtactgtagctgcacatctcg

SEQ ID NO: 251007 - DNA, 554 bp, Homo sapiens
  misc_feature: GYAE6OF02J3UB1.15.49.E05.1.454.CMB.1.raw
  modified_base (206)..(206): a, c, t, g, unknown or other
  misc_feature (206)..(206): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
tcagtctacgtagccacgaccggtgctcgatttagagcgactagcaatacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaancgccacctctcctgcagggccagtcagagtatgacagcaagttgcctggtaccagcaagaacctggaccagacctcccagactcgtcatcttgctacntcngccgaggccacgtggcactcccagcctacgttcaggtcggctaggtcgggtctgggacagtacgttcattccncaccatcagcacgctgcagtcagatntttgacttagtttatcgtgtctagctagtattaagtcgtacgttcggcccttaccggaccgttacggaccgtaacgggtaccgtaagggtacggtaactaccgaaaccggtacgtggtacggtcgtacgtaccaccgtagtcgttacg

SEQ ID NO: 251008 - DNA, 493 bp, Homo sapiens
  misc_feature: GYAE6OF02IKC13.15.49.E05.1.454.CMB.1.raw
  modified_base (398)..(398): a, c, t, g, unknown or other
  misc_feature (398)..(398): n is a, c, g, or t
  modified_base (488)..(488): a, c, t, g, unknown or other
  misc_feature (488)..(488): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaacctggccagactcccagactcgtcatctttgctacatctgccagggccactggcatcccagccacgttcagtggcagtgggtctgggacagtatttcattctcaccatcagcagcctgcagtctgaagtntttgctagtttattactgtcagctagtatatgactgcctcgacgttcgacacggacaggtgaactcgaaacgtatgtggctgactaccgntctcg

SEQ ID NO: 251009 - DNA, 492 bp, Homo sapiens
  misc_feature: GYAE6OF02ICQYO.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcacatcagcagcctgcagtctgaagtattttgctagttttattactgtcagctagtatatgactgcctcgacgtcgcgagggaccaggtggaatacgaaacgtaactgtgctgcacatctcg

SEQ ID NO: 251010 - DNA, 505 bp, Homo sapiens
  misc_feature: GYAE6OF02JHARO.15.49.E05.1.454.CMB.1.raw
  modified_base (208)..(208): a, c, t, g, unknown or other
  misc_feature (208)..(208): n is a, c, g, or t
  modified_base (400)..(400): a, c, t, g, unknown or other
  misc_feature (400)..(400): n is a, c, g, or t
tcagtctacgtagccacgaccggtgctcgatttagagcgactagcaacacgacgaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagngccacccgtctcctgcagggccagtcagagtattgacagcaagttagcctggtaccagcagaaacctggccagactcccagactcgtcatctttgctacatctgccagggccactggcatcccagccacgttcagtgcagtgggtctgggacagtagttcattctcaccatcagcagctgcagtctgaagtntttgactagtttattacgtgtcagcagtatagtgactcgcctcgtacgttccgaccaggaccaaggtgaactacgaaacgacgtgtaggctgacaccgtatctcg

SEQ ID NO: 251011 - DNA, 493 bp, Homo sapiens
  misc_feature: GYAE6OF02H7Y7G.15.49.E05.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (394)..(394): a, c, t, g, unknown or other
  misc_feature (394)..(394): n is a, c, g, or t
tcagtctacgtagccacgaccggtgctcgattttagagcgactagcaacacacaaaggggaggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctntcctgcagggccagtcagagtattgacagcaagttagcctggtaccagcagaaacctggccagactcccagactcgtcatctttgctacatctgccagggccactggcatcccagccacgttcagtggcagtggtctgggcagagttcattctcacatcagcagcctgcagtctgaagtnttttgctagtttattactgtcagtcagtataatgactgcctcgacgttcgccgaggaccgaaggtgaatcaaacgaactgtcggctgacacctatctcg

SEQ ID NO: 251012 - DNA, 505 bp, Homo sapiens
  misc_feature: GYAE6OF02G58L3.15.49.E05.1.454.CMB.1.raw
  modified_base (205)..(205): a, c, t, g, unknown or other
  misc_feature (205)..(205): n is a, c, g, or t
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttgcctggtaccagcagaaacctggccagacctcccagactcgtcatcttgctacatctgccaggccactggcatcccagccacgttcagtgcagtgggtctgggacagtagttcatttcncaccatcagcagcctgctagtctgaagtntttgcttagtttatactgtcngctagtatatgactgcctcgacgttcggacgtaggaccgtaaggtcgaaactacgaaacgtacgtgtcggctcgacactatcgtcg

SEQ ID NO: 251013 - DNA, 496 bp, Homo sapiens
  misc_feature: GYAE6OF02F7VB3.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatcttgctacatctgccagggccactggcatcccagccacgttcagtgcagtggtctgggacagagttcattctcacatcagcagcctgcagtctgaagtatttgctagtttattactgtcagcagtatatgactgcctcgacgttcgcgtacgggacgaaggtggaaactacgaaacgtactagtcggctgacactatctcg

SEQ ID NO: 251014 - DNA, 488 bp, Homo sapiens
  misc_feature: GYAE6OF02FOORO.15.49.E05.1.454.CMB.1.raw
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatcttgctacatctgccagggccactggcatcccagccacgttcagtggcagtgggtctgggacngagttcattcncacatcagcagcctgcagtctgaagtatttgctagtttattactgtcagcagtatatgactgcctcgacgttcgcaggacaggtggaatacgaacgtacgtgtacggctgcacatctcg

SEQ ID NO: 251015 - DNA, 501 bp, Homo sapiens
  misc_feature: GYAE6OF02IJ01G.15.49.E05.1.454.CMB.1.raw
  modified_base (496)..(496): a, c, t, g, unknown or other
  misc_feature (496)..(496): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccagggaaagagccaccctctcctgcagggccagtcagagtattgacagcaagttagcctggtaccagcagaaacctggccagactcccagactcgtcatctttgctacatctgccagggccactggcatcccagcccacgttcagtggcagtgggtctgggacagagttcattctcaccatcagcagcctgcagtctagaagtattttgctagttttattctgtcagcagtatatgactgcctcgacgttcgaccagggacctaagggtgaaatcgaaacgtactggtggactgacacctntctcg

SEQ ID NO: 251016 - DNA, 506 bp, Homo sapiens
  misc_feature: GYAE6OF02IXXL0.15.49.E05.1.454.CMB.1.raw
  modified_base (205)..(205): a, c, t, g, unknown or other
  misc_feature (205)..(205): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacatctgccagggcccactggcatcccagccacgttcagtgcagtggtctggacngagttcattcncacatcagcagcctgcagtctgaagtattttgctagtttattactgtcagctagtataagtgtacgtcgtcctccgtacgttcgccgaagggaccgaaggtcggtaaatacgaaacgacgtgtcggctgccacatctcg

SEQ ID NO: 251017 - DNA, 531 bp, Homo sapiens
  misc_feature: GYAE6OF02HK8EH.15.49.E05.1.454.CMB.1.raw
  modified_base (204)..(204): a, c, t, g, unknown or other
  misc_feature (204)..(204): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaanagccaccctctcctgcagggccagtcagagtatgacagcaagttagcctggtaccagcagaaacctggccagactcccagactcgtcatctttgctacatctgccagggccactggcatcccagccacgttcagtggcaggtgggtctgggacagagttcattcgtcaccatcagcagcctgctagtcagaagtattttgactagtttattacgtgtacagtctagttataatgacttcgcctacgtacgttcgaccgtacgggaccgtaaggtaacggtaactacgaaacgtacgtaggtcggcgtacgtaccacctgtcttacgg

SEQ ID NO: 251018 - DNA, 525 bp, Homo sapiens
  misc_feature: GYAE6OF02FZ7JG.15.49.E05.1.454.CMB.1.raw
  modified_base (207)..(207): a, c, t, g, unknown or other
  misc_feature (207)..(207): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtattgacagcaagttagcctggtaccagcagaacctggccagactcccagactcgtcatctttgctacatctgccagggccactggcactcccagccacgttcagtggcagtgggtctgggacngagttcattcncacatcagcagcctgcagtctagagtatttgacttagtttattacgtgtcagtctaagtatagtgacgttcgtcctaccggtacgttccggacacgggaccgtaaggtaggaaactaccgaaacgtacgtggtacggcgtagaccactatctcg

SEQ ID NO: 251019 - DNA, 563 bp, Homo sapiens
  misc_feature: GYAE6OF02I8117.15.49.E05.1.454.CMB.1.raw
  modified_base (205)..(205): a, c, t, g, unknown or other
  misc_feature (205)..(205): n is a, c, g, or t
  modified_base (374)..(374): a, c, t, g, unknown or other
  misc_feature (374)..(374): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagactcccagactcgtcatctttgctacatctgccaggggccacgtggcactcccagccacgttcagtggcaggtggtcgtgggacagagttcattcncacatcagcagcctgcagtctgattgtattttgacttagtttattactgtcagtctagtattaagtgtacgtcggtcccttccggtacggttccggaccgtaacggggaccgtaaggggttaacggaaacttaaccgaaaacggtaaccgttacgggtacggtccgtacggacctacccgtattacccg

SEQ ID NO: 251020 - DNA, 541 bp, Homo sapiens
  misc_feature: GYAE6OF02H7T4V.15.49.E05.1.454.CMB.1.raw
  modified_base (378)..(378): a, c, t, g, unknown or other
  misc_feature (378)..(378): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagagccaccctctcctgcagggccagtcagagtatgacagcaagttagcctggtaccagcagaaacctggccagactccagactcgtcattctttgctacatctgccagggccacgtcggcactcccagccacgttacagtcggcaggtgggtcgtgggacagtagttcattcncacatcagcagctgcagtctagaagtatttcgattagtttattactgtactagctaagtataatgaacgtcgcctaccggtacgttccggacgaacgggaccgtaaggtcggtaaactaccgaaacgtacgtggtacggtcgtagaccctactacgtcttacg

SEQ ID NO: 251021 - DNA, 612 bp, Homo sapiens
  misc_feature: GYAE6OF02GXFQE.15.49.E05.1.454.CMB.1.raw
  modified_base (371)..(371): a, c, t, g, unknown or other
  misc_feature (371)..(371): n is a, c, g, or t
tcagtctacgtagccacgaccggtgctcgatttagagcgactagcaatacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaaggttagcctggtaccagcagaaacctggccagacctcccagactcgtcatctttgctacatctgccagggccactggcatcccagccacgttcagtggcagtgggctgggacagagttcattcnctaccatcacgcacggcccttggctacgtcgtaggaaacgttagttttgacctaaggtttttatttaaccgttcggtcctaaggtacaaggttaacgttaaattcggtaaccgttcgggacccttacccggtaacggttcccgggtaccggaacgggtaccgtaacgggttagggaaactaccggtaaaaccgtaacgtcggtacgggaccgttaccggacgtaccctagtaccgttacgg

SEQ ID NO: 251022 - DNA, 495 bp, Homo sapiens
  misc_feature: GYAE6OF02F121E.15.49.E05.1.454.CMB.1.raw
  modified_base (205)..(205): a, c, t, g, unknown or other
  misc_feature (205)..(205): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctccctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgagtattttgctagtttattactgtcagcagtataatgactgcctccgacgttcggccagggaccgaaggtgaatacgaaacgactgtgctagcacatctcg

SEQ ID NO: 251023 - DNA, 572 bp, Homo sapiens
  misc_feature: GYAE6OF02G06IQ.15.49.E05.1.454.CMB.1.raw
  modified_base (206)..(206): a, c, t, g, unknown or other
  misc_feature (206)..(206): n is a, c, g, or t
  modified_base (253)..(253): a, c, t, g, unknown or other
  misc_feature (253)..(253): n is a, c, g, or t
  modified_base (307)..(307): a, c, t, g, unknown or other
  misc_feature (307)..(307): n is a, c, g, or t
  modified_base (360)..(360): a, c, t, g, unknown or other
  misc_feature (360)..(360): n is a, c, g, or t
  modified_base (412)..(412): a, c, t, g, unknown or other
  misc_feature (412)..(412): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaancgccaccctctcctgcgagggccagtcagagtatgacagcaagttcncctggtaccagcagaaacctggccagacctcccagactcgtcattcttgctacntctgccagggccacgtggcactcccagccctacgttcagtggcaggtcggtcngggacagtagttcattccacactatcagcacgcctgctagtcgtagaagttntttcgcttaagtttacttacgttgtaccagtactaagttaataagtcggtaaccgttcggtacccgttaccggtaaccgttccggaacccgtaaggggaccctaagggttacggaaacttacggaaacgtacgtggacggtactggaccacgtactctcg

SEQ ID NO: 251024 - DNA, 555 bp, Homo sapiens
  misc_feature: GYAE6OF02INF4Q.15.49.E05.1.454.CMB.1.raw
  modified_base (205)..(205): a, c, t, g, unknown or other
  misc_feature (205)..(205): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagcccaccctctcctgcagggccagtcagagtattgacagcaagttagcctggtaccagcaagaaacctggccagactcccagactcgtcatcttgctacatctgccagggccacgtggcactcccagccctacgttcagtcggcaggtgggtctgggacagagttcattctcaccatcagcagcctgcagtctagaagtatttgacttagttttattactgtcagtctaagttataatgacgtcggcctaccggtacgttccggaccgtaacggggaccgtaagggtacggtaaactacgtaaaacgtaacgttaggtacggacgttacgaccctacctacgtcttacg

SEQ ID NO: 251025 - DNA, 570 bp, Homo sapiens
  misc_feature: GYAE6OF02IJK0Z.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccacgtggcactccagccacgttcagtggcaggtgggtcgtgggacagtagttcatttctacacatcagcagcctgcagtctgaagtatttgactagttttattactgtactagctaagttaataagtgtaactcggtcccttaccggtaccgttaccgggaccgtaacggggtacccgtaagggtaacgggtaaaactaccgaaaacggtaaccgtggttacgggacttacggaccctaccgtagttccgttcg

SEQ ID NO: 251026 - DNA, 548 bp, Homo sapiens
  misc_feature: GYAE6OF02GQFF8.15.49.E05.1.454.CMB.1.raw
  modified_base (205)..(205): a, c, t, g, unknown or other
  misc_feature (205)..(205): n is a, c, g, or t
  modified_base (402)..(402): a, c, t, g, unknown or other
  misc_feature (402)..(402): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtatgacagcaagttagcctggtaccagcagaaacctggccagactcccagactcgtcatctttgctacatctgccagggccacgtggcatcccagccacgtcagtggcaggtcgggtctggggacagacgttcacttcgtcaccactcacgcacgtcctgcagtcgngtaagtatttcgctagtttacttacgtagtcgtagtacgtagtataatgtactcgacctacgtacgtttcggacgtaacgggactaagggtaggaaactacgtaaacgaacgttacgtacggtacgtacgacaccgtacgtctacg

SEQ ID NO: 251027 - DNA, 549 bp, Homo sapiens
  misc_feature: GYAE6OF02HQDPY.15.49.E05.1.454.CMB.1.raw
  modified_base (205)..(205): a, c, t, g, unknown or other
  misc_feature (205)..(205): n is a, c, g, or t
  modified_base (369)..(369): a, c, t, g, unknown or other
  misc_feature (369)..(369): n is a, c, g, or t
tcagtctacgtagccacgaccggtgctcgatttagagcgactagcaatacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaacctggccagactcccagactcgtcatctttgctacatctgccagggccacgtggcatcccagccacgttcagtgcagtgggtctgggacagagttcattcncaccatcagcacgcctgcagtcgtagaagtatttgacttagtttattactgtctagtactagttataagtgtacgttcggtcccgtccgacgtttaccggaccgtaacgggtaccgtaagggtacggaaacttacgaaacgtaacgtagtacggtacgtacgaccgtaccgtatacttcg

SEQ ID NO: 251028 - DNA, 662 bp, Homo sapiens
  misc_feature: GYAE6OF02HGERV.15.49.E05.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (304)..(304): a, c, t, g, unknown or other
  misc_feature (304)..(304): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccagggaaanagccaccctctcctgcagggccagtcagagtatgacngcaagttgcctggtaccagcaagaacctggccagactccagacctcgtcattctttgctacgntctgccagggccactggcactcccagccacgttcaggtgcaggtggctgggacagtacgttcgatttccgtacaccgtatccagaccgagccctggacctacggttcctaggtaaagttcttttggacctttaaggtttttaacttacgttcggtacctaaggtccgttaaagtttaagttaacgttacggtaaccttcggggtaccccttacccgggtaaccgggtttacccgggaaccccggttaagggggaaccccgttaaaggggttaaccggtaaaaccgttaaccgaaaaaccgggttacgtagggttaccgggtcccgttagaacccgtaaccttacgttccgtttaccgg

SEQ ID NO: 251029 - DNA, 563 bp, Homo sapiens
  misc_feature: GYAE6OF02G0AQR.15.49.E05.1.454.CMB.1.raw
  modified_base (410)..(410): a, c, t, g, unknown or other
  misc_feature (410)..(410): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagacgccaccctctcctgcagggccagtcagagtattgacagcaagttagcctggtaccagcagaaacctggccagacctcccagacctcgtcatcttgctacatctcgccagggccacgtgcactcccagccacgttcagtggcaggtggtcgtgggacagtagttcattctacacctatcagcacgcctgcagtctagaagttntttgacttagtttattactgtacagtctaagttatatacgacgttcggtaccttccggtacgttccggaccggtaacgggtaccgaagggtacggaaacttaacgaaaccggtaacgttaggtacggtacctagaccaacctagtccttacgg

SEQ ID NO: 251030 - DNA, 508 bp, Homo sapiens
  misc_feature: GYAE6OF02F8TO1.15.49.E05.1.454.CMB.1.raw
  modified_base (205)..(205): a, c, t, g, unknown or other
  misc_feature (205)..(205): n is a, c, g, or t
  modified_base (422)..(422): a, c, t, g, unknown or other
  misc_feature (422)..(422): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttgcctggtaccagcagaaacctggccagactccagactcgtcatctttgctacatctgccagggccagtggcatcccagccacgttcagtggcaggtgggtctgggacagacgttcattctcaccatcagcagcctgacagtctagaagtatttgctagtttacttactgtcanctagtatatgacttggcctcggtacgttcggcgaggaccgaaggtacggaactacgaaacgtaacgtgaggctgacacgtatctcg

SEQ ID NO: 251031 - DNA, 820 bp, Homo sapiens
  misc_feature: GYAE6OF02HYHKR.15.49.E05.1.454.CMB.1.raw
  modified_base (210)..(210): a, c, t, g, unknown or other
  misc_feature (210)..(210): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctgcctccagataccactggaagaaatagtaatgacgcagtcctccagcccaccctgtctgtgtcctccgaaggggaaanacgcccaccctctccgtgcgacgggccagtcagagttatgacagacgtaagttacgccgtaggtaacccagaccgaaagaaaccgtggaccctaacgaccctccccgaagtaccttccgtctaactttccgtttcgacctaactacttccgtacggccgaacggggccctaaccggttgggccctaacccgtccccgaacggtccccgtaaaccggtttcgaacgggtcgggtaccgtaaggggtttcggggttaccgacgggggtaacctagggttaaaccgttccttacgttacccgtaaccgaacccgtacgttaccgacggtaccgtacggtacccgtagaccgttacggtaccgtaaggttaacggttacgttttacggtacgtttaaaggttttacttaacgttacgtaccgtacgttaacgtaaggttaattaaacggtcgtaaccgttccggtacccgttacccgggttaaccggttacccggaaaccgggtaaccggggtaccggtaaaggggtaacggtaaaccgttaaccggaaaaccggttaccggttagggtaccggtacgtaccgaacccgttaaccgtacgttaccgttacccgg

SEQ ID NO: 251032 - DNA, 692 bp, Homo sapiens
  misc_feature: GYAE6OF02IZ484.15.49.E05.1.454.CMB.1.raw
  modified_base (206)..(206): a, c, t, g, unknown or other
  misc_feature (206)..(206): n is a, c, g, or t
  modified_base (307)..(307): a, c, t, g, unknown or other
  misc_feature (307)..(307): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccacctgtctgtgtctccgaggggaaangccacctctcctgcagggccagtcagacgtattgacagctaagttacgcctggtaccagcagaaacctggaccagactccagactcgtcatcgttgctacntctcgccagggccacgtggaccacgtcccgagtcccacgttcaggttcggcctaagggttcgggtactaggggaactacggtagtttccaagtttccgtctaacccgattaccgagaccgtacgcccgttagcctaaggtacgttacgtaagttacgtttttagaccgttaaggtttttaacctacgtttcgtaccgtaacgtctaaaggttaactaaacgttacgggaaccttcgggtacccgtttacccggtaacgggtttaccggacccgtaaacggggtaaccgttaacgggtaacggtaaaaccgtaccgtaaaacggttacccgtaagggttacgggtaccttaaccggacccgtaaccgttacgttaccgtttaccgg

SEQ ID NO: 251033 - DNA, 543 bp, Homo sapiens
  misc_feature: GYAE6OF02GIEOT.15.49.E05.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
tcagtctacgtagccacgaccggtgctcgatttagagcgactagcaacacgacaaagggggaggaactgctcagttaggacccagacggaaccatggaagccccagcgcagcttctcttcctcctgctactctggctcccagataccactggagaaatagtaatgacgcagtctaccagccaccctgtctgtgtctccaggggaaanggccacccgtntcctgcaggggccagtcagagtattgacagcaagttagcctggtaccagcagaaacctggccagactcccagactcgtcatctttgctacatctgccagggccactggcactcccagccacgttcagtggcagtgggtctgggacagngttcattcncacctatcagcagcctgcagtctgaatatttagctagtttatactgtacagtacagttatagtgacgttcggcctaccggtacgttccggaccgtaacgggaccctaagggttacggaaataccgaaacgacgttaggacggcgttagacacccgtagtccgttacgg

SEQ ID NO: 251034 - DNA, 557 bp, Homo sapiens
  misc_feature: GYAE6OF02HMAGK.15.49.E05.1.454.CMB.1.raw
  modified_base (205)..(205): a, c, t, g, unknown or other
  misc_feature (205)..(205): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttgcctggtaccagcagaaacctggccagactcccagactcgtcatctttgctacatctcgccagggccacgtggcactcccagccacgttcagtcggctaggtcgggtctgggacaggtacgttcatttcncaccatcagcagcctgctagtctagaagtntttagcttagtttattactgtcagtctagttataatcgactcggtaccctccgtacggttccggaccgtacgggaaccgtaagggtaacgtaaacgtacgaaaccgtaacgttggtacggtaccgtcggaccaaccgtctacgttcgg

SEQ ID NO: 251035 - DNA, 511 bp, Homo sapiens
  misc_feature: GYAE6OF02HXAT7.15.49.E05.1.454.CMB.1.raw
  modified_base (205)..(205): a, c, t, g, unknown or other
  misc_feature (205)..(205): n is a, c, g, or t
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttgcctggtaccagcagaaacctggccagactcccagactcgcatcttgctacatctgccagggccactggcactcccagccacgttcagtggcagtggctgggacagagttcattcncacatcagcagcctgcagtctgaagtntttgactagtttattactgtcagtctagtataatgactcgtcctcgtacgttccggaccgaagggaccgtaaggtggaaactacgaaacgaacgtgtacggctgacacctagtctacg

SEQ ID NO: 251036 - DNA, 485 bp, Homo sapiens
  misc_feature: GYAE6OF02FRXTW.15.49.E05.1.454.CMB.1.raw
  modified_base (205)..(205): a, c, t, g, unknown or other
  misc_feature (205)..(205): n is a, c, g, or t
  modified_base (482)..(482): a, c, t, g, unknown or other
  misc_feature (482)..(482): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacatctgccagggccactggcatcccagccacgttcagtgcagtgggtctgggacagagttcattctcaccatcagcagcctgcagtctgagtatttgctagtttattactgtcagtcagtatatgactgcctcgacgttcgccaggaccaaggtggaatcaaacgactgtgctgcacatntcg

SEQ ID NO: 251037 - DNA, 535 bp, Homo sapiens
  misc_feature: GYAE6OF02FG5G4.15.49.E05.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (372)..(372): a, c, t, g, unknown or other
  misc_feature (372)..(372): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaangcccaccctntcctgcagggccagtcagagtattgacngcaagttagcctggtaccagcagaacctggccagacctcccagactcgtcatctttgctacatctgccagggccactggcatcccagccacgttcaggtcgcaggtggtctgggacagtagttcattcncaccatcagcagcctgctagtctagagtatttgcttagtttactactgtcagactagtatagtgtactggtcctcggacgttcggaccgtagggaccgaagggtacggaaactaccgaaaacggtacgtggtacggacctacggcctaccgtacttcgttacg

SEQ ID NO: 251038 - DNA, 602 bp, Homo sapiens
  misc_feature: GYAE6OF02F0XY8.15.49.E05.1.454.CMB.1.raw
  modified_base (208)..(208): a, c, t, g, unknown or other
  misc_feature (208)..(208): n is a, c, g, or t
  modified_base (423)..(423): a, c, t, g, unknown or other
  misc_feature (423)..(423): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggcctcccagataccactggagaaatagtaatgacgcagtcctccagccaccctgtctgtgtctccgaggggaaangcccaccctctcctgccgagggccagtcagagtattgacagctaagttacgccttggtaccagcaacgaaaccctggccaacgacctcccagaccttcgtcattcctttgcttaacattcctcggcccgaggggcccacgtcggacactcccgagccctacgttcaggtcggacgtagggttcgggtctaggggaacaggtacgtttcatttccncaccatcgagcacgtcctgcacgttcgtagaagttagttttgcttagtttacttactgtacagctaagtatagtcgacgtcgcctccggtacgtccggaccgtaacgggaccgtaagggtaacggtaaactaccgaaaccgtacgttaggtacggcctacgaccaccgtagtcgttacg

SEQ ID NO: 251039 - DNA, 490 bp, Homo sapiens
  misc_feature: GYAE6OF02IQPJM.15.49.E05.1.454.CMB.1.raw
  modified_base (206)..(206): a, c, t, g, unknown or other
  misc_feature (206)..(206): n is a, c, g, or t
  modified_base (475)..(475): a, c, t, g, unknown or other
  misc_feature (475)..(475): n is a, c, g, or t
tcagtctacgtagccacgaccggtgctcgattttagagcgactagcaatacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcacatcagcagcctgcagtctgaagtattttgactagtttattactgtcagcagtatatgactgctcgacgttcgacaggacaaggtgaaatcgaaacgacgtgngctgcactatctacg

SEQ ID NO: 251040 - DNA, 484 bp, Homo sapiens
  misc_feature: GYAE6OF02H3DGI.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactccagactcgtcatcttgctacatctgccagggccactggcatcccagccacgttcagtggcagtgggtctgggacagagttcattctcaccatcagcagcctgcagtctgaagtatttgctagtttattactgtcagcagtatatgactgcctcgacgttcgacaggacaaggtgaatcaagacgtgtggctgcactatctcg

SEQ ID NO: 251041 - DNA, 542 bp, Homo sapiens
  misc_feature: GYAE6OF02H29G3.15.49.E05.1.454.CMB.1.raw
  modified_base (207)..(207): a, c, t, g, unknown or other
  misc_feature (207)..(207): n is a, c, g, or t
  modified_base (259)..(259): a, c, t, g, unknown or other
  misc_feature (259)..(259): n is a, c, g, or t
  modified_base (317)..(317): a, c, t, g, unknown or other
  misc_feature (317)..(317): n is a, c, g, or t
  modified_base (415)..(415): a, c, t, g, unknown or other
  misc_feature (415)..(415): n is a, c, g, or t
  modified_base (534)..(534): a, c, t, g, unknown or other
  misc_feature (534)..(534): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaangccacctctcctgcagggccagtcagagtatgacagcaagtgcctggtaccngcagaacctggccagactcccagactcgtcattcttgctacatctgccagggcctagnggcactcccgagcctacgttcacggtggctaggtggtctgggactaggtagtttcatttccaccacctagtccagccacgcctgcagtctagaagttntttgcttagtttatctagccagtacagttatagtcgcttcgcctacggtacgttccgaccgtaacgggtaccgagggtacgaaactcgaaacgacgtggtcggctacgacctaaccgtntacgttcg

SEQ ID NO: 251042 - DNA, 548 bp, Homo sapiens
  misc_feature: GYAE6OF02FKMJW.15.49.E05.1.454.CMB.1.raw
  modified_base (207)..(207): a, c, t, g, unknown or other
  misc_feature (207)..(207): n is a, c, g, or t
  modified_base (302)..(302): a, c, t, g, unknown or other
  misc_feature (302)..(302): n is a, c, g, or t
  modified_base (361)..(361): a, c, t, g, unknown or other
  misc_feature (361)..(361): n is a, c, g, or t
tcagtctacgtagccacgaccggtgctcgatttagagcgactagcaacacacgaaaggggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttgcctggtaccagcagaacctggccagactccagactcgcatcttgcctanatctgccagggcccagtggcatcccagccacgttcagtggctaggtgggtctggggacnggtacgttcattcctacaccatacagtcacgcctgcgagtcgtagagttagttttcgacttaagtttattactgtcagctaagttataagtgacgttacgccgttaccgtacggttcggaccgtaagggaccgtaaggtacggaaatacgaaacgacgtaggtcggactaggaccacgtactcttcg

SEQ ID NO: 251043 - DNA, 553 bp, Homo sapiens
  misc_feature: GYAE6OF02F9L1D.15.49.E05.1.454.CMB.1.raw
  modified_base (206)..(206): a, c, t, g, unknown or other
  misc_feature (206)..(206): n is a, c, g, or t
  modified_base (417)..(417): a, c, t, g, unknown or other
  misc_feature (417)..(417): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaangcccaccctctcctgcagggccagtcagagtattgacagcaagttgcctggtaccagcagaaacctggccagactcccagactcgtcatctttgctacatctgccagggccacgtggctactccagcctacgttcagtggcaggttcgggtcgtagggactaggtagttcatttcgctacctatcagcacgtcctgcagttctagtaagtntttgacttagtttattctgtcagtcgtaagttataagtgtacgtcgtccctacggtaccgttcgggaccgaagggtaccgtaagggtacggaaattaccgaaacgtacgtagtcggactcgacctactagtcttcg

SEQ ID NO: 251044 - DNA, 525 bp, Homo sapiens
  misc_feature: GYAE6OF02FPS4I.15.49.E05.1.454.CMB.1.raw
  modified_base (206)..(206): a, c, t, g, unknown or other
  misc_feature (206)..(206): n is a, c, g, or t
  modified_base (363)..(363): a, c, t, g, unknown or other
  misc_feature (363)..(363): n is a, c, g, or t
  modified_base (402)..(402): a, c, t, g, unknown or other
  misc_feature (402)..(402): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtattgacagcaagttagcctggtaccagcagaaacctggccagactcccagactcgtcatctttgctacatctgccagggccactggcactcccagccacgttcagtggcaggtgggtctgggacagnttcattcctcaccatcagcctagcctgctagtcagagtntttgctagtttactatcgtcagtcagttatatgacgtcgtcctcggtacgttccggacgtagggaccgaagggtcgaaacgtacgaaacgtacgtagtacggctacgaccactacgtcttacg

SEQ ID NO: 251045 - DNA, 717 bp, Homo sapiens
  misc_feature: GYAE6OF02FPS73.15.49.E05.1.454.CMB.1.raw
  modified_base (206)..(206): a, c, t, g, unknown or other
  misc_feature (206)..(206): n is a, c, g, or t
  modified_base (405)..(405): a, c, t, g, unknown or other
  misc_feature (405)..(405): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaangcccaccctctcctgcagggccagtcagagtattgacagcaagttcgcctggtaccagcagaaacctggccagacctcccagactcgtcatcttgctacatctgccgacggccacgtggaccacgtcccgacgccctacgttcgaggtcggactagggtcgggtacgtggggacaggtacgttctagtttccacacctntacacgcacgtcctcgactacggttctaaggtaacgtttagttttcgaccgttttaagtttttaacttacgtttacggtacctaacggtacttaaacggtttaagtttaaacgttccggttaaccggttccgggtaaccccgtttcccggttaaaccgggtttacccgggaacccgggttaaacgggggtaaacccgtaacgggggttaaccgggtaaaacgttaaaccccggtaaaaacggttaaccggtttaggggtaacccggtaccgttaccgggtaacccctaaccgttacgttaccggtttacccg

SEQ ID NO: 251046 - DNA, 603 bp, Homo sapiens
  misc_feature: GYAE6OF02HBIXC.15.49.E05.1.454.CMB.1.raw
  modified_base (207)..(207): a, c, t, g, unknown or other
  misc_feature (207)..(207): n is a, c, g, or t
  modified_base (243)..(243): a, c, t, g, unknown or other
  misc_feature (243)..(243): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagcccaccctgtctgtgtctccaggggaaangccacctctcctgcagggccagtcagagtattgacngcaagttagcctggtaccagcaagaaacctggaccagacctcccagactcgtcattcttgcctacatctgcccaggggcccacgtggcctatccccgagtcccacgttcaggtggccaggtcgggtctagggactaggtacgttcattcctacactatcagcagcctgcagtctagtaagtgttttgacttagttttacttcgtagtcgtagtacgtaacgttataacgttgtaccgtacggtacccgttaccggtaccggttccgggaaccggtaacgggaccggtaaagggtacggtaaactaccggtaaacgtaaccgtggttacgggacctcgacccgtaactacgttacgttacg

SEQ ID NO: 251047 - DNA, 517 bp, Homo sapiens
  misc_feature: GYAE6OF02IDV0S.15.49.E05.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (292)..(292): a, c, t, g, unknown or other
  misc_feature (292)..(292): n is a, c, g, or t
  modified_base (359)..(359): a, c, t, g, unknown or other
  misc_feature (359)..(359): n is a, c, g, or t
tcagtctacgtagccacgaccggtgctcgatttagagcgactagcaacacacaaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctntcctgcagggccagtcagagtatgacagcaagttagcctggtaccagcagaaacctggccagactccagactcgtnatctttgctacatctgccgagggccactggcactccagccacgttcagtgcagtggtctgggacagngttcattctcactatcagcagcctgcagtcagtaacgtattttcgacttaagttttacttacgtcgtacagctaagtataaatgactggcctacgtacgttcgacgaggacctaaggtagaatacgaaacgtatggtagcgtgaccactactcttacg

SEQ ID NO: 251048 - DNA, 604 bp, Homo sapiens
  misc_feature: GYAE6OF02H8HI8.15.49.E05.1.454.CMB.1.raw
  modified_base (206)..(206): a, c, t, g, unknown or other
  misc_feature (206)..(206): n is a, c, g, or t
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
  modified_base (466)..(466): a, c, t, g, unknown or other
  misc_feature (466)..(466): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaancgccaccctcgtcctggcagggcccagtcagagtatgacagnaagttgctggtaccagcagaacctggaccagactccagactcgcattcttgctanatctgccagggccagtggcactccacnccacgttcgagtcggctacgggtggtacgtggggacaaggttacgttacacgttttccacgtacctaagccagtacgaaggccttagccgtaagtacgttacgaaagttagtttggacttaaggtttattaacgtntaaccgaggtataaacggttataaagttcgaccgttaggacccgtacgtaacggtcggtaccgaaacgggcggtaaacggtagaaacgttacgaaacgtaaccgttagtacggtcgtaacgacaccgtatacgttacg

SEQ ID NO: 251049 - DNA, 556 bp, Homo sapiens
  misc_feature: GYAE6OF02H3JXE.15.49.E05.1.454.CMB.1.raw
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
tcagtctacgtagccacgaccggtgctcgatttagagcgactagcaacacacaaagggggaggaactgctcagttaggacccagacggaaccatggaagcccccagcgcagcttctcttcctcctgctactctggctcccagataccactggagaaatagtaatgacgcagtctccagccacctgtctgtgtctccaggggaaagagccaccctctcctgcagggccagtcagagtattgacagcaagttagcctggtaccagcagaaacctggaccagactacccagactcgtcattcttgctacatctgccgacgggccactggcactcccagccaacggttcagtggcagtggtctgggacagattcattctcacatcagcagcctgcgatctgtaatattttgcttagtttattactntacagntagtataatgtacgtcgtcctaccgaccgtttacggaccgtaacgggaaccgtaagggtaacggtaaaacgtaaccgaaaacgtaacgtacggttacggtacgtacgtaccgaactacgttacttacg

SEQ ID NO: 251050 - DNA, 671 bp, Homo sapiens
  misc_feature: GYAE6OF02J1A0W.15.49.E05.1.454.CMB.1.raw
  modified_base (152)..(152): a, c, t, g, unknown or other
  misc_feature (152)..(152): n is a, c, g, or t
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
tcagtctacgtagccacgaccggtgctcgatttagagcgactagcaacacacaaaggggaggaactgctcagttaggacccagacggaaccatggaagccccagcgcagcttctcttcctcctgctactctggctcccagataccactgganaaatagtaatgacgcagtctccagcccaccctgtctgtgtcctccgaaggggaanacgcccacccttctcctgcacgggccagtcagtacgtntgacagcaagttcgcctcgtacgtacgacacgaaccgtacgccgacgacctacccgacgtactaccggggggggtactactcttacgtctactactctcgccgacggccgacgtcgccgtacctacccgaccgaccgtaccgtacgtacggtacggtcgtacggtcgggtcggtacggtacgtacgtacgttacgtacttacgtaccaccgtactacgacgtcgacgtccgtacgtcgtacgtacgtacgtagttagtttcgtacgttagtttacgttacgttcgtacgtacgtactagttattaagtacgtacgtacgtccgtaccgtaccgttaccggtaccggtacggtacggtaacggtaacggtaacgtaacgtaacgtaacgtacggtacggtacgtacgtaccgaccgtacgtacgtcg

SEQ ID NO: 251051 - DNA, 663 bp, Homo sapiens
  misc_feature: GYAE6OF02IF8OG.15.49.E05.1.454.CMB.1.raw
  modified_base (206)..(206): a, c, t, g, unknown or other
  misc_feature (206)..(206): n is a, c, g, or t
tcagtctacgtagccacgaccggtgctcgatttagagcgactagcaatacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtatgacagcaagttagcctggtaccagcaagaaacctggccagacctcccaagacctcgtacagttccttttgcttacatctcgccgagggccacgtggcactcccagccctacgtttcgagtcggctagggtcgggtccgtaggggacctaggtacggtttcacgtttccgtaccaacctactcgacgtccaacggtccttggactaggttcctaggaacgttattttcggacttaggtttttaacttacgtagtccaggtacctaagtttaactaagttacgtacgttccgtacccgttaccggtaccggtttacccgggaaccgtaacggggtaacccgtaaggggtaaccgtaaaccgttacggaaaacccggttaacgtcggttacggacgttaccggaacctaccgtacgttacgttaccgg

SEQ ID NO: 251052 - DNA, 610 bp, Homo sapiens
  misc_feature: GYAE6OF02IAAY2.15.49.E05.1.454.CMB.1.raw
  modified_base (206)..(206): a, c, t, g, unknown or other
  misc_feature (206)..(206): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaanagccaccctctcctgcagggccagtcagagtattgacagcaagttagcctggtaccagcagaacctggccagactcccagactcgtcattctttgctacatctcgccgagggccacgtcggacactcccagcctacgttcagtggacaggtcgggtctaggggacagtacgttcactttcctacaccatccgagccacgtcctgcagtctaggtaagttatttgacttagtttacttcgtgtacagtctaagttatagtacgtacgttcggtaccctccggtaaccgttccggaaccgtaacgggtacccgtaaaggggttaacggtaaaaccgtaaccggtaaaaccggttaacgttcgggttacggtaccgttacggtacctacttaccggtatttacccgg

SEQ ID NO: 251053 - DNA, 715 bp, Homo sapiens
  misc_feature: GYAE6OF02HNMTU.15.49.E05.1.454.CMB.1.raw
  modified_base (208)..(208): a, c, t, g, unknown or other
  misc_feature (208)..(208): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggaagaaatagtaatgacgcagtctccagccaccctgtctgtgtctccgaaggggaaangcccaccctctcctgcagggccagtcagagttatgacagctaagttacgcctggtaccagacaagaaaccgtcggaccagacctccgagacctcgtacattcgtttgacctacatcctcgaccgacgggccacgtcggactacctcccgacgcctacgttcgaggtcggacgtagggttcgggtcgtcgggactaaggtacgttactattcctaccacctagtacctacggaccgacgtccgttacggcgtacgtttcgtaagtaaacgttgttttacgtaccgtttaagtttttaaccttacgttacgttacgtagtacgttaacggttaatttaacgttacggtaacgttaccggttaccccgttacccgggtaccggtttaacccgggaccggtaaaccgggggtaccggtaaacggggtaacggtaaaaccgttaccgaaaaccgggttaaccgttagggttaccggaccgttacgaaccctaccggttacgttcgttaccgg

SEQ ID NO: 251054 - DNA, 554 bp, Homo sapiens
  misc_feature: GYAE6OF02HCZXV.15.49.E05.1.454.CMB.1.raw
  modified_base (205)..(205): a, c, t, g, unknown or other
  misc_feature (205)..(205): n is a, c, g, or t
  modified_base (374)..(374): a, c, t, g, unknown or other
  misc_feature (374)..(374): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaanagccaccctctcctgcagggccagtcagagtattgacagcaagttagcctggtaccagcagaaacctggccagactccagactcgtcatctttgctacatctgccaggccactggcactcccagccacgttcaggtgcaggtcggtctgggactagagttcagtttccncacatccagcacgcctgctagtctagagtattttcgacttagtttattacgtgtacgagctaagttaataagtgtaccgttcggtcctaccggtacggttaccggaccgtacgggacctaagggttaggaaactacgaaacgtaacgtggtacggactacggaccctactagttctacgg

SEQ ID NO: 251055 - DNA, 629 bp, Homo sapiens
  misc_feature: GYAE6OF02I9IRM.15.49.E05.1.454.CMB.1.raw
  modified_base (205)..(205): a, c, t, g, unknown or other
  misc_feature (205)..(205): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaancgccaccctctcctgcagggccagtcagtgtattgacagcaagttgcctggtacagcagaaacctggccacgactcccagactcgtcatctttgctacatctcgccagggccactggcactcccagcccacgttacagtggcaggtgggtctgggactagagttcacttctacgacctataccagccagcccgtgcgtagttctagaaggttacttttagaccgttaagttttagttaaccttgtacggttagacgttaacggttaattaagtcgtaacggttcgtacccgtacccggtaacggttcggtacccgtaacggggaaccgtaaagggtcgggtaaaacttaccggtaaaaccgtaaccggttaaggttacgggtaccttaacgggcctaaacccggttacgtttaccgttaaccgg

SEQ ID NO: 251056 - DNA, 592 bp, Homo sapiens
  misc_feature: GYAE6OF02HGMO3.15.49.E05.1.454.CMB.1.raw
  modified_base (317)..(317): a, c, t, g, unknown or other
  misc_feature (317)..(317): n is a, c, g, or t
  modified_base (346)..(346): a, c, t, g, unknown or other
  misc_feature (346)..(346): n is a, c, g, or t
  modified_base (374)..(374): a, c, t, g, unknown or other
  misc_feature (374)..(374): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgagggggaaagagccaccctctccctgccgagggccagtcagagtattgacagcaaggttacgcctaggtaccagcaagaaacctggccagacctcccagactcgtctatctttgctacnttctcgccgagggccagtggcactcccancctacgttcaggtggctagggtgggtcnggggaacaggtacttcagtttccaccacctatacgagccacgcctgcgtagtcgtagtaaagttgtttacgacgttagttttactacgttcgtactagtctaaggttataagtcgtaccgttcgacccgttccggtacgttaccggaccggaaggtaccggtaagggtaacgaacttacgaaacgtacgtggtacggtcagtacccacgttatcgtcg

SEQ ID NO: 251057 - DNA, 518 bp, Homo sapiens
  misc_feature: GYAE6OF02ISKV2.15.49.E05.1.454.CMB.1.raw
  modified_base (207)..(207): a, c, t, g, unknown or other
  misc_feature (207)..(207): n is a, c, g, or t
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (515)..(515): a, c, t, g, unknown or other
  misc_feature (515)..(515): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagngcccacctctcctgcagggccagtcagagtattgacagcaagttagcctggtaccagcagaaacctggccagactcccagactcgtcatcttgctacatctgccagggccatggcatcccagccacgttcagtggcaggtcgggtctgggacngagttcattctcaccatcgancacgcctgctagtntacgatgtttgcgttatttattactgtctagctagtatatgactcggcctccgtacgttccggacgacggtacgtaaggtacgaatacgaaacgtagtcgtacggtcgtagccactcgtntcg

SEQ ID NO: 251058 - DNA, 650 bp, Homo sapiens
  misc_feature: GYAE6OF02HQ0WP.15.49.E05.1.454.CMB.1.raw
  modified_base (203)..(203): a, c, t, g, unknown or other
  misc_feature (203)..(203): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccacctgtctgtgtctcgaggggaancgccaccctctcctgcgagggccagtcagtagtattgacagactaagttacgcctggtaaccaggacaacgaaaccgtggaccaagacctcccagacctcgtcattctttgcctaacattcctcgccgagggccacgtggaccactcccgacgtcctacgttcaggtcggactagggttcgggtcgtaggggaacctaggttacgttctactttcctaccaacctatccgacgacgtacgtcccgtagcgtacggttccgtaaggtaacgttcgttttacgacgtttaaggttttaacttacgttgtacgtaagtacgtaagttaataacgtggtacgtcgtccccgtaggtaccggttccggaaccgtaacgggtaaccgtaagggtaacgtaaaccgtacgaaacgttacgtggtacgccgtacgacctaactacgttcgttacg

SEQ ID NO: 251059 - DNA, 586 bp, Homo sapiens
  misc_feature: GYAE6OF02JAZ4P.15.49.E05.1.454.CMB.1.raw
  modified_base (204)..(204): a, c, t, g, unknown or other
  misc_feature (204)..(204): n is a, c, g, or t
  modified_base (425)..(425): a, c, t, g, unknown or other
  misc_feature (425)..(425): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccacctgtctgtgtctccaggggaaangccaccctctcctgcagggccagtcagagtatgacagcaagttgcctggtaccagcaagaaacctggaccagacctcccagactcgtcatctttgctacatctcgccagggccacgtggcactcccgagccctagttcaggtgctagggtggtcgtgggacaggtacgttcactttccactaacctatacgacgtcacgtcctgctagtcctagaacgttnttttgacttagttttatacgtgtcagtctaagttactaagtgtaacgttcggtacccgttaccggtacggttccgggaccgtaacggggaccgtaaaggggtcgaaaactaccggtaaaacgtacgttaggtacggccgtacgaccgacctacgttctacg

SEQ ID NO: 251060 - DNA, 608 bp, Homo sapiens
  misc_feature: GYAE6OF02FZ67J.15.49.E05.1.454.CMB.1.raw
  modified_base (206)..(206): a, c, t, g, unknown or other
  misc_feature (206)..(206): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagatattgacagctaagttcgcctggtaccagcaagaaacctggccagactcccagactcgtctattcttcgctacactctcgccgagggccacgtggcactcccacgcctacgttcagtgctaggtcgggtctgggacaggtacttcatttcacacctatcagcacgcctgactagtcgtagaagtttcgtttagactttagtttacttacgtcgtacagtactaaggttactaagttacgacgttacgggtcccttaccgggtaccgttaccgggaccgtaacggggaaccgtaaggggttaacggtaaaacctaaccgtaaaaccggtacgttagggtacggtaccgtaccgacctaaccgtagttccgttacg

SEQ ID NO: 251061 - DNA, 603 bp, Homo sapiens
  misc_feature: GYAE6OF02GFSYR.15.49.E05.1.454.CMB.1.raw
  modified_base (207)..(207): a, c, t, g, unknown or other
  misc_feature (207)..(207): n is a, c, g, or t
  modified_base (307)..(307): a, c, t, g, unknown or other
  misc_feature (307)..(307): n is a, c, g, or t
  modified_base (450)..(450): a, c, t, g, unknown or other
  misc_feature (450)..(450): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagngccaccctctcctgccagggccaggtcagagtattgacagcaagttcgcctggtaccagcaagaacctggccagcctcccagactcgtcatcttgctacntctcgccgacgggcctagtggcaccgtcccagccctacgttcgaggtcggctagggtcggggtctaggggaccaggttacgttctatttccaccgtacctatcgacgcgaacggtccgtgactacgttaccgtagtaagtttnttttacgggactttacggttttactacgttacgttcaaggtactaagttactaagtcgtacgtcgtaccgtcgtaccgtcgacgtacggaccgtaagggtacgaactacgaaacgtactgggtcgtacgtaccggacctacctgtccgttacg

SEQ ID NO: 251062 - DNA, 791 bp, Homo sapiens
  misc_feature: GYAE6OF02FOFY4.15.49.E05.1.454.CMB.1.raw
  modified_base (207)..(207): a, c, t, g, unknown or other
  misc_feature (207)..(207): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaggggaaangccaccctctcctgcagggccagtcagagtattgactagctaaggttacgccttaggtaccagcaaacgaaaccgtggaccagacctacccgagtaccttcgtactacgttcttttaggaccttaacgacttcgcggtacccgaacccggggtccctaacggtcggtccctaaccgtcccctaacggtcccccttaacggtttcccgaagggttcgggaccggtaacggggttcggggttacccgtaggggaaacctaagggtttaaccgggtttacctacgttttaaccctaccgaacccttaagtacccgaacggtccgtaaccggtccgttacgaccgttacggttacccgttaacggtaaggttttaacctttttcggaaccttttaacggtttttaaccttacggttacggttacgtaacgtacgttaagttaaacgtaacgttccggttaacgttccggtaccttaccggtaccggttaccgggaacccgttagggaaccgttaacgggtaggtaaaaccgttaccggaaacggttagtcgggtacggtccttacggacccgtactaccgttctacgg

SEQ ID NO: 251063 - DNA, 573 bp, Homo sapiens
  misc_feature: GYAE6OF02GF3KC.15.49.E05.1.454.CMB.1.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (392)..(392): a, c, t, g, unknown or other
  misc_feature (392)..(392): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccatcctgtctgtgtctccaggggaaangccacctntcctgcagggccagtcagagtatgacagctaagttgcctggtaccagcagaaacctggaccagacctcccagactcgacacttctttgactacatctcgccgacgggccacgtggcacgtcccagcctacgttcaggttcggactaggtcggtcgtacgggactagtgttctactttcncacgactcgagcacgtcctagctagtcgtagtaagttactttgacttagtttactctagttcgagtactaagtactagtcgacttcgcctacggtacgttaccggacgtaacgggaccgtaaggtaacgtaactaaccgaaacgtacgtaggtcggaccgttacgacctaccgtattaccg

SEQ ID NO: 251064 - DNA, 620 bp, Homo sapiens
  misc_feature: GYAE6OF02IYU9D.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagagccaccctctcctgcagggccagtcagagtattgacagcaagttagcctggtaccagcaagaaacctggccagacctcccagactcgtcatcttgctacatctgccgagggccacgtggccatcccagcctacgttcagtcggctaggtcggtctgggacagtagttcacttctcacctatcgacgcacgtcctgactagtcgtagtaagtttacgtttcgacgtttagttttattacgttcgtactacgtacgtaagttaagttaagtcgtaccgttaccggtccgtacccggttaccggttaccgggtaacccgtaacgggtaaccggtaagggtaacggtaaaccgtaaaccggaaacgttaaccgttgggtacggtaccgtacgaccccgtaacgtacttaccgttccg

SEQ ID NO: 251065 - DNA, 725 bp, Homo sapiens
  misc_feature: GYAE6OF02GXL2N.15.49.E05.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccacctgtctgtgtactccgaggggaaancgccacctntccngcaggccagtcagtgtatgacagcaagttagcctggtaccagcaagaacctggccagctcccgagacctcgtacaagttctttacgcttaacacttccgtcggacccgtaaggggccctaacggtcgggaccctaacgttcccaggtcccctacgtttcgaacggttcggactacgggttcgggtctacggggaactagggtactttcgacttttcccacgaacccgtattaccgacgaccgtaacggtcccgttagaccttagtaccgtaaggtaagttacgttttacggactttaagttttacgttaacgtcgtaaccgtacggtacgtaaggttaacttaacgtacggaacgtttcggtacccgttaccggttaacgtttacccgggacccgtaacggggtacccgtaaacggggttacgtaaaaccgttacccgtaaaaccggttaaccgtttcgggttaccggaccttcggtaaccctacccgttacgtaccgtttaccgg

SEQ ID NO: 251066 - DNA, 713 bp, Homo sapiens
  misc_feature: GYAE6OF02GV2X9.15.49.E05.1.454.CMB.1.raw
  modified_base (229)..(229): a, c, t, g, unknown or other
  misc_feature (229)..(229): n is a, c, g, or t
  modified_base (459)..(459): a, c, t, g, unknown or other
  misc_feature (459)..(459): n is a, c, g, or t
tcagtctacgtagccacgaccggtgctcgatttagagcgactagcaacacacaaagggggaaggggaactagctcagttagggtacccgacgacgggaaccgaactggaaggaccccacgcgcagcttctcttcctcctgctactctggctcccacgataccactggagaaataagtaagtgacggcagtctccagccaccctgtctgtgtctccgaaggggaaagacncccaccctcctctcggcacgggccacgtcgagagtattcgaccagacaagttagcccgtcggtaccgagctaacgaaaccgtcggcacgtacctcccaagccgtacgtctattcttcgactaccatcgtcggccgagggtcccacgttcggcctacctccccgaacgtcctaacgttacgacgggtacggtcgtaggttacggggtctacgggggaataaggttacgttnttacccttacccgtacctaacctacgtaccgaacggaccgtaccgcccgtacgtcgtacggttcgtaacggtaagttacttttacggtacttacgttttacgttacttggtacagtactaagtacttaagtcgtactcggttcccgtaccggtacgtccgtaaccggacggtaacggtaggtaacggtaaactaaccggtaacgtaaccgttggtaacggtcggtaccgaccgtaaccgtacttaccgttacgg

SEQ ID NO: 251067 - DNA, 775 bp, Homo sapiens
  misc_feature: GYAE6OF02GANLQ.15.49.E05.1.454.CMB.1.raw
  modified_base (207)..(207): a, c, t, g, unknown or other
  misc_feature (207)..(207): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaggggaaangccaccctctcctgcaggccagtcagagtattgacagcaagttgcctggtaccagcaagaacctcggaccagaccctcccagacctcgtctattctttgctacactctcgccgacgggcccacgtcggacctaccgtcccgacgccctacgttacgacggttcgggccgtagggttcgggtaccgtagggggaacctagggttacgtttcgtaacttttcccgtactaaccctacgttaccgaacgtccgtaacggtcccgttacggccgtaacgggttccgttaacggtaaacggtttacgttttttaaccggacgttttaaaggtttttaacctttacggtttacggttacccgtaaggtaccgttaaaggtttaacgttaaacgttacgtacccgtttacgggtaccccttacccgggtaacccggtttacccggaaccgggttaaccgggaaccgttaacggggtaaacggtaaaacgttaacccggtaaaaccggttaaccgttaacgggttccgggtaaccgttaccggtaacccgtaaccgtttaccgtacgtttacccgg

SEQ ID NO: 251068 - DNA, 736 bp, Homo sapiens
  misc_feature: GYAE6OF02G0GTN.15.49.E05.1.454.CMB.1.raw
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagcgcccaccctcctcctgcgagggccagtcagagtatgacagcaagttagcctggtaccagctaacgaaaccgtggaccagaccctcccagacctcgtacattccgtttgcttaccattcctcggcccgaggggcccacgtcgggacctaccgtcccagccctacgtttacgaacgttggcgtacgggttcgggttcgtacggggactacggtacgtttccgaactttcccgtacacccgtacgttaccaaccggccgaacgtccccgttgaccgtacgttcgttaggtaaacgtttacgttttttacggttaacgtttttacttacgttcgggttaccaaggtcgttaaaggtttaactaagtttccgggtaacgttaccgggtaccctttacccggggaccggtttacccgggaacccggtaacggggtacccgtaaaggggttaccggtaaaactaaccggtaaaaccgacggtttacggaccggttacgttaccggaccctaaccgttacgttacccgtcgttaccg

SEQ ID NO: 251069 - DNA, 620 bp, Homo sapiens
  misc_feature: GYAE6OF02G6WLV.15.49.E05.1.454.CMB.1.raw
  modified_base (206)..(206): a, c, t, g, unknown or other
  misc_feature (206)..(206): n is a, c, g, or t
  modified_base (339)..(339): a, c, t, g, unknown or other
  misc_feature (339)..(339): n is a, c, g, or t
  modified_base (460)..(460): a, c, t, g, unknown or other
  misc_feature (460)..(460): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaancgccaccctctcctgcgagggccagtcagacgttattcggacagcaagttacgcctaggtaccagccaagaacctcggacacgacctcccaagtacctcgtcattctttcgctacatctggcctaggcctcgnggccacgtcccagccgtacgttcgagttcggcgtacgggtcgggtacgtacggggactaggtacttctacgttcctacacgctacgcgaccgacgcctaggcctagtccgtagtaacgttnttttcggtatttacgttttanacgttntacgtcgtattagttacgtaatccggtagttccgcctccggttacgtaccgacggtaacggaccggtaaggttaacggaaactaccgggtaaactacgttaggtacggtcgtgtaacccgcttacctaggttc

SEQ ID NO: 251070 - DNA, 795 bp, Homo sapiens
  misc_feature: GYAE6OF02IQ547.15.49.E05.1.454.CMB.1.raw
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctgctcccagataccactggagaaatagtaatgacgcagtctccagccaccctgtctgtntctccgaggggaaanacgcccacctctcctgcngggccagtcagagttacttgacagctaagttagccctggtaccagcaacggaaaccgttcggacccgaagtaccctccccgaagtaccctacggttaccacgttccgtttttggaccttaaccgatttccgtacggacccgtacggggacccctaaacgttcgggacctaacgtcccccgaacggtaccccgtaacggttttccgaaacggggttacggaccgttaacggggtttcggggttaccgtagggggtaaacccggttaggtaaacggttttcctaacgttttcccgtaacccgaacccgtttaacttaccggaaccgtaccgaacggtccctcggtaaccgtacgttaccgttaacgggtaaacgtttagtttttcgaccgttttaacggttttaactttacgttacggtactacgtacgtaagtagttaaattcggtaacgtccggtaccgttccgtaccgggttacgtaccggaacgggtaaccgttaacggggtacgtaaaacgtaccgtaaaacgtccgttaggtacggtccgttacgaccctaacggtactcggttaccg

SEQ ID NO: 251071 - DNA, 734 bp, Homo sapiens
  misc_feature: GYAE6OF02GVHKX.15.49.E05.1.454.CMB.1.raw
  modified_base (329)..(329): a, c, t, g, unknown or other
  misc_feature (329)..(329): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaaggggaaagcgcccaccctctccgtgcacgggccagtcagagtatgacagactaagttacgcctaggtaccagacgaagaaacccgtggaccagaccctcccgagacctccgtacattctttcgactacnttccgtcgccgacgggccctagtcggaccactcccgagtcccgtacgttcgtaagggtcgaccgtagggttcgggtcgtacggggactaaggttacgtttaccgtacttttcccgtaaccgaccgtacgtaccgacgaccgtacggtccgttacgacgtacggttacgtaacgtaagttacgtttagtacggtttaacttttacgttacgttacgtaccgtagtaccgttaagttaacgttaacgttacgtaccgttaccggtacccgttacccgggttaaccggttacccgggaaccggtaaccgggtaaccggtaacggggtaacggtaaaaccgtaaccgtaaacggttacgttacgggtacggtacggtaccgtaaccgtaccgtaccggttacttacccg

SEQ ID NO: 251072 - DNA, 666 bp, Homo sapiens
  misc_feature: GYAE6OF02HXWNN.15.49.E05.1.454.CMB.1.raw
  modified_base (459)..(459): a, c, t, g, unknown or other
  misc_feature (459)..(459): n is a, c, g, or t
tcagtctacgtagccacgaccggtgctcgattttagagcgactagcaacacacaaaggggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagcgccacctctcctgcagggccagtcagagtatgacagctaagttagccttggtaccagacaagaaccgtggaccagacctcccagacctcgtcattcttgctacatctgccagggccacgtggcctacgcccagcctacgttcgagtcggctaggttcgggtcgtagggactaggtacgttcgtactttccgtacctaacctagtccgaacgtccacgtcccgtacgacttacgtacgtaggtaaacgttntttcgtacgtttagtttaacttacgttgtacctagtacgttaagttaactaacgttcgtacgttccggtacccttccgggtaaccgttccggaaccggtaacggggtaacccgtaaggggttaacggtaaaaccgttaccggtaaaaccggtaccgttcgggtaacgggtacctaccggacccgtaacccgttagttcccttaacgg

SEQ ID NO: 251073 - DNA, 698 bp, Homo sapiens
  misc_feature: GYAE6OF02G55NZ.15.49.E05.1.454.CMB.1.raw
  modified_base (189)..(189): a, c, t, g, unknown or other
  misc_feature (189)..(189): n is a, c, g, or t
  modified_base (206)..(206): a, c, t, g, unknown or other
  misc_feature (206)..(206): n is a, c, g, or t
tcagtctacgtagccacgaccggtgctcgatttagagcgactagcaacacacaaagggggagaactgctcagttaggacccagacggaaccatggaagccccagcgcagcttctcttcctcctgctactctggctcccagataccactggagaaatagtaatgacgcagtctccagcccacctgtctgngtctaccgaggggaaancgcccaccctctccgtgccgacgggccagtcagagttatgacaggtcaaggttcgcctggtaccaggcaacgtaacctggaccacgacctacccgagtacctcgtcacttcgttcgactaacatcgtcgaccgtaggtccacgtggccaacgtccccgaagtcccctagtccgaggttcgctagggttcggacgtcgggaactaggtacttcgacttccgactaccgtactacgacgtacgacgcgttacgacgtacgtcgtaacggtaatttacgttttacgacgtttaagttttaacgtacgttacgtaccagtactaaggtttaactaaacggttcgtaccggttacgtaccccggttaacggtaccgggtttaccggaacccggtaacgggtaaccgttaacggggtaacgtaaaccggtaacccgtaacggtaacggttggtaccgggtacctacgggtaacttaaccccggtgttaccgttaccgg

SEQ ID NO: 251074 - DNA, 647 bp, Homo sapiens
  misc_feature: GYAE6OF02HIA6R.15.49.E05.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactgggagaaatagtaatgacgcagtctccagcccacctgtctgtgtctccgaggggaaangcccacctctccngcagggccagtcagagtatgacagctaagttacgcctggtaccagcaagaaaccgtggccagacctcccagacctcgtcactctttgctacatctagccgacgggccacgtggcactcccgacgccctacgttcaggtcggacgtagggtcggtcgtacgggacaggtacttcgtatttccgctaaccactcacgcgtaacgcctggactcgttacgtaggtaacgttagttttaggactttaagttttacgttaacttggtacttacgaccgttaagttaactaagttcggtaccgttcgggtaccccgttccggtaacggtttcccgggaccggtaacgggtaccgtaacggggtaacggtaaactaccggtaaaacgtacgtgggttacggtacctagaaccccgtacttacgttccgttaccg

SEQ ID NO: 251075 - DNA, 689 bp, Homo sapiens
  misc_feature: GYAE6OF02JIJ3L.15.49.E05.1.454.CMB.1.raw
  modified_base (257)..(257): a, c, t, g, unknown or other
  misc_feature (257)..(257): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaggggaaagagcccaccctctcctgcagggtccagtcagagtatgacagtcaagttacncctggtaccagcaagaaaccgtcggccacgacctcccagactcgtccattcctttgcctactactctacggccgtacgggcctacgtcggaccacgtccccacgacccgtacgttacgacgtcgggaccgtacgggttcgggtacggttacgggactacgggtaacggttcctacgtttccctaaccacctaaccgtcgtacgactccggtaccctcggtacagttcgtaaggtaacgtttaagttttcgtacgtttagttttaaacttcgttagtccgtaaagcttaataagtaagtacgtacgttccgtcccgttaccgtacggttaccgggaaccgtagggaacccgtagggtaacgggaaacttaccggtaaaacgtacgtaggttacggtaccgttaccggaccgtaaccgttacgtacccgttagg

SEQ ID NO: 251076 - DNA, 694 bp, Homo sapiens
  misc_feature: GYAE6OF02H6CLG.15.49.E05.1.454.CMB.1.raw
tcagtctacgtagccacgaccggtgctcgatttagagcgactagcaacacacaaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagagccaccctctcctgcagggccagtcagagtattgacagctaagttgcctggtaccagacaagaaccctggaccagacctcccagtacctcgtacattctttgctacatctgcccgagggccctacgtggccactccccagtcccacgttcgagtcggcgtaggttcgggtcgtgggactaggtacgttactagtttcccgactaacctatccgacgtccgtacggtccgtacgacgtagttaccgttaggtaaagtttacttttacggtaccgtttaagtttttaactttaccgttgttaccacgttaccgtaagtttaacgtaacgttcgtaacgttccggttaccccgtaccgggttaccggttacccgggtaacccggtaaccggggtaacccgtaaggggtaacggtaaaaccttaacccggtaaaaccgtaccggttacggttacggccgttaccgaacccggtactaccgttccttacgg

SEQ ID NO: 251077 - DNA, 664 bp, Homo sapiens
  misc_feature: GYAE6OF02IVBFL.15.49.E05.1.454.CMB.1.raw
  modified_base (205)..(205): a, c, t, g, unknown or other
  misc_feature (205)..(205): n is a, c, g, or t
  modified_base (426)..(426): a, c, t, g, unknown or other
  misc_feature (426)..(426): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccacctgtctgtcgtctccgagggaaancgccaaccctctcctgcagggccagtcagagtctgacagactaagttacgcctggtaccagccaaggtaaacctggaccagtacctccagactcggtacctattctttagccttaacattcgtacgccgtaacgggcctaacgtcggaccaacgtcccgaacgcctaacgtttcacgggttcggccaggtcgggtctacggggacagtacgttcagttccnctaccgaatcggaatccgtacgcctgacgtagtctaggtacgttaactttggaccttaagtttcgttagtacgtcacggtaattagttaagtacgttagtacccgttacggtcccgttaccggaaccgtttccggaacggtacggtaaccggtaacggttaacggtaaccgtaaacggtaaacccgtaagtacggttaccgggtactaccggtaaaccctcgtttacggtaccgttcg

SEQ ID NO: 251078 - DNA, 584 bp, Homo sapiens
  misc_feature: GYAE6OF02FK63F.15.49.E05.1.454.CMB.1.raw
  modified_base (208)..(208): a, c, t, g, unknown or other
  misc_feature (208)..(208): n is a, c, g, or t
  modified_base (274)..(274): a, c, t, g, unknown or other
  misc_feature (274)..(274): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagngccaccctctcctgccagggccagtcagagtatgacagcaagttagcctggtaccagcagaaaccnggccagactccagactcgcatcttgctacatctgccagggccacgtggcactcccagcctacgttcagtggccgtaggtcgggtcgtgggacaggtacgtttcactttctacaacccgtatcagcacgcctgcagtctagaagttattttgacttagtttattacgtagtaccgtagtactaaggttataagttcgtacgttcggtcccttacggtaccgttacgggaacccgtaacgggaccgtaagggtaacggaaacgttacgaaacgtaaccgtggtacggctagacctaccgtacgtaccgttcg

SEQ ID NO: 251079 - DNA, 699 bp, Homo sapiens
  misc_feature: GYAE6OF02HHBXI.15.49.E05.1.454.CMB.1.raw
  modified_base (421)..(421): a, c, t, g, unknown or other
  misc_feature (421)..(421): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggaagaaatagtaatgacgcagtctcagcccacctgtctgtgtctccgagggaaagcgcccacctctcctgcacggaccagtcagtagtatgacagacgtaagttcgccgtagtaccagccaacgaaccgtggaccagacctcccgagacctcgtactacttcgtttcgacctacacgttcctcggcccggacgggaccccacgttcggaccctaccgtacccgactcccgtacgttaccgagggtcggccgtagggtcggtctacgggacnggttacgttctaacttcctaccgacctacgttaccacggactacgtcccgtgtaccgtaacgttccggtaaggttaaacttcgtttacgtaacgtttaacgttttactttactacgttacgacgtacgttaagttaatacgtcggtaaccgttccgggacccgttacggtaccgggttaccggaaccgggacgggaaccgttaagggtaacgtaaaccttaacgaaaccggtaaggttacgtacggtacctacggtacctaacgttcgtaccgtttcg

SEQ ID NO: 251080 - DNA, 723 bp, Homo sapiens
  misc_feature: GYAE6OF02HEX7Y.15.49.E05.1.454.CMB.1.raw
  modified_base (167)..(167): a, c, t, g, unknown or other
  misc_feature (167)..(167): n is a, c, g, or t
  modified_base (207)..(207): a, c, t, g, unknown or other
  misc_feature (207)..(207): n is a, c, g, or t
  modified_base (324)..(324): a, c, t, g, unknown or other
  misc_feature (324)..(324): n is a, c, g, or t
  modified_base (422)..(422): a, c, t, g, unknown or other
  misc_feature (422)..(422): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacncagtctccagccaccctgtctgtcgtctccgaggggaaancgccaccctctcctgcgacgggccagtcagtacgtattcgacagactaagttacgccgtaggtaccagcaagaacctgaccagacctccagacctcgtcaacttcctttcgactacncgtctcgaccgaggtccacgtcggacctacgccctacgcctacgtcgagtcggcgtacggttgggacgtggggactacgtacgttactacgttacccncgtaaccctataccggacgtacccacgtcgtacggactacggttccgtaacggtaactttagttttccgacttttaaggtttactaccggttcgtaaccgacgttacgtaaacgttacgtaacgtccgtaccggttaccggtcccgttaccccggttacggttacccgggaacccgtaaccggggtaacgttaaacgggttaaacgttaaacccggtaaaccgttaaaccggttaaccggttaacgggttaccggtacctaccggtaaccccttaaccggttaccgtttactttaacccgg

SEQ ID NO: 251081 - DNA, 967 bp, Homo sapiens
  misc_feature: GYAE6OF02HIQU3.15.49.E05.1.454.CMB.1.raw
  modified_base (153)..(153): a, c, t, g, unknown or other
  misc_feature (153)..(153): n is a, c, g, or t
  modified_base (172)..(172): a, c, t, g, unknown or other
  misc_feature (172)..(172): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactgganaaatgtaatgacgcagtcnccagccacctgtctgtctctcgagggaaancgccacctntcctggcagggccagtcaggtatatcgacgagactaagttcgccgttaggaccgagtccaacgtaaccgtggaccaacggtaccctaccgaagaccttaccggttactacgttccgtttacgaccttaagacttcgtacggtcccgtaaacggggtccacggttacgcctaaccgttcccgacggttaccccgaacggttttcgaacggggttccggtacccgttaagggggttttcccggttacgggtaaccgggggaaacctttaacggggtttacccgtttaacggttaccctttacccggtttaccgtaaaccccggtagtttaccccgtaacgggtaaaccccggttaccggttacccgttaacgggttaccgtaaacggggtttccgttaaacggggttaaaacgttttaccggtttttaacggttacccggtttttaaacgggtttttttaaaccggtttaaccgtttaacggttccccggttaaaggtttaaaccggtttaaaccggttaaactttaaacgggtaccggtttacccgggttacggtttaacccccggggtaccgggtttaaccgggttaccccggggtaaaaccggggtttaacccgggtaaacggggtttaaacggggtttaaaccccggtaaaacgtttaaccccggggaaaaaccggttttacggtccggggttttaacgtaccggttaaaccccggttaacgtaacgggttttcccgttaaaccgttttcccgg

SEQ ID NO: 251082 - DNA, 733 bp, Homo sapiens
  misc_feature: GYAE6OF02F0P3O.15.49.E05.1.454.CMB.1.raw
  modified_base (169)..(169): a, c, t, g, unknown or other
  misc_feature (169)..(169): n is a, c, g, or t
  modified_base (209)..(209): a, c, t, g, unknown or other
  misc_feature (209)..(209): n is a, c, g, or t
  modified_base (720)..(720): a, c, t, g, unknown or other
  misc_feature (720)..(720): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccacgtggagaaatagtaatgacgnagtctccagcccaccctgtctgtgtcctaccgaggggaancgcccaccctctcctgcgagggccaggtcagtagtattgacagactaagttacgcctaggtaccagcaagaaaccgtggaccagaccctcccagtacctcgtcagttcgttgaccttacacgttcgcggacccgacgggaccctacgtacggactacgtccccgagtcccgtaacggtttcgaggttcggcttagggtcgggttcgacgggactaggttacgttaccacgtttcccaaccgacctacgtacccgaagcctacggtccgtacgacgtacgtccgtaaggtagtttacttttacggaacttttaacggttttaacgtaccgttacggtaccgtaacgttacgttaacgtttaagttaacgttaccggtaccggttcccggtaacccttacccgggttaccgggttacccgggaacccggtaaacgggtaccgtaacggggtaaacgtaaaccgtaccgtaaacggttcggttacggttcgaccgtacggaccctaacccgttnttacccgttaccg

SEQ ID NO: 251083 - DNA, 707 bp, Homo sapiens
  misc_feature: GYAE6OF02IK5PK.15.49.E05.1.454.CMB.1.raw
  modified_base (156)..(156): a, c, t, g, unknown or other
  misc_feature (156)..(156): n is a, c, g, or t
tcagtctacgtagccacgaccggtgctcgatttagagcgactagcaacacgacgaaagggggaggaactgctcagttaggacccagacggaaccatggaagccccagcgcagcttctcttcctcctgctactctggctcccagactaccactgganaaatagtaatgacgcagtctccagcccaccctgtctgtcgtctcaggggaagcgacccaccgtctccgtgaccgagggccaggttccaaggagtattggacacgacaagttcgcctggtaccagcaagaacctggccagacctccagctcgctatctttgcctacatctagccgaggtccacgtcggaccacgtcccaggtccacgttcacggttcggactagggttcggtcgtaggggactaggtacgtttctacgttctacacctatacgaacgcgaacgtccgtagtcgtacgtaccgtagtaaacgtctttttacggacgttagtttttaacgttcgttaacgtccgttaaggtaccgttaaggttaactaaacggtttcgaaccggtttacccgggtacccgtttaaacccggtcgggttttacccgggaacccggtaacggggaaacccgtttaaggggtaacggtaaaccgttaaccggtaaaccggttaaccgttacgggtaccggtacggttcgtaacccgtaccgtacgtacccgttacgg

SEQ ID NO: 251084 - DNA, 664 bp, Homo sapiens
  misc_feature: GYAE6OF02GUCXD.15.49.E05.1.454.CMB.1.raw
  modified_base (342)..(342): a, c, t, g, unknown or other
  misc_feature (342)..(342): n is a, c, g, or t
  modified_base (444)..(444): a, c, t, g, unknown or other
  misc_feature (444)..(444): n is a, c, g, or t
  modified_base (474)..(474): a, c, t, g, unknown or other
  misc_feature (474)..(474): n is a, c, g, or t
tcagtctacgtagccacgaccggtgctcgatttagagcgactagcaacacacaaagggggaggaactgctcagttaggaccagacggaaccatggaagccccagcgcagcttctcttcctcctgctactctcggctcccagataccactggagaaatagtaatgacgcagtctccagccaccctgtctgtcgtctccgaggggaaacgacgcctaccttctccctgaccaggggcctagtccgaagagtattggaacacggcaagttagccgtggtaaccagctaacggaaacctgggacccaaggtacctaccccagacttcgactatctttcgctaactnctcggacctcgggacctactcggcaacttccgaacgcctaacgtttccgagttcgggcaggttgggtcctgggacagtacggtttcacggttcaacgactancgtacgctacgcgtacgctacgtcggtaanaggttctttaggacccttaaggtttaacttcgttacgcgtaacgctaagttacgtaaactcgtcttacgggaccctcggtaccgttcggacccgtaggaacccggtaacggtaacggtaaacgtaccggtaaaacgtaaccgttacggaagggtacccggttagaaccgtttacccgagttaccggttcc

SEQ ID NO: 251085 - DNA, 716 bp, Homo sapiens
  misc_feature: GYAE6OF02GWD1C.15.49.E05.1.454.CMB.1.raw
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (331)..(331): a, c, t, g, unknown or other
  misc_feature (331)..(331): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagattaaccactggagaaatagtaangacgnagtctcagccacctgctgtgtctcgaagggaaangcccaaccttctccngcgacgggtaccagtcaagacgtaatcggacagactaagttagctacggtaccagaacagtaaacctggaccaagacctaccaagtactcgtatacgttcgtttagactanacgtcgtacgaccgagggaccctaaacggtcggtaccacgttaccccaacggcctaacgtttaccgaacggttcgggaaccgtagggtttcccgggtgttaacgggggaaacctaacggttaacgtttacgtacggtttcccttaacgtacccgttaacgtacgtaagaccgaacgtccgtacgtaccgtagttaccgtaaggtaacgttaagtttacgtactagtttaactacgtaggtacagtactaagttacttaatcggtacgtacgtaccgtaccgtaccggtacgtaccgaacggtaacggtaacgggtaacgaaacgtaacgtaaaacgtaaccgttaagggtacggtaccgttaaggacaccggttagtacggttac

SEQ ID NO: 251086 - DNA, 765 bp, Homo sapiens
  misc_feature: GYAE6OF02FR87W.15.49.E05.1.454.CMB.1.raw
  modified_base (216)..(216): a, c, t, g, unknown or other
  misc_feature (216)..(216): n is a, c, g, or t
  modified_base (264)..(264): a, c, t, g, unknown or other
  misc_feature (264)..(264): n is a, c, g, or t
  modified_base (475)..(475): a, c, t, g, unknown or other
  misc_feature (475)..(475): n is a, c, g, or t
tcagtctacgtagccacgaccggtgctcgatttagagcgactagcaacacacaaagggggaggactgctcagttaggacccagacggaaccatggaagccccagcgcagcttcctcttcctctgctactctggctcccagataccacgtggagaaatagtaatcgacgcagtcctcccgagcccaccctgtctggtgtcctacccgaggggaaagngcccgaccctctcccgtgccggaggccagtccagtacgtattggaacngacagtttacgccgtggaccacgacacgaaaccgtcggacccgtacgaccttccccaacggcctacgtacctattccgtttacaccttacctacgttccgtcgtaccgaccggacccgtacgttcggaccgtacctacccaacgtcccgtacggtcgacgtgtacgaggtccgggttcgtggggacacggtacgttacctacgttttaccncgaacccgactacgacgcgacgtacccgttgacctagttcttacggaagtttacgttttacggaccttttaacgttaacgtttaccgttacgtaccgtaacgtcgtaacggttacttaaaaggttccggaccggtttacgggaccccgtttccggtacccgttacggggtaccccgtaacggggtacccgaaacgggggtttaaaccggaaacggttaaacccggtaaacgtaaccggtttacggacgggttaccgacccgggacctacccggtactttaccggtttacc

SEQ ID NO: 251087 - DNA, 790 bp, Homo sapiens
  misc_feature: GYAE6OF02G5GJD.15.49.E05.1.454.CMB.1.raw
  modified_base (212)..(212): a, c, t, g, unknown or other
  misc_feature (212)..(212): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctcagccacctgtctgtgtctccgagggaagcgccaccctntcctgcgagggccagtcagtagtattgacagactaagttcgccgtaggtaccagcaacgaaaccgtggacctaagcccgtacccaagtaccgtcgtactaacgttcctttagacctaactatcctacggacccgacgggaccctaggtcggaccaccgtaccccgaaggtccccgtaacgttcgtaacggtcgggaacctagggggttacggtaccgggttaggggaaacctacggttaacggttttccgacttttaccccgtacgaacccgttaaacgtccgaacggtaccttaccgggtacctaccggtacgtaacgttaccgttaacggtaaacggtttacgttttcgtaacgtttaacgttttaactttaccgttacggtctaacgttacgtaacgttaagttaacgtacgggttacgttacccgggttacccgtaaccgggttaacccggtttaccggggaaccgtaaccggggtaaccgggttaaagggtaacggtaaacggtaaaccggtaaaccggttaaccgttaggtaccggttacgtacgtaccgtaaccgtaccgtccgtttacgg

SEQ ID NO: 251088 - DNA, 790 bp, Homo sapiens
  misc_feature: GYAE6OF02G3R0N.15.49.E05.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtcnccgaggggaancgcccacctctcctgcgaacggccaggtaccagtacggtattcggacagactaaggttagaccgtaggtaccaagcgaacgtaaaacccgtgggaccaacggaacccttcccccgaaatcccgttcgtaccttaacgttccgttttacgctttaacacttcgcggcctaagggccaacgttcggaccacgttacccgagtacccgaccgtttacacgggtttcggacgtaagggttccggggttccgtaagggggaacctagggtacgttttaaccaagttttcccaccgtaaccgtaacgttacgaacggtacgaacgttccggttagaccgttaggttaccgttaacggtaaagtttacgtttttacggtacgttttaacgttttaacttaaccgttcgttactaacgggttctaaacggtttaacgttaaacgttaccggttaccggtacggttacccgttacggtaacccggtttacccggggaaccgtttaacggggaaccgttaaacggggtaggttaaaaccgtacggtaaacgaacggttagttacgggtccaagtaccgaacttacggtcttacgg

SEQ ID NO: 251089 - DNA, 779 bp, Homo sapiens
  misc_feature: GYAE6OF02F10CI.15.49.E05.1.454.CMB.1.raw
  modified_base (238)..(238): a, c, t, g, unknown or other
  misc_feature (238)..(238): n is a, c, g, or t
tcagtctacgtagccacgaccggtgctcgatttagagcgactagcaacacacaaaggggggaggaactgctcagttaggacccagacggaaccatggaagcccagcgcagcttctcttcctcctgctactctggctcccagataccactggagaaatagtaatgacgcagtctccagccaccctgtctgtgtcctccgaagggaaagacgcctaccctctcctgcgagggccctagtnacgagttattgacagacgaagttcgcctaggtaccagacgtaacgaaaaccgtcggccaacggtaaccctccccggaagaacccgtttccggttactaacgttttccgtttagacccttaaactccttaccttcgggacccgtaaacgggggtccctaaccggtgggccctaaccgtacccgaacggtccctacggttaccgtagggtcggacctaggggtttcgggtacggtacggtaacgaaggttcgtttaccacgtttacctccgaacctacgtaccgaacggtcctacggacccgttacgaccgttaacggtcgttaaacggttaacgtttaaccgttttaggtaaccgtttttaacggtttaacttttaccgtacggtttacaccgggttactaagtttaacgtaattaccggtacgttccgtacccgttaccggtaccggtttccggaaacccggttacggggaacgttaaccgggtaggaaaccttaacgaaccggttaacgtggtacggactcggacctacggattactcgg

SEQ ID NO: 251090 - DNA, 875 bp, Homo sapiens
  misc_feature: GYAE6OF02IWFXL.15.49.E05.1.454.CMB.1.raw
  modified_base (207)..(207): a, c, t, g, unknown or other
  misc_feature (207)..(207): n is a, c, g, or t
tcagtctacgtagccacgaccggtgctcgatttagagcgactagcaacacacaaagggggagaactgctcagttaggacccagacggaaccatggaagccccagcgcagcttctcttcctcctgctactcctggctcccagactaccactggagaaatagtaatgaacgcagtctccagcccacctgtctgtcgtctccgagggaancgcccacctctcctgcagggccagtcagacgtattgaccagactaaggtttacgcccgttagtacccgaagaccgaaacgaaacccgttcggaacctcgtaccctaccccgaagactttcccggacttaagttccgttttacgaccttaactacgtttaccgtcggacccggtacgggtaacccctacggtcggtacccctaccgtacccggtaacggtcccctttaacggttactaacgggttacgggtccgaacggggtttccgggtcggtaaaccgggggaaaccttagtaacggttttccctaacgttttcccgaacccgaaccttaacgttaaccggacgtaaccgtacccggttacccgtgtaacccggtaaccgttcggtaaccggttaaaaggttttcggttttaacgttacggtttttaaacggttttacgttaacccttttaaccggtacggttaaccggtactttaacgggtttaatttaaccggttaccggttaccgttaccgggttacccgtacccggtttaaccggtacccgggtaaccggtacgggtaacccggttaacgggggtaacgtttaaaccgtaaacggtaaacccgttaacgggttacgtaacggtccggttaccggaacctcccggttaacgttccggtttaccg

SEQ ID NO: 251091 - DNA, 631 bp, Homo sapiens
  misc_feature: GYAE6OF02IETUS.15.49.E05.1.454.CMB.1.raw
tcagtctacgtagccacgaccggtgctcgatttagagcgactagcaatacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaagagccaccctctcctgcagggccagtcagagtatgacagcaagttagcctggtaccagcaacgaacctggccagacctcccagactcgtcacttctttgcttacactctacgcctacgggccacgtggccactcccacgtcctacgtttcgaggttcggcgtagggttcgggtacgtcggggactaggtacgttacctatttccaccacctatcacgcgacgtccgtgcgtacgtctaggtaaagtttgtttcgtactttaaggttttacttacgtgtaccgtagtactaagttagtaagttacgacgttccggtacccgtacggtaccgttaccgggacccggtaacgggtaacggtaacgggtaaggtaaacctaacggaaaccgttaagcggttagccggtacgaccctacgtacgttcgttcg

SEQ ID NO: 251092 - DNA, 711 bp, Homo sapiens
  misc_feature: GYAE6OF02GN27D.15.49.E05.1.454.CMB.1.raw
  modified_base (289)..(289): a, c, t, g, unknown or other
  misc_feature (289)..(289): n is a, c, g, or t
tcagtctacgtagccacgaccggtgctcgatttagagcgactagcaatacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgagggaaagacgccaccctctcctgcgagggccagtcagagtattgacagcaagttagcctggtaccagccaagaaacctggaccagacccncccagacctcgtcctattcttgacctactatccgtcgccgacggggtcccacgttcggacctacctccccgacgtaccccgtaccgttcgtacgggtcggaccgtaggggttcggggtaccgttaggggaccgtaaggtcgtttctactttccgtacctaacccgtacgttacgacgtaccgcggtaccccgtgccgtaacggttcgtaaggtaaacgtttcgttttacgaccgttttaaggttttacttacgttacgtttaccgagtaccttaaggtaatttacgtaggtaccgttccgggtacccgttccggtaaccgggttccgggaccgggtaacgggtaccggtaagggtacgtaaaacgttaccggaaaccgttacggtcggttagaccgtaccgaccgtactaccgttgtacccg

SEQ ID NO: 251093 - DNA, 671 bp, Homo sapiens
  misc_feature: GYAE6OF02F36II.15.49.E05.1.454.CMB.1.raw
  modified_base (633)..(633): a, c, t, g, unknown or other
  misc_feature (633)..(633): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagatacccactggagaaatagtaatgacgcagtctccagccctaccctgtctgtgtctccgaggggaacggccaccctctcctgcgacgggccagtcagtagtattgacagcaagttagcctggtaccagacaagtaaccgtggaccagtacctaccccgagaccttccggtacacttcttttagctacgtatccgtgacccgtacgggccctacgtcggaccacctcccgacgccgtaccgttacgacggtggtaccgagggttgggtacgtacgggactacggttacgttactaccgtttcacccgtaacagttaccgagtccgtacgtcctagtacctagtccgttaaggacgttactttgtacgttagttttattccgttgtacgtagtacgtaagtaattagtcgtacgttcgtaccgttaccggttcggttaccggaccgttaacgggaccgtacggttaacggaaacctaacggaaaccgttacggngttaccggacttcggacctacgtctaccgtcgttaccg

SEQ ID NO: 251094 - DNA, 776 bp, Homo sapiens
  misc_feature: GYAE6OF02FQY4O.15.49.E05.1.454.CMB.1.raw
  modified_base (208)..(208): a, c, t, g, unknown or other
  misc_feature (208)..(208): n is a, c, g, or t
  modified_base (254)..(254): a, c, t, g, unknown or other
  misc_feature (254)..(254): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagngcccaccctctcctgcagggccagtcagatatgacagacaagttcncctggtaccagcagaaacctggaccagacctcccgagtacctcgtctattctttcgcttaaccatcctcggcccgacggggcccctacgttcgggacctacctccccgaacggaccccgttacgttacgtaacggtcgggaccgttacgggttcggggttcggtaggggtaaccgtaaggttaccggtttaccgtaacgttttcctacccgaacccgtacttaaccgaggtaccccgacggttcccgttacggaccgttacgttaccggtaaggtaaacggttttacgttttaggtaccctttaaggttttttaaacgttaccgtttaggtaaccgttacggttaccgtaaaggttttaacgttaacgtttaccggtaccggttacccgggtccctttaacccggggttaccggttacccgggaaccgggtaaccgggtaccgtaacgggggttaacggtaaacgtaaccggtaaacgtaccggttaggtcggacgttaccgaccgtacgtacgtacgttcc

SEQ ID NO: 251095 - DNA, 713 bp, Homo sapiens
  misc_feature: GYAE6OF02GXPYQ.15.49.E05.1.454.CMB.1.raw
  modified_base (208)..(208): a, c, t, g, unknown or other
  misc_feature (208)..(208): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (473)..(473): a, c, t, g, unknown or other
  misc_feature (473)..(473): n is a, c, g, or t
  modified_base (672)..(672): a, c, t, g, unknown or other
  misc_feature (672)..(672): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagcccaccctgtctgtgtctccgaaggggaaancgcccaccctctccgtgccgtagggccagtcgagtaggttattcgaacaggtacaaggttcgccgtagggtaccaggccaaacgtaaccgtcggcctacgacctacccagaccttgtacctattcgttgacctaacnttcgacgccgacggaccncgtacgccncctacccacgtccgtaccgttgaggtcggtcgtacgggtggttcggaggactagtacgttacctagtttcccaacgtaccgtactacgtaccgaccgtccnccgtcggtacttacggttcgtaacggtacgttttgttttaccgacgtttagtttttaccgtacgttaggtacctgtacttaaacggttaattagtacccggtaccgtttccgggtccccgttaccggtaacgggttcccgggaaacgtacccggggtagtaaacggtaacggtaacgttaaaccggtaaaccgtacggngggttacggcctacgggaccctaccgtttagccctttacgg

SEQ ID NO: 251096 - DNA, 786 bp, Homo sapiens
  misc_feature: GYAE6OF02II345.15.49.E05.1.454.CMB.1.raw
  modified_base (154)..(154): a, c, t, g, unknown or other
  misc_feature (154)..(154): n is a, c, g, or t
  modified_base (170)..(170): a, c, t, g, unknown or other
  misc_feature (170)..(170): n is a, c, g, or t
  modified_base (214)..(214): a, c, t, g, unknown or other
  misc_feature (214)..(214): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctaccagactaccactgganaaattagtaatgacgnagtctaccagtccacccttgtctgtgtcctaccggaaggggaanacgccacccgtctcctgcgacgggccaggtccaggtaagttactggaacctaggactaacggttacgccttagggtaaccagaccgtaaggaacctcggaccacggtacccacccagtaacctcggtacttaccgttgtttaccgacctaactctcgtccgccggaccgggacctaagttcggacctaccttacccgaccgtcccggtaacgtttcgacggtacggtccggtaacggtttcggggtaccgttaggggaaacccgtagttacgttaccgtatttaccgtacaacgacgttaccgaaaccggtagcccgtctacgtaccgtaggtactaagggtaattcgtttacggactttatttaccggttctagaccggtagactaaggttttacacgttaacggtaccgttaccctaccgggtttacgtaacccgggtttcggaaaccgacccggggttaacggtttaaacggggaaacctttaaaccggtaaacggaaacccgtttaagggacccggtttaagggttcccgacggtaaacccggtacccttacgtaacccggttttccg

SEQ ID NO: 251097 - DNA, 765 bp, Homo sapiens
  misc_feature: GYAE6OF02HFUXO.15.49.E05.1.454.CMB.1.raw
  modified_base (154)..(154): a, c, t, g, unknown or other
  misc_feature (154)..(154): n is a, c, g, or t
  modified_base (210)..(210): a, c, t, g, unknown or other
  misc_feature (210)..(210): n is a, c, g, or t
tcagtctacgtagccacgaccggtgctcgatttagagcgactagcaatacacaaaggggggaggaactgctcagttaggacccagacggaaccatggaagccccagcgcagcttctcttcctcctgctactctggctcccagataccactgganaaatagtaatgacgcagtcctcagcccaccctgtctgtgtctccgaaggggaaacngacccaccctctcctgcgagggcctaggtacagtagttcttagaactagaccgtaaagttacgcctacggtaaccagaccaaggaaaccgtggaccaacggacctacccgaagcctacggtactacttactttcgaccttaacgacttcgtaccgtacccggacgggtacccacggtacggactaccgtcccgacgtaccctacgttacgacggtcgacgtaggttcgggtactagggacctgtacgttcgactttcgaccgtaactactacgtaacgccgaccgtaccgtacgtacgtagttacgtacggtaacggtttacgttttaggtacgttttaagtttaactttacgttcggttaacgacgttacgttaaacggtttaattaaagttcgttacgttaccggtacccgttaccgggttaacgttacccggggaacccgttacggggaaccgttaaacggggtaaacggttaaaccgttaaacggtaaaaaccggtacgtacggggtttacggtacgcgttaaccccgaacgttaccgttaaccggttccg

SEQ ID NO: 251098 - DNA, 748 bp, Homo sapiens
  misc_feature: GYAE6OF02FX4DE.15.49.E05.1.454.CMB.1.raw
  modified_base (204)..(204): a, c, t, g, unknown or other
  misc_feature (204)..(204): n is a, c, g, or t
tcagtctacgtagccacgaccggtgctcgatttagagcgactagcaatacacaaagggggaggaactgctcagttaggacccagacggaaccatggaagccccagcgcagcttctcttcctcctgctactctggctcccagactaccactgagaaatagtaatgacgcagtctccagccacctgtctgtgtctccgagggaaancgacctaccctctcctgccgagggcctagtcagatacttggaacctacgaacgagttacgtacccgtaggtacccaagccgaacgtaaaccgtcggacccacgtaccctcccaagacctcgtactacgttcgtttacgaccgtaactacgtaccgttacggaccgacgggcccttaacgtccgggaacctaccgtaccccgtacggacccctagtttaccgacggtcgaaccggtacgggtgggtccgtaagggcctaggtaccgttataccggttcctaccgtacctaacggttacacgtaccgtaacgtcgtaacgtcgtaacggttaccgtaaggtaacgtttactttaccggtaacgtttacgttttaactacggttcgtaaccgtaaggtacttaaggttagttaacgtggtacctacgggcccttaccggtacgggttaccgaaccgggttacgggtaacccaagggttaaccggtaaacctaaccgggaaagtaccgtaggttacgtaccgaccttaccggactttacgcgttaccg

SEQ ID NO: 251099 - DNA, 763 bp, Homo sapiens
  misc_feature: GYAE6OF02GH6P0.15.49.E05.1.454.CMB.1.raw
  modified_base (205)..(205): a, c, t, g, unknown or other
  misc_feature (205)..(205): n is a, c, g, or t
tcagtctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcacgtctccagccaccgtgtctgtgtctacgagggaancgcccacctctcctgcgagggccagtcagtagtatgacagactaagttcgccgtagaccaggacaacgaaccgtcggaccagtaccctacccgaagtaccgttccgtactaactttccggtttacgacccttaacgtacttccgtccggaccggtaccggggacctaccggtacggtaaccctaaccgtcccgtacgtacccgtacgttacgacgggtcggacgtacgggttcgggtacgtacgggaactacgttacgttactacgttcccaaccgtaccgtactaccggacgtaccgaccgtcccggttaggacctttacgggtacgttaagggttaacgtttaccggtttagtaccgttttaacgtttacgttacgtacgtaccgtaggtacttaaggttacgtaacgttcggtacgtaccggtaccgttaccggtaacggttaccgggaaccggtaacgtaaccgggtaacggttaaacggtaaaccgtaaccggttaaaccggtacggtaggttccgtacgtaccgtaaccgtaccggttacgtaccgttaccg

SEQ ID NO: 251100 - DNA, 699 bp, Homo sapiens
  misc_feature: GYAE6OF02JHUUW.15.49.E05.1.454.CMB.1.raw
  modified_base (561)..(561): a, c, t, g, unknown or other
  misc_feature (561)..(561): n is a, c, g, or t
tcagtctacgtagccacgaccggtgctcgatttagagcgactagcaacacacaaagggggaggaactgctcagttaggacccagacgtaaccatggaagccccagcgcagcttctcttcctcctgctactctggctcccagataccactggaagtaaatagtaatgacgcagtcctccacgcccacccgtgttctgtgtctaccgaggggaacacgccacccttctccgtgaccgacgggtccacggttcgaagtagttagtcgaacgagacgtaagttaaccgcctcggtaaccgacggacaacggtaaaaccgtcggacctaacggacctacccgacgtacgttccgtactacgtttcctttcgtactaccttaacgtccttcgacccggtacgggccgtacgtacggcctacctacccgtaacgccctacgttacgacgggtgaccgtagggtgggtcggtacggaacgacggttataccgttactttcaccgtaccacgctacgcgtacgcctgcgtcgtacgtagttatagtttgactttagtttatacgttcgtntaagtctaacgttactaagtcgtacgcgttacgtccgtacggttccgaacggtacgggaacgtaacgggtaaacgtaacgtaaccggaacgttacggtacggtaccggtctaccggtacctaacgtcgtcttacccgg

SEQ ID NO: 251101 - DNA, 726 bp, Homo sapiens
  misc_feature: GYAE6OF02JFISE.15.49.E05.1.454.CMB.1.raw
  modified_base (163)..(163): a, c, t, g, unknown or other
  misc_feature (163)..(163): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctccagataccactggagaaatagtaangacgcagtctccagcccaccctgtctgtcgtctaccgaaggggaaagcgcccaccctctccgtgcgagggccagtcagagtatcgacagactaagttcgccgtaggtaccagcaacgaacctcggaccacgacctcccgagacctcgtacacttcttcgacctacactcgtcggccgacgggccctacgtcggacctaccgtacccgacgtacctaccgttacgacggtcggacgtacggggtcggtacgtagggaactacggttacgttactacgtttcaccgtaccgtactcgtacgaccgtactccgtcgaccgtagtcgtacggtaagttcgttacgtaacgttagtttaacgttacgttcgtacgtacgtacgtaacgttaagttaacggttccgtaacgttcccggtaccgttaccgggtaaccggttaccgggtacgggtaacccgggtaacgggtaaccgggttaaacggtaaaccgtaaccgtaaaaccgggttacggtaacgggtacggtacccgttaacgacccgtttaaccgtacgttacccggtttaacg

SEQ ID NO: 251102 - DNA, 694 bp, Homo sapiens
  misc_feature: GYAE6OF02GV6I8.15.49.E05.1.454.CMB.1.raw
  modified_base (208)..(208): a, c, t, g, unknown or other
  misc_feature (208)..(208): n is a, c, g, or t
  modified_base (419)..(419): a, c, t, g, unknown or other
  misc_feature (419)..(419): n is a, c, g, or t
tcagtctacgtagccacgaccggtgctcgatttagagcgactagcaacacacaaagggggaggaactgctcagttaggacccagacggaaccatggaagccccagcgcagcttcccttcctcctgctactctggctcccagataccactggagaaatagtaatgacgcagtctccagcctacctgtctgtagtctaccgaggggaaancgcccaccctctcctgccgagggccagtcgagagttacttagacctagacctaaggttacgccgtaggtaaccagacacggtaaccgtacggaccacgtacctcccgagaccgtaccgtactacgttcgtttacgacctacaacgttccgtcggaccgtacgggccctaacggtcggctacctccggaactccgtagttcgaggtcggacnggttcggtacgaggggatacggtacgttacgtcttaccgtaccaccgtaagtccgacgtacgacgtccgtcggtactagtccgtaagttacgtacgtttacgtattacgtttacttcgtactcgagtactaagttacgttagtcctaacggtccgttaccgttaaccggtaccggttaacgaaccgtaaggtaccgtaacgggtaacgtaaccgttaacgaaaccggttgtacgtacgtaccttagacccgttacgtacttccgttacgttaccg

SEQ ID NO: 251103 - DNA, 608 bp, Homo sapiens
  misc_feature: GYAE6OF02F12CZ.15.49.E05.1.454.CMB.1.raw
  modified_base (189)..(189): a, c, t, g, unknown or other
  misc_feature (189)..(189): n is a, c, g, or t
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (294)..(294): a, c, t, g, unknown or other
  misc_feature (294)..(294): n is a, c, g, or t
tcagtctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagccacctgtctntgctaccaggggaaangccacctctcctgcagggccagtcagagtattgacagcaagtacncctggtaccagcagaaacctcggaccagacctcccagactcgtnatctttagctacatctgccgagggccacgtcggacactcccagaccacgttcaagtcggactaggtcgggtctaggacagagttcattcacacatcagacagctgactagtaccgtagtaagtattttcggacttaagttttacttacttaggttaccgaagtctaagttattaactaggtaaccgttcggtacccttaccggtaacggttacccggacccgttaacggggtaacctaaacgggtacggaaaacgtacgaaaaccggtacgttacggtaggtcctaccggtaccgtaaccgtacgtcttaccgg

SEQ ID NO: 251104 - DNA, 215 bp, Homo sapiens
  misc_feature: GYAE6OF01DAXU5.1.88.H11.1.454.CMB.1.raw
  modified_base (214)..(215): a, c, t, g, unknown or other
  misc_feature (214)..(215): n is a, c, g, or t
tcagacgagtgcgtcacgaccggtgctcgatttagcgacagcgagtcgcgggggaggaactgctcagttaggacccagacggaaccatggaagccccagcgcagcttctcttcctcctgctactctggctcccaggaactgtggctgcaccatctgtcttcatcttcccgccatctgaacgcactcgtctgagcgggctggcaaggcgcatagnn

SEQ ID NO: 251105 - DNA, 215 bp, Homo sapiens
  misc_feature: GYAE6OF01BB6T7.1.88.H11.1.454.CMB.1.raw
  modified_base (214)..(215): a, c, t, g, unknown or other
  misc_feature (214)..(215): n is a, c, g, or t
tcagacgagtgcgtcacgaccggtgctcgatttagcgacagcgagtcgcgggggaggaactgctaagttaggacccagacggaaccatggaagccccagcgcagcttctcttcctcctgctactctggctcccaggaactgtggctgcaccatctgtcttcatcttcccgccatctgaacgcactcgtctgagcgggctggcaaggcgcatagnn

SEQ ID NO: 251106 - DNA, 221 bp, Homo sapiens
  misc_feature: GYAE6OF01AQZPL.1.88.H11.1.454.CMB.1.raw
  modified_base (212)..(221): a, c, t, g, unknown or other
  misc_feature (212)..(221): n is a, c, g, or t
tcagacgagtgcgtcacgaccggtgctcgatttagcgacagcgagtcgcgggggaggaactgctcagttaggacccagacggaaccatggaagccccagcgcagcttctcttcctcctgctactgtggctcccaggaactgtggctgcaccatctgtcttcatcttcccgccatctgaacgcctgtctgagcgggctggcaaggcgcatagnnnnnnnnnn

SEQ ID NO: 251107 - DNA, 220 bp, Homo sapiens
  misc_feature: GYAE6OF02HI93M.1.88.H11.1.454.CMB.1.raw
  modified_base (213)..(220): a, c, t, g, unknown or other
  misc_feature (213)..(220): n is a, c, g, or t
tcagacgagtgcgtcacgaccggtgctcgatttagcgacagcgagtcgcgggggaggaactgctcagttaggacccagacggaaccatggaagccccagcgcagcttctcttcctcctgctactctggctcccaggaactgtggctgcaccatctgtcttcatcttcccacctcctcacgcactcgtctgagcgggctggcaaggcgcatagnnnnnnnn

SEQ ID NO: 251108 - DNA, 255 bp, Homo sapiens
  misc_feature: GYAE6OF02G854Z.1.88.H11.1.454.CMB.1.raw
  modified_base (216)..(255): a, c, t, g, unknown or other
  misc_feature (216)..(255): n is a, c, g, or t
tcagacgagtgcgtcacgaccggtgctcgatttagcgacagcgagttcgcgggggaggaactgctcagttaggacccagacggaaccatggaagccccagcgcagcttctcttcctcctgctactctggctcccaggaactgtggctgcaccatctgtcttcatcttcccgccatctgaacgcactcgtcctgagcgggctggcaaggcgcatagnnnnnnnnnnnnnnnnnnnnnnnnnnnnnnnnnnnnnnnn

SEQ ID NO: 251109 - DNA, 249 bp, Homo sapiens
  misc_feature: GYAE6OF01BQHVK.8.55.E11.1.454.CMB.1.raw
  modified_base (248)..(249): a, c, t, g, unknown or other
  misc_feature (248)..(249): n is a, c, g, or t
tcagctcgcgtgtccacgaccggtgctcgatttagcactcgcacgttgggtttgggggtgtggtggtctccactcccgccttgacgaggccgactattactgcggagcatgggatagcagcctgaacactgtggtcttcggcggagggaccaagctgaccgtccttagtcagcccaaggctgccccctcggtcactctgttccgccctcctcactactcacactgagcgggctggcaaggcgcatagnn

SEQ ID NO: 251110 - DNA, 600 bp, Homo sapiens
  misc_feature: GYAE6OF01BJMET.8.55.E11.1.454.CMB.1.raw
  modified_base (249)..(249): a, c, t, g, unknown or other
  misc_feature (249)..(249): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgcctccctctcctcctcacccttctcattcactgcacaggtcctgggcccagcctgtgttgacgcaggccgccctcagtatccgtggccggccccgggacaggacgggtccaccatcctcctgcctccggaanccacctcaaattgttggggactagttttgtagtcgtggtatcagcaacggtccccgaacaccgacccccaaactcctnatttangagataagtgagcgacgttcgaaggtaacttcctagtaccgtttctcgtggcctaccaagtctggcctacgtcacgcccaccgtgggcagtccgaccgactccgacgacgtcggggacgacggccgtactagttacgtggacggagctaggtagggataggcacgccgtagaacctcgtaggtcggtacggttcgggacgggaacgggaccaaggtccttacggtacccgttccgttacggtaccgaccggcccgtaagggtccccg

SEQ ID NO: 251111 - DNA, 248 bp, Homo sapiens
  misc_feature: GYAE6OF01CSE52.8.55.E11.1.454.CMB.1.raw
  modified_base (247)..(248): a, c, t, g, unknown or other
  misc_feature (247)..(248): n is a, c, g, or t
tcagctcgcgtgtccacgaccggtgctcgatttagcactcgcacgttgggtttgggggtgtggtggtctccactcccgccttgacgaggccgactattactgcggagcatgggatagcagcctgaacactgtggtcttcggcggaggaccaagctgaccgtcattagtcagcccaaggctgccccctggtcactctgttcccaccctcctcactactcacactgagcgggctggcaaggcgcatagnn

SEQ ID NO: 251112 - DNA, 281 bp, Homo sapiens
  misc_feature: GYAE6OF01C9FKH.8.55.E11.1.454.CMB.1.raw
  modified_base (246)..(281): a, c, t, g, unknown or other
  misc_feature (246)..(281): n is a, c, g, or t
tcagctcgcgtgtccacgaccggtgctcgatttagcactcgcacgttggggtttggggggtgtggtggtctccactcccgccttgacgaggccgactattactgcggagcatgggatagcagcctgaacactgtggtctcggcgatggaccaagctgaccgtccttagtcagcccaaggctgccccctggtcactctgtcccgcctcctcgagcgacgactgagcgggctggccaaggcgcatagnnnnnnnnnnnnnnnnnnnnnnnnnnnnnnnnnnnn

SEQ ID NO: 251113 - DNA, 594 bp, Homo sapiens
  misc_feature: GYAE6OF01BQWLV.8.55.E11.1.454.CMB.1.raw
  modified_base (240)..(240): a, c, t, g, unknown or other
  misc_feature (240)..(240): n is a, c, g, or t
  modified_base (321)..(321): a, c, t, g, unknown or other
  misc_feature (321)..(321): n is a, c, g, or t
  modified_base (364)..(364): a, c, t, g, unknown or other
  misc_feature (364)..(364): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccgggacagagggtcaccatctcctgctccggaancacctcaaatagttggggactagttttgtatcgtggtatcagcaacgtccccggaacacgaccccaaactcctacatttangagataatgagcgtacttcaggtaacttccgtgtaccgtttcncgtggcctccgaagtcttggacacgtcaacgccctaaccgtgggctacgtccgacccggactccgaagaccgtggggacgacggccgtaactagtacgtgcggagcgtagtgggactacgcacgcccgtagaacgtacgtcggtagttccgttccgggacgggtaagggacccgtaaggcgttacggacccggtttaccttaggacccgacggccccgtaagggtccccg

SEQ ID NO: 251114 - DNA, 812 bp, Homo sapiens
  misc_feature: GYAE6OF01AKHV5.8.55.E11.1.454.CMB.1.raw
tcagctcgcgtgtccacgaccggtgctcgatttagcactcgcacgttgggtttgggggagctctgcttcagctgtgagcgcagaaggcaggactcgggacaatcgtcatccatgacctgcctccctctcctcctcacccttctcattcactgcacgaggtcctgggcccagcctgtgttgacgcgacggccgccctcaggtactcgtcggcccggaccccgggacaggtacgggtccaacctatcctccgtcgaccgtaccgggaaacgcctaacctactaaaacgttacggttacgggggaaccttaggtttttcgtaacgttcggtggtaactccgacgaccgtaaccggtacccccggaaacaccgtacccccctaaaacttcccttacgtagtttaacgaggaacggtaacttaaacgtcggtaaccgaccggtaacggtttacgaacggttaacctttcccgttacggttaacccgttttcgtaccggtacggtccgtaaccgtaacgttccgtcggacctaccgtaccgacggtaccctaccggtgggacctacgtacccgacccggtaacgtaccgaaggtaccggtacgggaaccgtaccgggtaccctaacgttaacgttaccgtacgggacccggtaacggtcgtaaggtacgggaacgtacggtaccgtaccgttaccgtaacggtaaccgtcggttacggttaccgggttaccggttaccggggaccggtaacgggacccgtacggtcgttacccggacccgttacgttacggacccgaccggtacccggacggtccccg

SEQ ID NO: 251115 - DNA, 919 bp, Homo sapiens
  misc_feature: GYAE6OF01DWGMH.8.55.E11.1.454.CMB.1.raw
tcagctcgcgtgtccacgaccggtgctcgatttagcactcgcacgttgggtttgggggagctctgcttcagctgtgagcgcagaaggcaggactcgggacaatcgtcatcatgacctgctcccctctcctcctcacccttctcattcactgcacgagggtcctcgggcccagcctggtgttgacgcacggccgccctcagtatctcggccgggccccgggacaggacgggtacaacgattcctccgtggcctaccgggaacgccacctaacaaaagttagttacgggggaacttaggtttttagtaacgttcggtaggtactcgaacggaccgtaaaccgggtaccccccggaaacacccggtaaccccccctaaaaccttcccttacgttaacgttttaacgaggtaacggtaattaaagtcggaacggtaccggtacgttacgtaacggttaactttccgtacggttacccgttttctcgtacggtacctaccgtaacgttcgtacggacctacgtacgccgtacccgtaacccggtgggacctacgtaccccggtaaccgtaccgtaccggaacggtaccggggttacgggggaaccggtaccgggtacccgtaaacgtttacgttaccggtacgggaaccgggtaacggtacgtaacggggtacgggtaaccgttaaccgggaccgtaaccgggtaacccgttacggaaacccgttaaccgggttttcggggttaacccggggtttccccgggtttaacccgggggggtaaacccgggggtaaaccggggtaaaccccgttaaccggggttacccccggttaaacggggttaaccccccggttttacgggttaaccccggttaacccccgggtaaaccccgggaaccccccgggttaacgggttccccccccggg

SEQ ID NO: 251116 - DNA, 675 bp, Homo sapiens
  misc_feature: GYAE6OF01E5PT9.8.55.E11.1.454.CMB.1.raw
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (335)..(335): a, c, t, g, unknown or other
  misc_feature (335)..(335): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgcctcccctctcctcctcacccttctcattcactgcacagggtcctgggcccagcctgtgttgacgcaggcgccctcagtatctggccggccccggganagacggtccaccatcctcctgcctccggaanccacctacaaatagttggggactagttttgatcgtggtatcgagacaacggtccccggaacaccgacccccaaactcctactatttagngagataagtgagcgtacgttacgaggtaacttccgtcgtaccgtttctcgtggcctacagtctggcacgtcacgcccaccgtggactactccgaaccggacctccgaggtaccggtcgggggaacgacggcccgtaactacgtttacgtcggaccgggagaccgtaggtacgggactacggaccacgtacccgtaaggaaccgtacgttcgggttacggttacccggttaccgggggaccggggtaaacggggaacccctaaacgggtccgttacccggtaacccccgggttaccgtttaacgggtacccgaacccgggtaccccgaaacggggtccccg

SEQ ID NO: 251117 - DNA, 824 bp, Homo sapiens
  misc_feature: GYAE6OF01EDCAX.8.55.E11.1.454.CMB.1.raw
tcagctcgcgtgtccacgaccggtgctcgatttagcactcgcacgttgggtttggggagctctgcttcagctgtgagcgcagaaggcaggactcgggacaatcgtcatcatgacctgcctccctctcctcctcacccttctcattcactgcacgagggtcctgggcccagtcctgtgttgacgcgacggccgccctcgaagttactcgtcggcccgggacccccgggaagagggtaacggggtccaacctacttccgttcccgttcggacccgtacccggggaaaacgtccctaaaccccttacgtaaaaagtttacgggtttacggggggtaacctttaggttttttaggttaacgttccgggttagggttaacttaccgaacggtaccgtaaaccggtacccccgggaaacacccggtaacccccctaaaaccttccctttactaacgttttaagacggtaacggtaataaacgtggaacggtaccgtaacgttacgaacggtacttaccgtcgttaccgtttctcgtcggtacctacgtaagtccgtcggactaccgtcaccgtcccgtaccgtggtaccacgtaccgtacccggtactaccggacggtaccgggtcggggaaccgtacgggaccctaacgttacgtaacggtcggacggacgtaccgtaaggtaccgggaagtacgaccgacgtacccgtagaaccgttacggtcgggttacggtacccggttacggggaccgggaaccgggaccggtaacggtccggttaaccggtacccgtttacgtacggacccaccggtaacccgtacggtccccg

SEQ ID NO: 251118 - DNA, 779 bp, Homo sapiens
  misc_feature: GYAE6OF01CQSKS.8.55.E11.1.454.CMB.1.raw
tcagctcgcgtgtccacgaccggtgctcgatttagcactcgcacgttgggtttggggagctctgcttcagctgtgagcgcagaaggcaggactcgggacaatcgtcatcatcgacctgcctccctctcctcctcctacccttctcacttcactgacacgacgggtccgtcgggccctagtccgtggttcggttcgaccgcgacggccctccctcgagtactccgtcggccgggacccgggacgacggacggtccacctactcctccgtcgccgtaccggaacgacctaacctaacgtaaacgttacggttacgggtacctttaggtttacgttacgtacggtggtaactaccgaacgaccggtaacccggtaacccccggaaccaccctaacccccgtaaactccctaacgttaatttacgagaacggtaataacgcgacgtcggtacgtacgtaacggttacttcccgtaggttacccgtttcacgtacggtacctaaccggtacgttcgtacggacgtacgaccgtaccgtcccgaccggtcggtacctacgtacccgacccggtaccgtaccgacggtaccgggcgggtaaccgacggtaccctaagttacgtacggtacggaccgggacgaccgagggtaccggaatacggtacgacgtaccgtacgtaacgtacggtcgtaccgggttacggtaccggggacgggaaccggtcgtaccggtacgtaccggtccgttaaccggtacgtacccgacccggtccggaccggtccccg

SEQ ID NO: 251119 - DNA, 759 bp, Homo sapiens
  misc_feature: GYAE6OF01AXYEA.8.55.E11.1.454.CMB.1.raw
tcagctcgcgtgtccacgaccggtgctcgatttagcactcgcacgttgggtttggggagctctgcttcagctgtgagcgcagaaggcaggactcgggacaatcgtcatcatgacctgctccctctcctcctcacccttctcattcactgcacagggtcctgggcccagcctgtgttgacgcaggccgccctcagtatcgtcgccggccccgggagaggacgggtccaccatcctcctgccgtccggaacgccacctacaaataggttacgggacttagttttgtacgtcgtaggtactcgacgacgaaccggtaccccggaaccaccgacccccctaaaaccttccctactaacgttttacgtaggtaacggtaattaaagtcgaacggtaccggtacgtttaccgaacggtactttaccgtacgttaccgtttcgtcgtcggtaccttaccgtaacgttcgtcggtaccgtaaccggtaccaccggcccgtaacccgggttgggacctaaccgttacccggaaccccggtacctacccgaacggtaccgggtccgggggaaaccgtaccgggaccccttaacgttacgttaaccgtagggacccgggtaacgacgttaacggtacggggtaactacggacctacgtaccgttaacgaacccgtggttcggtaccgggttcggttaccgggacgggtacgggaacaacggtccgtaacggttacccgttctaacggaccgacggacccgtcggtccccg

SEQ ID NO: 251120 - DNA, 623 bp, Homo sapiens
  misc_feature: GYAE6OF01EGJ1B.8.55.E11.1.454.CMB.1.raw
  modified_base (194)..(194): a, c, t, g, unknown or other
  misc_feature (194)..(194): n is a, c, g, or t
tcagctcgcgtgtccacgaccggtgctcgatttagcactcgcacgttgggtttggggggctctgcttcagctgtgagcgcagaaggcaggactcgggacaatcgtcatcatgacctgcctcccctctcctcctcacccttctcattcactgcacagggtcctgggcccagcctgtgttgacgcaggccgccctnagtactctcggccggccccgggacagacgggtcaccatcctcctcgccgtccggaacgccacctacaaattagttggggactagttttgtactgtgtatcagcaacgtcccgaacacgaccccaactccgtctattatgagactaatgacgacgtacgtcgacgtaacttcctcgtacccgtttctcgtcggtcctaccgaagttcgtcggtacaccgtcgacgtacccgtacccgtcggacacgtccgacccggtactccgaacggacggtacgggacgacgccgtacttagtacgcggacggagctaggtagggatagcgaaccgtcgtacgaacgtcgtcggtcggttacgtcgggacgggaacggacgaacgtctaccggtacccgttccgttacgacaaccggcccgtaacggtcctaccccgg

SEQ ID NO: 251121 - DNA, 975 bp, Homo sapiens
  misc_feature: GYAE6OF01CQPM7.8.55.E11.1.454.CMB.1.raw
tcagctcgcgtgtccacgaccggtgctcgatttagcactcgcacgttgggtttggggagctctgcttcagctgtgagcgcagaaggcaggactcgggacaatcgtcatcatcgacctcgcctccctcctcctccctcctacccttctctattccactcgccacgacgggtccgtcgggcccagtctggtcgttagaccgcgacggcctccctcgtagtactccggtcggcccgggaccccgggaacgagggtacgggtaccaccgtacttccgtccgtcggccgtaccgggaacgccaaccgttactaaaagttacgggtttacggggaacgtttaggttttcggtacgttacgggttaggtaactaccggtaacggaaccgtaaaccccgggtaccccccggaaacctaacccggtaccccctaaaaccgttccctaattaacgttttaagaggtaaacggtaacttaaggacggtacggtaccggtaacgttaccggtaaacggttaccttcccgttaacggttacccgttttacgtacggtaccggttacccttaaccggttaacggttccggtaacggtacctacccggaccgacccggtaacccgtaacccggtcggtaaccgtaccgtacccggaacccggtacccgaccgggtaccggtaacggggaaccgggtaccggacccggtaacccgtaacgtttaaggtacccggtacgggaacggtacggtacgtaacgggtacggggtaaccttaaccgggaccggaacgggtacccttaacggttaacgggttacgggttaccgggtaccgggttaccgggttaaccggggggaacccgggtacgggttaaaccccggccggggtttaacccggttaaccccgggttaccggtttaaaccccggtaaccgggtttaccccggggaaacccggtaacccccgggttacccgggtttaaccccccccgggg

SEQ ID NO: 251122 - DNA, 847 bp, Homo sapiens
  misc_feature: GYAE6OF01BEA3Z.8.55.E11.1.454.CMB.1.raw
tcagctcgcgtgtccacgaccggtgctcgatttagcactcgcacgttgggtttggggagctctgcttcagctgtgagcgcagaaggcaggactcgggacaatcgtcatcatgacctgcctccctctcctcctcacccttctcattccactcgcacgacgggtcctcgggcccacgcctgttgttgacgcgacggccgccctcgtagtactcgtcggccgggccccggacgacggagggtaccaccgtactcctcctcgccgtaccggtaacgacctacctactaaaagttacggttgggggtacttaggtttttgtaacgttcggttaggtactcgacgtacgtaaccggaccccggaacaccgaccccgtaactccgtacttacgtttaacgtaggtaacgtacttaaagtcggaacgtacggtaaccgttcgtaaacggtactttccgtacgttaccggtttctacggttccggtacctacgtaacgtcgtcggtacctaacgttccgaccgtacccgtacccgtcgggacctacgtaccgaccggtaccgtaccgtaacggtaccgggtacgggaccggtacggtacccgtacttaacggttcggtacggccgggtaacgtcgtaagggtacggtacgtaaccggacgtaacgtacccggtaaggttaaaccgtccgggttaacgggttccgggttaccgggttccgggggaaacggggtaaccccggggttaaaccgtaaccgggttacccgggtttacccggttaaccccggggttaccccgttttaaccggggaaccccgttaaccccggggtaaccccggtaacccgggtttccccccgg

SEQ ID NO: 251123 - DNA, 939 bp, Homo sapiens
  misc_feature: GYAE6OF01AZAR7.8.55.E11.1.454.CMB.1.raw
tcagctcgcgtgtccacgaccggtgctcgatttagcactcgcacgttgggtttgggggacgctctgcttcagctgtgagcgcacgaaggcaggactcgggacaatcgtcatcatgacctgcctcccctctcctcctccacccttctcacttccactgcgacgacgggtccgtacgggcccacgtcccgttggttcggttcggaccgcgaccgggccgacccctcgacgttacgttccgtacggcccggggacccccggggagacgggtaccgggtacctaccacgttccgtcccgttacgcccggttacccgggaaccgaccttaacccgttacgtaaaacgtttacgggttacgggggtaacctttaaggggtttttcgtacgttacggttacggtaactccggacggtacccgtaaacccgggtacccccggaaacctacccggaaccccctaaacctttccccgtaagttaccttttaacggtacggaacggtaattaacggtcggtaacggtccggtaaccgttacggtaaccggtttaacgttcccgtttaacggttacccggtttccttaccggacggttaccttaccggtagtcccggtaccggaaccgttccgaacccgtccggtacccctacccgggtacgggacctaaccggtcccggtaacccggttacctaccgggtaaggtacccgggtaacggggaccggtaccgggaccgtttaacgtaccggtttaacggacgggtaccgggtataccggtaagggttcggtaacgttccggaaccgttttaccggaccgtacgtaacgttacggtcgggttacccggttcgggttccgggaaccgggtacggtaaacgggcccgttaccggttaaccggttcccgttaccggttacgtccggaacccggtacccggtaccggttaccccggg

SEQ ID NO: 251124 - DNA, 943 bp, Homo sapiens
  misc_feature: GYAE6OF01E0DTI.8.55.E11.1.454.CMB.1.raw
  modified_base (621)..(621): a, c, t, g, unknown or other
  misc_feature (621)..(621): n is a, c, g, or t
tcagctcgcgtgtccacgaccggtgctcgattttagcactcgcacgtttggggtttgggggagctcgtgcgttcagctgtgagcgcagaaggcaggactcgggacaactcgtcatccatgacctgcctcccctctccctcctcctacccttctctacttccactgaccacgacgggtccgtcgggccccacgtcccgttggttgttcggaccgccgacggcccgtcccctacgaacggttactccggtacgggccccgggacccccggggtacgacggtacggggtacccaacccgtaacgttccctccgtacggacccgtacccgggaaacgtacctaacccgttacgtaaaaacgttttaggttacgggggtaaacctttaggtttttacggttaacgttccgggttagggttaacctaccggacggtaaccccggtaaacccgggttcccccccggaaaacgaccccggttaaacccccctaaaacgtttccccgttaaccgttaaagtttttacggacggtaaacggtaacgttaaacggtcggtaaaccgggtacggttaacccgtttacggtaaacggtttaccgttttaccctacgggtttaccccgttttacnccggtttaccggtacctaccgtaacggtttccgtacggaaccctaccggtaccgaaccgtccccgtacccggttcgggacctacgtaccccggaccggtaccgtaccgacggtacggtacgggacgtaccggtaccgttacttacgtacgcggaccgaaggtaccgtaaggttacggtacgtacgtacgttaccgtaccggtaacggtaccgtcgggttcgggttaccggtacccgggttacgggaccgggtaacgggaaccgtacggtccggtacgtaaccccggttcgtaaccggaccgacccgtccggaccgttcccgg

SEQ ID NO: 251125 - DNA, 817 bp, Homo sapiens
  misc_feature: GYAE6OF01BO8KC.8.55.E11.1.454.CMB.1.raw
tcagctcgcgtgtccacgaccggtgctcgatttagcactcgcacgttgggtttggggagctctgcttcagctgtgagcgcagaaggcaggactcgggacaatcgtcatcatgacctcgcctccctcctcctcctcctacccttctctattcactgacacgacggtcgtcggccctacgtcgtgtgttcgcgcgacggccgccctgacgtcgtccgtcggcccgggcccggagacggtacggtaccacctctcccgttccgtcgacccggtaccggaacgaccttaaccgtaactaaaagttcggttaacggggttaactttaggtttacgtagttaccggttagttacgtcgaaccgtacccggtaaacccgtaccccggaaaccgacccccgtaacccctaaaccgttcccgttaacgttacgtttacggaaggttaacgtaagtaacggttacgacttaacggttaccttaacggtacgttaaccgtttccggttacgtttcccgtttaccgtcggttacctaccgtacgtacgtaccgtcggacctaccggctaccccggtaccgtccggtacctaccgtaccgtaccggtacccgtacctacgggtacggtacccgggacggtaaccggaccgttacccgttagttaacggccgtagggaccggaactcggtaagggtacgacggttccgaacggtcaaccgggtaccgttgaccggttacggtccggttaaccgggcgggacgtaacggggtccaggtacccccgtttggaccctttaccgtagacccggaccctcgggacccttccccggg

SEQ ID NO: 251126 - DNA, 686 bp, Homo sapiens
  misc_feature: GYAE6OF01AC67D.8.55.E11.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (430)..(430): a, c, t, g, unknown or other
  misc_feature (430)..(430): n is a, c, g, or t
tcagctcgcgtgtccacgaccggtgctcgatttagcactcgcacgttgggtttggggagctctgcttcagctgtgagcgcagaaggcaggactcggacaatcgtcatcatgacctgcctccctctcctcctctacccttctctattccactgccacgaggtcctgggaccagccttgtcgttcgacgcgacggccgtccctanacgtctcgtacggccgggaccggacaggacggtcactactccnccgtcgccgtaccggagcctaccgtaagtaaacgtcggttacgggacttagtttcgtacgtcggtacgtaactcgtacgaacgtacccggtacccgaacggtacccaccctaacgtcctagttaacttagtacggaagtactacgtagcgtacgtacgtcgtaagtacgttcgtacgtcgttcnggtactactacgtactcgacgtccaggtcaccgtcccgacggcgaacgtacgtaccgtaccgtacgtccggtaacgtacggtaccggacggtcgaaccgttacgtacgttacgcggtacgacgtacgacggttacgagtaacggctacgtaccggtaatacgggttagtcgggtaccgtcgaaccggggtcgaaccgggtactcgggtacccgtacgtaccggttcactaccgggacctcggtaacccggtcccgg

SEQ ID NO: 251127 - DNA, 727 bp, Homo sapiens
  misc_feature: GYAE6OF01EP8AH.8.55.E11.1.454.CMB.1.raw
  modified_base (140)..(140): a, c, t, g, unknown or other
  misc_feature (140)..(140): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
tcagctcgcgtgtccacgaccggtgctcgatttagcactcgcacgttggggtttggggagctctgcttcagctgtgagcgcagaaggcaggactcgggacaatcgtcatcatgacctgcctccctctcctcctcaccttntcattcatcgacacgacgggtcctcgggcccagtcctggtcgttgacgccaggccncctnagtacncgcggccggcccgggacaggagggtaccaccagtcctcncgacgtaccggaatcaaccctataaagtacggttggggtaacttaggttttagagtacggtggtaactcgaagtaccaaaccggtccccggaacaccgtacccccaaacgttcctactaatttaagaggtaagactaatacgtacgacgtaacgttacgtaacgtacgttcctaggtaccgtttcacgtcggtacctacgtaaacgtcggtacgaccgtaccgtaccacggtacccgtaccggtacggcctacgtacccgtaacccggacgttaaccggagggttaaccggacgggggaacgtaaccgacgtaacgttaacgtacggtacgaccgggaactacgtaacgggttaggtacaacggtaccgtaacgacccggtataaaccgtcgggttaggttacccggtcggttaacggcgggtaacgaacgtacggtacgtaccgtacccgtcgtaaactccgaacgtccccgagggtcccc

SEQ ID NO: 251128 - DNA, 611 bp, Homo sapiens
  misc_feature: GYAE6OF02H0S1L.8.55.E11.1.454.CMB.1.raw
tcagctcgcgtgtccacgaccggtgctcgatttagcactcgcacgttgggtttggggagctctgcttcagctgtgagcgcagaaggcaggactcgggacaatcgtcatcatgacctgctccctctcctcctcacccttctcattcactgcacagggtcctgggcccagcctgtgttgacgcaggcgccctcagtatctgcggccccgggacaggagggtcaccatcctcctgctccggaagcacctcaaatagttgggactagttttgtatcgtggtatcagacaacgtccccggaacacgcccccaaactccactatttatgagtataatgagcgtacgttcaaggtacttcctgtaccgtttctcgtcggctacctaagtcgtcggaccacgtcacgccctaccccgtgggacctagtccgaccggacctccgaggaccgtggggaccgacgggccgtaacttacgttacctggaccggagtacgagtacgggataggaccagcccgtagaacctacgttgggttacggttcgttcggggacgggtaacgggacctaacggtcctaccgggaaccgttccttaacggcaaccggtacccgaaggtcccg

SEQ ID NO: 251129 - DNA, 792 bp, Homo sapiens
  misc_feature: GYAE6OF02G7IG3.8.55.E11.1.454.CMB.1.raw
  modified_base (210)..(210): a, c, t, g, unknown or other
  misc_feature (210)..(210): n is a, c, g, or t
  modified_base (251)..(251): a, c, t, g, unknown or other
  misc_feature (251)..(251): n is a, c, g, or t
  modified_base (323)..(323): a, c, t, g, unknown or other
  misc_feature (323)..(323): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgctccctctcctcctcacccttctcattcactgcacagggtcctggcccagcctgtgttgacgcaggcgccctcagtatctgcggccccggganaggacggtcaccatctcctgctccggaagccacctcaaatnttggggactagttttgtatcgtggtatcagcaacggtccccggaacacgacccccaaactcctactatttangaggtataagtgagcgtacgttcaggtaacttccgtagtacccgtttctcgtcggtccttaccgtaacgttccgtacggacctaaccggtttccaacggtcccctaaccccggttcggggtacctaacgttacccgaaccccgggtaaccttcccgaacggtaaccggttacggggggaaaccgttaccgggaaccccggttaacttaaccgttttaccgtacgggtaccgggaacggtaccgtaaacgggttacggggtaacgttaacggacccgtaacgggtaccccgtttaacggaaaacccgtaccggtttacgggtttacccggggttaccggtttacccgggggaacccggggtaaaccgggggtaaccccgtaaagggttcccgttaaccggggtaacccccggttttccgtttaaaccgggaccccgtaaccgggtacccccggtaacgggttccccccgg

SEQ ID NO: 251130 - DNA, 645 bp, Homo sapiens
  misc_feature: GYAE6OF02JDXPV.8.55.E11.1.454.CMB.1.raw
  modified_base (547)..(547): a, c, t, g, unknown or other
  misc_feature (547)..(547): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacaggtcctgggcccagcctgtgttgacgcaggcgccctcagtatctgccggcccgggacagacgggtcaccatcctcctgccgtccggaagccacctcaaatattggggactagttttgtatcgtggtatcagcaacgtccccggaacaccgaccccaaactcctacatttatgaacggtataagtgacgtcgacgttcaacggtacttaccgtgtaccgtttctcgtcggtctaccaagttctacgggtaccacgttccgacgcccgtaacccggttgggacctacgtcccgtaacccggtacctaccgaacggacggttcggggaaccggacggacccgtaaactcttaacgcggtacgggactcgaagtcgggaatcggaccacgtccgtanaaaccgtcgttcggtcggttaccggtccgggcgggaacgggacctaagtccgtacgtacccgttaccgttacgaccggaccgtacccgaaggtccccg

SEQ ID NO: 251131 - DNA, 253 bp, Homo sapiens
  misc_feature: GYAE6OF02GGUZP.8.55.E11.1.454.CMB.1.raw
  modified_base (247)..(253): a, c, t, g, unknown or other
  misc_feature (247)..(253): n is a, c, g, or t
tcagctcgcgtgtccacgaccggtgctcgatttagcactcgcacgttgggtttgggggtgtggtggtctccactcccgccttgacgaggccgactattactgcggagcatgggatagcagcctgaacactgtggtcttcggcggagggaccaagctgaccgtcattagtcagcccaaggctgccccctggtcactctgttcccacctcctcactactcacactgagcgggctggcaaggcgcatagnnnnnnn

SEQ ID NO: 251132 - DNA, 786 bp, Homo sapiens
  misc_feature: GYAE6OF02HBA39.8.55.E11.1.454.CMB.1.raw
  modified_base (471)..(471): a, c, t, g, unknown or other
  misc_feature (471)..(471): n is a, c, g, or t
tcagctcgcgtgtccacgaccggtgctcgatttagcactcgcacgttgggttggggagcgtctgcttccagcgtgtgagcgtcagaaggccacggacctcgggactaagtcgttcgatctatgacctcgcctaccctcctccctacctccaccctttctactattccactggcctacgtagggtcctcgggaccccacgccctagtcgttgaacgcgacggccctccccgtaggaccggtaatccgtcgaccgggtccccggggaagtacggaccgggttccaacccgtaccgggttccttcccgtggaccgttaccggaacgtcctaccgtacaaaattagttttggggactagtttttcgaccttccgtacggtaacttacgacgaccgtaaacggtacccccggaaacaccgggtaccccccaaaatcccgtacccgtaaggtttaacggcggaaaggtaggttaacncggaagtacgaacgtttacgaggtaacttccgtgggtaccgtttacttcgtcggacgtaccaaagttcgtcgggacgtacggtaccgtaccgaccctaaccgtcggtcgtaacgtaccgaaccggtaacttaccgaaggtacggtacgggtaacggtacggtacccgtaactaacgttaacgtacgacgtacgacgtaacgtcgggaaagtacgaccgacgtcctagtaactacgtcgtacggtaccgttccggaacggtaacgacgaacggctaccgtacgtaccgtacgttaccgtacgttaccaggttaccg

SEQ ID NO: 251133 - DNA, 659 bp, Homo sapiens
  misc_feature: GYAE6OF02I44T2.8.55.E11.1.454.CMB.1.raw
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcaatgcacagggtcctgggcccagcctgtgttgacgcaggcgccctcagtatctgccggccccgggacagacgggtcaccatcctcctgctccggaanccacctanaaatagttgggactagttttgtatcgtggtatcagctaacggtccccggaacacgccccaactcctnatttangagataatgagtcgacgttcaaggtaacttccgtagtacccgtttntaccgttggcctacctaagtctcggactacgtcacgcccaaccgtcgggacacgtaccgaccggacctacgacggtacgtacgggggacgagggacccgtaacgtaacttacgtcggtacgggtaagtccgtaaggttacggggaatttacgggcccgaaagttcccgtaacgaaaccgttacggtcggtttacgggttccgttacggggaccggggtacggtaaccgaacggtccggtacgttaaccccgttcgttaaccggccgaccggtaccccgtaaggtccccg

SEQ ID NO: 251134 - DNA, 676 bp, Homo sapiens
  misc_feature: GYAE6OF02F078K.8.55.E11.1.454.CMB.1.raw
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccggganaggagggtcaccatctcctgctaccggaanccacctacaaatagttggggactagttttgtatcgtggtatcagacaacgtaccccggaacacgacccccaaactccctactatttangagataangagcgacgttcgagtacttccgtcgtaccgtttctcgtggtcctacctaagttcgtggtctacgtcacgtccctaccgtgggcacgtaccgacccggtacctacccgaaggaccgtacgggggaaccgacgggacccgtaacgttacgttacgtcggaccggacggtaccgaaggttacggggacgttaacggcgtaaccggccctaacggaaccgttacggttggtttacgggttaccggtttaccgggaccgggggaaccggaacccgtaacggtccgttaccggtacccggtttaccgttaaggtcccgtacccggtacccggtaaccggtcccg

SEQ ID NO: 251135 - DNA, 833 bp, Homo sapiens
  misc_feature: GYAE6OF02GXI8L.8.55.E11.1.454.CMB.1.raw
tcagctcgcgtgtccacgaccggtgctcgatttagcactcgcacgttgggtttggggagctctgcttcagctgtgagcgcagaaggcaggactcgggacaatcgtcatcatgacctgctccctctcctcctcaccctattctactacttcacgtcgaccacggtacggtccgtccgggcccacgtccgtggttagtcgaccgcgacggccccgtccctagtaagttactcggtccgggccccggggaccccgggagacgggtacggtacccaaccgtactccttccgtcgtacccgtaccgggaacaccctaacctaacgtaaaagttggggttacgggaactttaggtttttagacgttcgggttaggttactacgaacggtaacccgtaacccgggtaacccccggaaaccacccccggtaaacccccctaaacctttcctaacgtttaacgttttacggaagggtaacggtaaattaacggtaggaaccggtacgttaaccggttacgtaaacgggttaaccctttccggtaaccggtttaccgttttccgtacggtaccggtaccttaaccggtaacgttccgggtacgaccgttacgaccgaccgtaccccacgggtcgaactaccgtaccgaccgttaccaccggacggtacgggtacgggaaccgccggtacctaagttacgttaccggcgacggacgacgttaggggtacaagtacgacggtacctcgtaaacgacgtaggttcggtaccggttacgggcggggacggtaccggaagtccgtcggtaccggttaccgttcgtaacgccggtaccgaccggtacgg

SEQ ID NO: 251136 - DNA, 901 bp, Homo sapiens
  misc_feature: GYAE6OF02HNR6G.8.55.E11.1.454.CMB.1.raw
tcagctcgcgtgtccacgaccggtgctcgatttagcactcgcacgttgggtttggggagctctgcttcagctgtgagcgcagaaggcaggactcgggacaatcgtcatcatgacctgctccctctcctcctcacccttctcattcactgcacagggtcctgggcccagcctgtgttgacgcaggccgccctcagtatcgtcggccggccccgggacaggacgggtccaaccgtattccgtcctggccgttaccggaacggccaacccttaccgtaaaaagttacggtttacggggggtaacttacgggttttttagtaacgtttccggttagggttaactccggtaagtaccgtaaacggttaccccccggaaaacgtaccgacccccccgtaaaacgtccctaccgtaatttaacgtacggtaacggtaaattaaacgttacggaacgtaccggttaaccgtttacgaaacggttaaccgttttacccgtacggttaacccgttttacctttacggtacggtacccgtttaacccgaaacggtttccgttacggtaacccgttaaccgggtttaccgaccgtaccccgtaaccccggtttgggaccccttaacggtacccgtaaaccccgggtaccttaaccggacgggtaaaccggttaccgggggaaccggtaaccggtaccccggtaactttaacgttaccgtcgggaaccgggagtaccgtaacggtaccgggtaacttacggaacctacgtaacccgttaggaaacccgttggtacggttaccgggtttaccgttacggggacgttaccgggaacgggtaaccctaagggtacccgtttacggttaaccccggtacgttaacccggttccgaaccggtaccccggttaaaccggg

SEQ ID NO: 251137 - DNA, 833 bp, Homo sapiens
  misc_feature: GYAE6OF02JL75Q.8.55.E11.1.454.CMB.1.raw
  modified_base (211)..(211): a, c, t, g, unknown or other
  misc_feature (211)..(211): n is a, c, g, or t
  modified_base (651)..(651): a, c, t, g, unknown or other
  misc_feature (651)..(651): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgctccctctcctcctcacccttctcattcactgcacagggtcctgggcccagcctgtgttgacgcaggcgccctcagtatctgcggccccggganagacgggtcaccatccgtcctcgcctaccgggaagccaccctacaaaacgttagttcgggggactagtttttgtaattcggtggttatcgagcaaacggtaccccccggaaacaccggaccccccaaaacttccctactaacgttttaactggaacggtaattaacgttacggaacggtaccggttaacggtttcccgaaagggtaaacctttcccgtttaacggtaccccggtttttaccgtccgttcggggtacccttacccgttaaaacgttccggttacggaccctacgggtttaccgtaacggcccccgtaaccccggttggggaccctaacgtaccccgtaacccgggtaaccttacccgaaggtaacccggttaggggggaaccgtaacggggaccccgtaaacgttacgttaccgttacgggaccgggacgngtacggtacgggtagaaccggtacgacgttaccgtacggaaactcgttcgggttcgggtttaccggttacccgggggtaaccggggtaaccggggaaccctaacgggtaccgttaccgggtaacccccgtttaccggtttaaccggtacccggtaccggtacccccggtaacggtaccccgg

SEQ ID NO: 251138 - DNA, 885 bp, Homo sapiens
  misc_feature: GYAE6OF02HZIKL.8.55.E11.1.454.CMB.1.raw
tcagctcgcgtgtccacgaccggtgctcgatttagcactcgcacgttgggtttggggagctctgcttcagctgtgagcgcagaaggcaggactcgggacaatcgtcatcatgacctgcctccctctcctcctcacccttctcattcactgcacgagggtcctgggcccagcctgtgttgacgcaggccgccctcagtatcgtggccgggaccccgggacaggacgggtcaccatcctcctgaccgtaccggaacgccacctacaaaagttaggttacggggacttaggtttttagtacgttcggtaggttaatcgaacgtaccgaaaccggtacccccggaaaccaaccggtacccccctaaaacttccctacttaatttacgtaggaacgtaataacgtaggaacggaccggtaaacggttcgtaacggtaaccgtttaccgtttacggttaacccgttttactaccgttacggtacccttacgtaacggtttaccgtaccggaccgtaccggttacccgaaccggaccccggtaacccggtcgggacctacgtacccgaaacccgggtaacctacccgaagggtacccggggttacgggggaaccggtacccgggtaccggtaaacgtttaaccggttttaacccgacggggacccgggaacggtaaccggtaacgggttaaccggggtaattaacccgggtaaccgtaaaccggtacccgtacgggtaaaacccgttacgggtttaccgggttaccgggttaccgggtttaccgggggaaaccgggggtacgggttaaacccggaacggtaccgttacccgggtacccggtttaccgtttaccgaacccggttacccggaccccggtaacggttaccccggg

SEQ ID NO: 251139 - DNA, 734 bp, Homo sapiens
  misc_feature: GYAE6OF02FL7HP.8.55.E11.1.454.CMB.1.raw
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccggganagagggtcaccatctcctgctccggaagccacctcaaatnttgggactagtttgtatcgtgtatcagcaacgtccccggaacacgcccccaaactccctactagtttacacgtaggataatcgacgacgtacgttacaaggtaacttcctacggtaccgtttttctcgttacgggtacccttaccgtaaagtttcctacgggccgtaaccgtcaacggtcccaacccggttcggggtcacgtcccgaacccggaccttacccgaaggtaccgacgggggtaaccggacggtaccccgaactttacgttaaccgtacggaccgggtaacgaccgagggttacgggaacgttaacggtccgtaaaggtcccgtacggaaaccgttaccgttcgggttacggttcggtttaccggggaaccgggggtaaccgggaacccggttaaccggaccggttaaccggtaccccggtttacccggtttaaccgtaccgggaaccggttacccccggtaaggtacccccggg

SEQ ID NO: 251140 - DNA, 833 bp, Homo sapiens
  misc_feature: GYAE6OF02IZGMP.8.55.E11.1.454.CMB.1.raw
  modified_base (217)..(217): a, c, t, g, unknown or other
  misc_feature (217)..(217): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggccgccctcagtatcgtggccgggccccggganaggacgggtccaccatcctcccgtcgccgtaccgggaacgcccaacctacaaaagttacggttacgggggaaccttaaggttttttcgaacgttccggttagggttacttaccgaacggtaccgaaaacccgggttaccccccgggaaaaccgtaaccccggtaacccccccctaaaaaccgttccccgttaaccttaagtttttaacggtaaggtaacggtaaattaaaagtcggaacgtaccggtaacggtttacgaaaggttaaccttccgtacggttaacccgttttcgtacgttcggtaccttaccgtaacgttcgtcggacctaccgtcgtaccggaccctacccgtagggcctaacgtcccgaaccggtacctacccgaaggtaaccggtcggggtaaccgacgggtccccttaaacgttaccgttaacgtcggaccgggaagtccgtaagggtcggtaagtcgacggtacgtacccttaaggaacccgtcgttcggttaccggtcggttaccggggacgggtaaccgggaacccgtaacggttccgtaaccgggttaccccgtttacggttaacggtacccgacggtaacccccggtaggtcccccgg

SEQ ID NO: 251141 - DNA, 854 bp, Homo sapiens
  misc_feature: GYAE6OF02IEBTD.8.55.E11.1.454.CMB.1.raw
  modified_base (682)..(682): a, c, t, g, unknown or other
  misc_feature (682)..(682): n is a, c, g, or t
  modified_base (691)..(691): a, c, t, g, unknown or other
  misc_feature (691)..(691): n is a, c, g, or t
tcagctcgcgtgtccacgaccggtgctcgatttagcactcgcacgttgggtttggggagctctgcttcagctgtgagcgcagaaggcaggactcggacaatcgtcatcatgacctgcctccctctcctcctcacccttctctattcactgcacgtacgggtcctcgggccccagtccgttggttgttacggaccgcgaacgggccctccccttagaaggttactccgtcgggaccccggggacccccgggaacgagggtaccgggtaccaaacccgtcttcccgtccctggtcccgtaaccgggaacgacccctaaccgttaactaaaaacgttaggtttacgggggtaactttaggtttttcgtagttccggttaggttatcgaacgtaacccgtaaccggtacccccggaacaccccgaacccctaaaccttccgtacttaactttaggacgaaagtaataagtgacgtacgtacgtacgacgtttacttcgtcgttaccgtttcctacgtcgtacctaccgtacgttcgtaccggacctaaccggtccgacccgtacccggtacccgtcggaactaccgtaaccccgtaccggttacctacccggaacggtcccgggtaggggaacccgacccgggtaaccttacgttaaaccgtgtacgggacgtaggacgtaacggnggtaaaccngtcaaccgttacgacgtaacgtttagggtccggttacgggttcccgggttaacgggggaccgggttaaaccgggaaaccgtacccgggttacgtacccggtttaacccggtttctaaacccggggtcccacccgggttacccccggtaacgggtaccccccgg

SEQ ID NO: 251142 - DNA, 797 bp, Homo sapiens
  misc_feature: GYAE6OF02JB5QI.8.55.E11.1.454.CMB.1.raw
  modified_base (259)..(259): a, c, t, g, unknown or other
  misc_feature (259)..(259): n is a, c, g, or t
tcagctcgcgtgtccacgaccggtgctcgatttagcactcgcacgttgggtttggggagctctgcttcagctgtgagcgcaagaaggcaggactcgggacaatcgtcatcatgacctgctcccctctcctcctccacccttctcattcactgcacgtacgggtctcggccagtcctgtgttgacgcacggcgccctcagtatctcggccgggcccggacgacggagggtctaccactcctccgtcgccgtaccggaacncaacctacaagttagttcgggacttagttttcgtatcgtagtctacgagacgtaaccggtaccccgaacacccgtaccccctaaacgttacctcttagtttaacgtacggtaacgtacgtaacgtacggtacgtaccggttaccgttacggaacgtttaacgttacccgtacggtttacccgtttcgttaccttacgggtacccgttaaccgtaccgttccggtaccggcccgttaccggttacgaaccggtaccccgtccggtacgggcgttaacctaccggtaacccggttaccgtaacgaaccggttacgggacgggggtaccgggaccggtacccgttaaccgtttaccgttaccgggacgttaccgggacggaccggttaggcggtacggtaaccggttcgaaccgtccgtaaccgacgttacggttaggtcccgggttcggttaccggggaacgggtaccggtaaacggtaaccgtccggtaacttaccccggttacggtttccggacacccggtacccgtccggttcccgg

SEQ ID NO: 251143 - DNA, 726 bp, Homo sapiens
  misc_feature: GYAE6OF02IBI25.8.55.E11.1.454.CMB.1.raw
  modified_base (165)..(165): a, c, t, g, unknown or other
  misc_feature (165)..(165): n is a, c, g, or t
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (237)..(237): a, c, t, g, unknown or other
  misc_feature (237)..(237): n is a, c, g, or t
  modified_base (425)..(425): a, c, t, g, unknown or other
  misc_feature (425)..(425): n is a, c, g, or t
  modified_base (455)..(455): a, c, t, g, unknown or other
  misc_feature (455)..(455): n is a, c, g, or t
  modified_base (480)..(480): a, c, t, g, unknown or other
  misc_feature (480)..(480): n is a, c, g, or t
  modified_base (507)..(507): a, c, t, g, unknown or other
  misc_feature (507)..(507): n is a, c, g, or t
tcagctcgcgtgtccacgaccggtgctcgatttagcactcgcacgttggggtttggggagctctgcttcagctgtgagcgcagaaggcaggactcgggacaatcgtcatcatgacctgcctccctctcctcctcacccttctcattccactgacacgtgggtccncgggcccagtcctggtcgttgacgcgagggcccncccttnaggtactccgnggccccgggaccccgggtaanacgggtaacgggttcccaacacttccgttcctggtcccgtaccgggaattcctaaccgtataaaagttacggttccggggaactttaggttttagtacggtaccggttagggtaactcgaccggtaacgaaccggtacccccggaaccgtaccgtacccccctaaacggttccctaattacgttacgngtaagtactaagtcggagacgtaccgttanaacgttacgtcgtaccgtacgttcncgtaccgtctaccgtagtcgtccggtnacccgtttcgaccggacccgtccgtgggtccacgtaaccgaccgtactaccgggactcggggtacgggaacggaccgtaccgttacgtaccgttagacggtacggacgtgtaacgggtgaacgttaaccggctaacgcgtacggaacttcggtacgttcgtcgggtacgggtagggaccgaagcgttgaccgtcgtactacgcgacctccggatccccg

SEQ ID NO: 251144 - DNA, 666 bp, Homo sapiens
  misc_feature: GYAE6OF02JNLO1.8.55.E11.1.454.CMB.1.raw
  modified_base (189)..(189): a, c, t, g, unknown or other
  misc_feature (189)..(189): n is a, c, g, or t
  modified_base (219)..(219): a, c, t, g, unknown or other
  misc_feature (219)..(219): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (456)..(456): a, c, t, g, unknown or other
  misc_feature (456)..(456): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtcgttgacgcaggccncccgtcagtactcgtgccggccccgggacnggacggtcaccgtatcctaccgtcgccgtccggaaagtccacctccaaagtagttcggggacctaggtttttcgattcggtggtaatcgacgtcaacggtccccggaacncgtacccccaatcccgtntacgtttangaacgtataacgtgtacggcgtacgttcgaacggtacttccgtacgtaccgtttctccgttcggtacctcccgttaaagtccgtacggccgtacgttacnccgaccgtacccgtcgggaccactacccgaccggtactccgaacgtcggtacgggacggacgaccgtacttactacggtcgtaccggaacgtctacgggtgacgtaagtccgaacgtcgtacaacgtcgtacgtcggtacgtccgggcggtaacggactaacggcgttaccgaccgttccgtaacgtccggtaacgccgtaacgtcccgg

SEQ ID NO: 251145 - DNA, 951 bp, Homo sapiens
  misc_feature: GYAE6OF02FQOPC.8.55.E11.1.454.CMB.1.raw
  modified_base (293)..(293): a, c, t, g, unknown or other
  misc_feature (293)..(293): n is a, c, g, or t
tcagctcgcgtgtccacgaccggtgctcgatttagcactcgcacgttgggtttggggagctctgcttcagctgtgagcgcagaaggcaggactcgggacaatcgtcatcatgacctgcctccctctcctcctccacccttctcacttcactgcacgtacgggtcctgggcccagtccgttgtgttcgacgcgacggccgccctacgtaggttactccgtcgggacccggggccccgggaagaacgggtacgggtaccacccgtacttccttccgtcggaccgtaccgggaacncccgtaacctacgtaaagttaacggttacggggtaactttacggtttttaagttacggtacggttacggttaacaccgtaagtaaccccggtaaccggttaacccccggtaaaccgtaaccccggtaaccccccctaaaacctttccgtaacgtttaacgttttaacggacggtaaggttaaagtaacgttacgggaactaccgggttaccgttaacggtaaacgtttacgttacccgttacggttacccttttcgtacggttccgtaacctacgtaacgtttccggtaccggttacgtaacccgtccgacccgggtacccgtacccggttacggaccttaccgtaccccggtaccggtaaccctaaccgggaccggtaacgggggtaccgggtaccgggtaaccggttaccctaactttacccggttaacgtccggggtaccggaagtacccggtaaagggtttaccgggaagttaaccgggccggtaaaccgtaccgttaacggaaaccgtttccgggttacggtttacccggggtacgggtaccgggggtaacgggaccgggtaacccgtttaacgggtcccggttaaccggttacccggtttaacgttaccccgggaaccggttaacccgacccgggttacgggttaccccccg

SEQ ID NO: 251146 - DNA, 548 bp, Homo sapiens
  misc_feature: GYAE6OF01CISSD.16.35.D02.1.454.CMB.1.raw
  modified_base (335)..(335): a, c, t, g, unknown or other
  misc_feature (335)..(335): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggagtggggagattgatcccagtgactntcacatcaactacacgcccgtaccttccaaaggcccaacgtccaaccatctcagctagacaagtccatccagtactcgcctttcctgcagtgcgcagcctggacggtcctacggacaccgccattactattactgtcgcgtagtccggttatcgccgcagactcacttactactacgtacgttctacggacgtctcggggccaagggtacccg

SEQ ID NO: 251147 - DNA, 526 bp, Homo sapiens
  misc_feature: GYAE6OF01C5LBM.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggagattgatcccagtgactctcacatcaactacagcccgtcttccaaggcccacgtcaccatctcagctgacaagtccatcagtactgccttctgcagtggcgcagcctggagccctcggaccaccgccaatatattactgtgcgagtccggttatccgccgcagctcactactactactacggtctggacgtgtcggggcaaggggacccg

SEQ ID NO: 251148 - DNA, 557 bp, Homo sapiens
  misc_feature: GYAE6OF01A3OEG.16.35.D02.1.454.CMB.1.raw
  modified_base (279)..(279): a, c, t, g, unknown or other
  misc_feature (279)..(279): n is a, c, g, or t
  modified_base (479)..(479): a, c, t, g, unknown or other
  misc_feature (479)..(479): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtncgccagaagcccggtaaaggcctggagtggatgggggagattgatcccagtgactctcacatcaactacagcccgtccttccaaggcccacgtcaccatctcagctgacagtccatcagtactgccttctgcagtggccgcagccgtggacgccctcggaccacccgccatatacttactgtcgcgtaggtcccggttanccggccgcagtactcctactactaccgttactaccgggttctacgggacgttccggcggggcccgaaggggtaccccg

SEQ ID NO: 251149 - DNA, 666 bp, Homo sapiens
  misc_feature: GYAE6OF01BTL6P.16.35.D02.1.454.CMB.1.raw
  modified_base (159)..(159): a, c, t, g, unknown or other
  misc_feature (159)..(159): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtgccgaagtgcagctggtgcagtccggagcagaggtagaaaaaggcccggggagtctctgaggatctcctgtaagggttctggatacgtaggttttccagtctacgtggatcaccgtgggtcgcgccgaagaacgacccggtaaaggcctaggagtggagtgggggagtattgactccgagtgactctcactatcaaactacacgtccctactacgaacggcccacgtcaccatccacagcctagaactaacgtccaagtctaacgttactccgtcccttcctgaccgtaggtcggaccgacgacggtccgtacgggacgtcccgtacgggaacccacccggtacctaattaacttaacgtttacgtcgtacggtaccgtacgggttcccggttatcccggaccgtcgaagtaccgttacacccttaaactaccgttaaccgttaccgggcgttacggggacccgtttgggtaccgggggaaccgtaaacggggtacccccg

SEQ ID NO: 251150 - DNA, 594 bp, Homo sapiens
  misc_feature: GYAE6OF01CV8GJ.16.35.D02.1.454.CMB.1.raw
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaagccggggagtctctgagatctcgtgtaagggttctggatacgtaggttttccagctactggatcaccgtggtgcgacagaacgccggtaaaggctggagtggagtggggagattgatcccgagtgactctcacatacaactacacgtcccgtccttccgaaacggcccaacgtccaacctatctacagctagacaacgttccatcagtactcgcctttcngtccgagtcggcncaggtccgtggacgccgtcgacacccgacaatacttacgttacgtgtcgcgtacggtccgttacgtccgccgacagtacctcctaacttaccgtacttaccgttaaccggtcgttacgggtacgttaccggcggggacccgaacggggtaccccg

SEQ ID NO: 251151 - DNA, 669 bp, Homo sapiens
  misc_feature: GYAE6OF01DYIZB.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacgcccggggagtctctgaggatctcctgtaaggttctggatacgtaggttttccagctacgtgatcaccgtgggtcgcgccagaacgcccggtaaaggcctggagtgggagtgggggaggattgactcccgagtgactctcacatacaactacgacgtccccgttacttaccgaaggcccacgtccacctactctcagtctagacaacgtccaatcagtacctcgtaccttctagcgaggtcggccgtcacggtccgtcgggaccgcccgtaccggacctacccgactaacttaacgttacttaacgtcggttacgaccggttacggttccggttaacgtcccggtacccgacgtaacgtactacccgtaacttaaccgtttacctaacccggttaccgggttaccgttacgggtaccggttaccgggtacgggggaacccgtaaaccgggggtaaccccgg

SEQ ID NO: 251152 - DNA, 756 bp, Homo sapiens
  misc_feature: GYAE6OF01C4IFU.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctccgtgtaaggttctggatacaggttttccagctactggatcaccgtgggtgcgccagaacgcccggtaaaggcctggacgtggagtgggggagtagttggactcccaggtcgactcgtacacatccaactacacgacccgttcttaccgaaggcccacgtccaaccgactcctacacgtctagaacaacgttccaattaccgaagtaccttacggccctttcccgtgtccgtaaggttcggccgtaccgacgggtccccgttggggaacccggtccccgttaccggggaacccaaccccgggtacctaacgtttaacgtttacgttttaccgttaggttaccggtaccggttaacgggtttccccggtttaaacgtcccgggacccggttacccgtaagttaaccgtttacccgaacccgttttaaaccgttaacccgtttaaccggttaacccgggtttccgttaaccggggtaacccggtttccgggttacggggggaccccctaaacggggggtaaaccccccg

SEQ ID NO: 251153 - DNA, 639 bp, Homo sapiens
  misc_feature: GYAE6OF01BM3MU.16.35.D02.1.454.CMB.1.raw
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacgtaggttttccagtctacgtggatcaccgtggtgcgcagacgccggtaaagctggagtggagtggggagattgactccgagtcgactctcacatcaactacacgcccgtcttaccgaacggcccacgtcaccatcctacacgctagacagtccatcagtactcgccttcngctagtcgcncacgcgtggacgccgtcggacacccgaccaagttactacttacgtggtcgaccggtacggttacccggttacgtcccggcccgtaccgtaaggtaccttacccgtaaccttaaccgttaacccgttaaccggttaacccgggttccggttaacggggttacccgttaccggggtaccgggggtaaccccgtaaagggggtaaacccccgg

SEQ ID NO: 251154 - DNA, 550 bp, Homo sapiens
  misc_feature: GYAE6OF01D0UR8.16.35.D02.1.454.CMB.1.raw
  modified_base (423)..(423): a, c, t, g, unknown or other
  misc_feature (423)..(423): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaacgcccggtaaaaggcctggagtggagtgggggaggattgatcccagtgactctcacatcaaactacacgcccgtccttccaacggcccacgtccaaccatcctcagctagacaagtccatcagtactcgtccttcngcagtggcgcagccgtggcgcctcggaccaccgcaatatacttacgtgtcgcgtacgtccgttatccgccgcagactcactacctactaccgtcgtacgtcggacgtcgacggggcaacgggacccg

SEQ ID NO: 251155 - DNA, 544 bp, Homo sapiens
  misc_feature: GYAE6OF01BXDWR.16.35.D02.1.454.CMB.1.raw
  modified_base (249)..(249): a, c, t, g, unknown or other
  misc_feature (249)..(249): n is a, c, g, or t
  modified_base (378)..(378): a, c, t, g, unknown or other
  misc_feature (378)..(378): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (478)..(478): a, c, t, g, unknown or other
  misc_feature (478)..(478): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaaggttctggatacnggttttccagctactggatcacctggtgcgccagaacgccggtaaagcctggagtggagtggggagattgatccgagtgactctcacatcaactacagtcccgtccttaccaagcccacgtcaccatcncagctgacagtcatcagtacngccttcngcagtcgcncgagcctgggacgcccgtcggaccacccgcataatacttacgtgtacgcgtacgtccggttanccgccgctagactccactactcgtacgttacgtcgtcggacgttcgacggggtccaaagggtcccg

SEQ ID NO: 251156 - DNA, 636 bp, Homo sapiens
  misc_feature: GYAE6OF01BP6G7.16.35.D02.1.454.CMB.1.raw
  modified_base (244)..(244): a, c, t, g, unknown or other
  misc_feature (244)..(244): n is a, c, g, or t
  modified_base (422)..(422): a, c, t, g, unknown or other
  misc_feature (422)..(422): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaaggcccggggagtctctgaggatctcctgtaaggttcnggatactaggttttccagtctacgtggatcaccgtggtgcgcagacgccggtaaggcctggagtggagtggggagattggactccgagtgactctcacatcaactacagcccgtaccttccgaacggtccacgtcaccatctacacgctgaacagtccagtcacgtactcgtcttcgngacaggtcgcgtacacggaccgtggacggtcctaccgggactacccggactaactaactttacgttaactcggttacggacgttaccgggttaccggttaacgttccgaccccggactaaacggaccttaccgaaccttaccgtaaaccttacccgttacggtccgttacgggaacgtttccgggtaccggggaccgtaaaccgggtaacccgg

SEQ ID NO: 251157 - DNA, 525 bp, Homo sapiens
  misc_feature: GYAE6OF01EH9RL.16.35.D02.1.454.CMB.1.raw
  modified_base (415)..(415): a, c, t, g, unknown or other
  misc_feature (415)..(415): n is a, c, g, or t
  modified_base (436)..(436): a, c, t, g, unknown or other
  misc_feature (436)..(436): n is a, c, g, or t
  modified_base (468)..(468): a, c, t, g, unknown or other
  misc_feature (468)..(468): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagccggtaaaggcctggagtggatggggagattgatcccagtgactctcacatcaactcacgcccgtcttccaaggcccacgtccacatctcagctgacagtccatcagtactgccttctgcagtggcncagccctggacgcctcggacnccgcatactattactgtgtcgacgtccgttancgccgacagactcactactactacgtacgtcgtggacgtgtcgggccaagggtaccc

SEQ ID NO: 251158 - DNA, 802 bp, Homo sapiens
  misc_feature: GYAE6OF01C2QAH.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaaggcccggggagtctctgaggatctcctggtaagggttctggatacgtaggttttccagtctaacgtggatcaccgtgggtcgcgaccgaggaacgacccggtaaaggccgtggagtggagtgggggagtattgactcccgagtcgtactctacacatacaactaccgacgtcccgtaccttaccgaacggccctacgtccaacctatcctacacgtccgtaggaacctaaacgtccaacgtaccgtaacgttaccttcgtcccctttccgtagtaccggtaacggttccgggaccgaccgtaacgggtcccgttacggggacccggtccccggttaccgggaacccgaccccgtaccgttaaacgtttaacgttaccggtttaaccgtcgggttaaccggtacccggttaaccgggtttaccccggggttttaaaccgcccgggtaccccggtaccgtaacggttaacccgttacccgtaacccgtttaaacccgttacccgttaaacccggtttaccgggttacccgggttacgggtaaccccgggttcgggttacccgggggaaccccggtaaaaccggggggtaacccccgg

SEQ ID NO: 251159 - DNA, 588 bp, Homo sapiens
  misc_feature: GYAE6OF01DMM1I.16.35.D02.1.454.CMB.1.raw
  modified_base (336)..(336): a, c, t, g, unknown or other
  misc_feature (336)..(336): n is a, c, g, or t
  modified_base (421)..(421): a, c, t, g, unknown or other
  misc_feature (421)..(421): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcaccgtgggtgcgccagaacgccggtaaaggcctggagtggagtggggagattgatccagtgactcncacatcaactacacgtcccgtccttccgaacggccacgtcaaccactcctcacgctgaacacgtccatcagtactcgtccttccngccaggtcgcgacacggccgtggacggccgtcggaccaccgtcatactattaccgtgtcgcgtacggttccggtgtcccggccgtcgaacgtactacctaacttacttacctaacgtccggttacgtacgggtaccgttggtacggggaccgtaaggggtaaccccg

SEQ ID NO: 251160 - DNA, 693 bp, Homo sapiens
  misc_feature: GYAE6OF01BB80G.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctcgtgaggatctcctgtaagggttctggatacgtaggttttccagctactggatcaccgtggtgcgccagaacgccggtaaagcctggagtggagtggggagattgactccgagtgactctcactatacaactacacgcccgttacctaccgaacgcccacgttccaacctactctcgacgctagaactacgtcccaattccgaagttacctcgtccctttaccgtgacgtacggtcggtaccgcgtacggtccgtacggggaccggtacccgtaccgggaacccaacccggacctaacgttaacttaagtttaccgtaggttcggtacggttacggttacccggttacgtccggtacccgtacgtaacgtaccgttacctaaacctttaacccttaccgttaaccgttacccggttacgttaccgggttaaccggttcccgggtacgggggtaacccgaacggggtaaccccgg

SEQ ID NO: 251161 - DNA, 633 bp, Homo sapiens
  misc_feature: GYAE6OF01C2LRH.16.35.D02.1.454.CMB.1.raw
  modified_base (374)..(374): a, c, t, g, unknown or other
  misc_feature (374)..(374): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctggtgcgccagaagcccggtaaagcctggagtggagtgggggagtatgatcccgagtgactctcacatcaactacagccctctccaaggcccacgtcaccntctcagctagacaacgtccatcacgttactcgtcccttcngctaggtcggccgnacgtccgtgggacgcccgtacggaccacccgacctaagttacttaagtttaccgtgtcggacggttacggttaccgggtttatcccggaccgtacgagtaccttaccgaacctttaaccgttaaccttaaccggttaccggttaccgttacggggtaacccgtttccgggtaaccgggggacccgtaaaccgggggtaacccccg

SEQ ID NO: 251162 - DNA, 624 bp, Homo sapiens
  misc_feature: GYAE6OF01B6Y8O.16.35.D02.1.454.CMB.1.raw
  modified_base (448)..(448): a, c, t, g, unknown or other
  misc_feature (448)..(448): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctggtaagggttctggatacgtaggttttccagtctactggatcaccgtggggtcgccgccaaggaacggacccggtaaaggcctgggagtgggagtgggggaggtattgactcccgagtgactctcacatacaactacacgcccgtccttaccgaacgccacgtcacctactcctacagctagaacaacgtccatcacgtacctcgtcccttacgtncgtaggtcggccgcgacggtcccgtagggaccggcccgtccggaacccacccgacaacttaagttacttacgtgtacggacgttacggttccgttactccggcccgagaacgtactcctactacctactaccgttacgtcgtacggaccgtacggtcgggaccgtaagggaccccg

SEQ ID NO: 251163 - DNA, 618 bp, Homo sapiens
  misc_feature: GYAE6OF01ANL1A.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaacgcccggggagtctctgaggatctcctgtaagggttctggatacaggttttccagctactggatcacctgggtgcgccagaacgcccggtaaaggcctggagtggagtgggggagattgactcccgagtcgactctcacactacaactacacgccccgtccttaccgaacggcccacgtccacccatcctcacgctgacaacgtccaatcaagtactcgccttcctgccgtagtcgggccgacgacggccgtagggacggtcccgtacgggaccacccgctaactattacttacgtcggtcgacgtacggttcccgttacgccgcccgtacagtactcctaaccttactacccttacgttacccggtcgtaccgggtaccgttcggtacggggacccgtaaggggaaccccg

SEQ ID NO: 251164 - DNA, 654 bp, Homo sapiens
  misc_feature: GYAE6OF01BY10O.16.35.D02.1.454.CMB.1.raw
  modified_base (418)..(418): a, c, t, g, unknown or other
  misc_feature (418)..(418): n is a, c, g, or t
  modified_base (465)..(465): a, c, t, g, unknown or other
  misc_feature (465)..(465): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggagtctctgaggatctccgtgtaagggttctggatacgtaggttttccagctactggatcaccgtgggtcgcgccgaaggaacggcccggtaaaggccgtaggaggtggagtgggggaggtattggactcccgagtcgactctacacatacaactacgacgtccccgttccttaccgaacgccctacgtccaccactctcgacnctagacaacgtccatacagttactcgtcccttctgctaggtcggccncgacgtcccgtggaccgccgtcggaccacccgctaagtacttacgttacgtggtacgtcgtacggttccggttaactccggaccgtactaggtacttacccgtaacttaaccgttaccgtaaccgttacgggttccgttaccggggaccgttaccgggtaccggggaacccgtaaacggggtaaccccg

SEQ ID NO: 251165 - DNA, 672 bp, Homo sapiens
  misc_feature: GYAE6OF01ETYTC.16.35.D02.1.454.CMB.1.raw
  modified_base (424)..(424): a, c, t, g, unknown or other
  misc_feature (424)..(424): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatactaggttttccagctactggatcacctgggtgcgccagaacgcccggtaaaggcctggagtggatgggggagattggatcccgagtgactctcacatcaactacacgcctcctaccgaaggcccacgtcaccactcctacagctagacaacgtccatcaacgttctgtccctttcngctaggtcggccgcagtcccgtgggaccggcccgtacggaacccacccggacctaagttacttaaccgtttacgtggttcggacccggttacgggttacccggtttaacgcccgggtacccgaacgtaagtacccgtttaccgaaccctttaacccgttaacgttaacccggttaccggttaccgtttaccggggaccggtttaccgggtaccgggggtaaaccccgtaaacgggggtaaccccccgg

SEQ ID NO: 251166 - DNA, 698 bp, Homo sapiens
  misc_feature: GYAE6OF01ASBJU.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaaggcccggggagtctcgtgaggatctccgtaggtaagggttctggatacgtaggttttccagtctactggactccgaccgtgggtgccgccgagaaccggacccggtaaaggcctgggaggtggaggtgggggaggtattggactcccgagtacgactcgtacactactacaactacacgtccccgtaccttaccgaacggtccctaccgtaccaacctacgtcctacgacgtcgtacgaaccgtaacgtccctataccgtaagttacctcgtcccctttcgcgacgtacggtcggcctacgacgtccgtgggaccgtcccgtacgacccgtacccgctaacgttaacttacgttacgtcgtaccggtacggttaccggttaccgtaacggtcccgacgtaccgaggttacctccgtaccttaacgtccgttaccggttaccgtcggtacggtacccggttggtaccgggacccggtaacgggtacccccg

SEQ ID NO: 251167 - DNA, 600 bp, Homo sapiens
  misc_feature: GYAE6OF01A7SLC.16.35.D02.1.454.CMB.1.raw
  modified_base (160)..(160): a, c, t, g, unknown or other
  misc_feature (160)..(160): n is a, c, g, or t
  modified_base (355)..(355): a, c, t, g, unknown or other
  misc_feature (355)..(355): n is a, c, g, or t
  modified_base (453)..(453): a, c, t, g, unknown or other
  misc_feature (453)..(453): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaacggngtctgtgccgaagtgcagctgggtgcagtccggacgcgagaggtagaaaaaggcccggggaagtctctcgaggatcgtcctggtaagggttcgtaggatacgaggtttcagctacgtggatcacgtgggtcgcgccagaacgacccggtaaaggcctaggagtggagtgggggagattgactccgagtcgactcncacatacaactcaccgcccgtcctacgaacggccacgtcacctatcacagctacgacacgtacatcagtacctcgtaccttcgtgcgtagtcggaccncgacgtccgaggacggccgtacggaccaccgctaacgtatacttacgtggtcgtacgtacggttaccgtagtccgacgacagtactactaacttactacgtacgttacggtacgtacggtccgtaggtcgggacgaaccgggtaccg

SEQ ID NO: 251168 - DNA, 660 bp, Homo sapiens
  misc_feature: GYAE6OF01E0R7T.16.35.D02.1.454.CMB.1.raw
  modified_base (451)..(451): a, c, t, g, unknown or other
  misc_feature (451)..(451): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaaggcccggggagtctctgaggatctcctggtaaggttctggatacgtaggttttccagtctactggatcaccgtgggtgcgccagaacgcccggtaaagcctggagtggagtgggggagattggactcccgagtgactctcacatacaactacgacgtcccgtccttaccgaacggcccacgtcaccactctacagctagacaacgtccatcagtactcgtccttctgcaggtcgcgcacgccgnggcgccgtacggaccaccgactattaacttacgttacgtggtacgtacggtacggttacccggtttaacgccggtacccggacgtaaccgtacgttaccctaaccctttaaaccgttacccgtttaaccgttcccgggtttaccgtacgggttacccggttaccggggttaccgggggtaaaccccggaaccgggggttaaacccccgg

SEQ ID NO: 251169 - DNA, 572 bp, Homo sapiens
  misc_feature: GYAE6OF01AFYLQ.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaacgcccggtaaaggcctggagtggagtgggggagattgatcccgagtgactctcacatacaactacacgccctccttaccaacggcccacgtcaccatctcagctgacacgtccatcagtactgtccttcgtgctagtcggccgcgacgtccgtgggacgccgtcggaccaccgctatactacttacgtgtcgcgtacggttccgttactccgccgacagtactcctactaccttactacgtaccgttcgtcggacgttcggtcggggaccgtaaggggtaccccg

SEQ ID NO: 251170 - DNA, 527 bp, Homo sapiens
  misc_feature: GYAE6OF01EA996.16.35.D02.1.454.CMB.1.raw
  modified_base (476)..(476): a, c, t, g, unknown or other
  misc_feature (476)..(476): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggagtgggggaggattgatcccgagtgactctcacatcaactacacgccctccttaccaagccacgtcaccatctcagctgacaagtccatcagtactgtcctctgcagtcgcgcagcctggacgccgtcggacaccgcatatatactgtgcgtagtccgttatccgcncagctacactactactacgtacgtcgtcggacgtgcggggcagggtacccg

SEQ ID NO: 251171 - DNA, 713 bp, Homo sapiens
  misc_feature: GYAE6OF01DZ4DQ.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaagcccggggatctctgaggatctcctggtaagggttctggatacgtaggttttccagctacgtggatcactgggtgcgccagacgccggtaaagcctggagtggagtggggagattgactcccgagtgactctcactatacaactacgacgtcccgtcctccgaagcccacgtccacctatctacacgctagaactaacgtccatccagtacctcgtccctttccgcgacgtacggtcggaccgccgtacggcccggttacgggaccggtccccgttaccgggaacccacccgggtacctaagttaacttacgtttaccgttacggttccggacggtttaccgggttaccgggtttacgtccccgggacccggtaccgaacggttaccgttacctaacccctttaactttaccccgttaaaccgtttacgggttacccgttacggggtaacccgggtttacccggggtaccgggggaaccccggtaaaccgggggtaaccccccgg

SEQ ID NO: 251172 - DNA, 779 bp, Homo sapiens
  misc_feature: GYAE6OF01CA50I.16.35.D02.1.454.CMB.1.raw
  modified_base (159)..(159): a, c, t, g, unknown or other
  misc_feature (159)..(159): n is a, c, g, or t
  modified_base (194)..(194): a, c, t, g, unknown or other
  misc_feature (194)..(194): n is a, c, g, or t
  modified_base (548)..(548): a, c, t, g, unknown or other
  misc_feature (548)..(548): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtgccgaagtgcagctggtgcaggtccggancaggtaggtagaaaaacggcccggggtatcctgtggaggatccgtccgtaggttaagggttctaggtaactacgtacggttttccaggtcttaacgtggatccgtaccggttgggcgccgacgaaggaaccggacccgggtaaaggccgttagggaaggttgggaggtagggggtagtaagtttcggacctcccggtaagtgtaacctttctaacaactacgttaacaaacctacgaccgtccccgttaccgttacgaaacggtcccacgttaccactacttaccgtcacgtcgtacggaacttacgtaccatacggtaacgtcctccgtccgttcaggacttaggtccggacncgcggtccgtaacgggaccgtcccggtaccggacgaacccgtctaacgtttacttaccgttaacggttccggacgtaccggttaaaccgttcccgttaaacgttaccggttccccggaccgttaacggaaccgttacgtaaaccctttaccggttaaacctttaaccgtaccgtttaacggttccgtacgggttacccgttacgggaccggggtaaaccgtaaccccgggg

SEQ ID NO: 251173 - DNA, 650 bp, Homo sapiens
  misc_feature: GYAE6OF01ACETF.16.35.D02.1.454.CMB.1.raw
  modified_base (488)..(488): a, c, t, g, unknown or other
  misc_feature (488)..(488): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggatctctgaggactctccgtggtaagggttctaggatacgtaggttttccagtctactggactcaccgtgggcgcgccagaacgcccggtaaaggcctggagtggagtgggggagatgactccgagtcgactctcactactactaactacgacgtcccttaccgtaccgaacggccctaaccgtccaacccgtatcctacgacgtctacgaactacgtccagtaccgtagtaccttccgcctttcctaggcctaggtcggccgcgtacgtccggnggaccggcccgtacggaccctaccgactacttaacgttacttagtcgtcgtacgtacggttccgtacgtccgccgtacgtacgacgtcctacgttacgtccgttaaccgtcggtaccggttacggaccgttcggaccggggtacccgtaacgggtaccccgg

SEQ ID NO: 251174 - DNA, 615 bp, Homo sapiens
  misc_feature: GYAE6OF01BEE1A.16.35.D02.1.454.CMB.1.raw
  modified_base (447)..(447): a, c, t, g, unknown or other
  misc_feature (447)..(447): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggagtctctgaggatctcctgtaagggttctggatacgtaggttttccagctactggatcaccgtgggtgcgcagaacgccggtaaaggcctggagtggagtggggaggattgactcccgagtcgactctcaacatacaactacacgcccgttccttacgaacggcccacgtaccacctatctacacgctagaacaacgtcactcgaagtctcgtcccttctgacgagtcggcncgacgccgtggacgtcccgtacggaccacccgctaacttacttattacgtgtacgcgtacggtccgttagtccggccgacgaacgtaccgtaccgtaacttaccgtaaccttacgttaaccggtcgtaccgggtacgttacggcggggaacccgaacgggtaaccccg

SEQ ID NO: 251175 - DNA, 706 bp, Homo sapiens
  misc_feature: GYAE6OF01AV5WM.16.35.D02.1.454.CMB.1.raw
  modified_base (291)..(291): a, c, t, g, unknown or other
  misc_feature (291)..(291): n is a, c, g, or t
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
  modified_base (406)..(406): a, c, t, g, unknown or other
  misc_feature (406)..(406): n is a, c, g, or t
tcagtgtactactccacgaccggtgctcgatttagcacacgatagttgggtttggggcgtccttcaccacccagctgggatctcagggcttccttttctgtcctcctccaggatggggtcaaccgccatcctcaccctcctcctggctgttctccaaggagtctgtgccgaagtgcagctggtgcagtccggagcgaggaggtagaaaaacggcccggggagtctcgtgaggatctcctggtaagggttctggatacgtggtttccagtctacgtggatcaccgtgggtcncgccagaacggcccggtaaagcctggagtggagtgggggaggattggacgtacccgngtcgactcacactatacgaactacncgtcccgtaccttacgacggccaacgtcacctntcctcacgctcgaaactacgtcccaagtcctaagtaccctggtacccttttcggcgacgtacggtcggtccggacacgggtcccgttaggggaaccggtccccgttacccggggaaccaccccgggtaacctaagtttacttacgttacggttgccggtaacggtacggttaccggttaacgtcccggtccgggtacaacggttaccttaccggtaactttaacccgtaacgttaccccggttaaggttccgtaacggggtaccttcgggtaccgggggaaccgtaacggggtaacccgg

SEQ ID NO: 251176 - DNA, 838 bp, Homo sapiens
  misc_feature: GYAE6OF01DZKMI.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacggcccggggagtctcgtaggaggactctccgtaggtaagggttctggtatacgtacggttttccagtctacgtggactcgtaccgtggggtcgaccgtaccgaagggaaccggtacccgggtaaaacggtcccgtaggggtaaggtaggggtaggtagggggggtaaggttagtttacgggaaccgttaccccggtaaggttcgtaaccgttacctacaaacctacttacctaaaaccgtacgaccggtacccccgttacccgttaacccgaaccgggtcccctaaccgtcccgaaccctacgtcctacgacgtcgtacgaacctaacgtacctactacgtacgttacctccgtacctttaccgtgtaccgtacgggtacgccggtaccgtaccggtccggtacgggtacccggtacccgtaaccgggaccctaccccgtaacgaacgtttaaccttaacgttaccggttcggtacgtacccggttaacggttaccggttaccgtccggaccgtaccgtaaccgtacgttacctaacccgtttaacgttaaccccgttaccggttacccggttacgtaccgggttacggtacccgggtacccggggtaacccgtaaacggggtacccccg

SEQ ID NO: 251177 - DNA, 824 bp, Homo sapiens
  misc_feature: GYAE6OF01CWW0L.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaacggcccggggatctctgaggactctaccgtaggtaagggttctaggatacgtacggtttccagtcctacgtggatccgtaccggtgggtcgccgaccgaacggaaccggtacccggggtaaaggccgtagggacggtggtacggtagggggagtagtgactccgaggtcgactctaccactactacaacgtacaccgtccccgttcctaaccggaacggcccctaccgtaccaaccctacgtaccctaccgtagtaccgtacgtaacctaccgtaccctaagtacccgtacgttaccgtaccgttcccctttccgacgtacggttaccgggtcggacccggtaccgtaacggtccccgggtacgggtacccggtcccggtacccgggaacccaccccggtaccgttaacttaacgtttaaccgtttccgggtacggttacccggggtacggtttacccggtttaccggtttaacccgtccccgggtaccgaccggttaccgtacccgttaacccttaacccgttaaccgttaacccgtttacccgggtaacggttccggttaaccggggttaccgttaccggggtacccggggacccggtaacccgggtaaccccgg

SEQ ID NO: 251178 - DNA, 643 bp, Homo sapiens
  misc_feature: GYAE6OF01B6D2R.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctcgtgaggatctcctggtaagggttctggatactaggttttccagctactggatcaccgtgggtcgccgccaggaacgacccgggtaaaggcccgtagggacggtggagtgggggaggtattggactcccgagtcgactctcacatacaactacacgtcccgtccttaccgaacggccacgtcaccatctcagctagacaacgtccatcagtactcgtcccttcgtcgcgtacggtcggccgcgacgtccgtggacgcccgtacggaccacccgactattatacgttactggtacgtccggtacggttccgttacgtccggccgtaccgaaggtaccttcgaacccttaacgttaacctaccggttaccggttcgtaccgggtaccgttaccgggtccggggaaccgtaaccggggtaaccccgg

SEQ ID NO: 251179 - DNA, 806 bp, Homo sapiens
  misc_feature: GYAE6OF01BCMWG.16.35.D02.1.454.CMB.1.raw
  modified_base (686)..(686): a, c, t, g, unknown or other
  misc_feature (686)..(686): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaacgcccggggatctctgaggatctcctggtaagggttctggatacgtaggttttccagtctactggatcaccgtggtgccgccaaggaacgcccggtaaaggccgtagggacgtggagtgggggagtattgactcccgaaggtcgacctcgtacacgactccgtaaacctacgaccgccccgttacctttaccgaacgggtccctaccgttaccaacccctacttccgtaccgacggtcctacggaacccgtaaaccgtaccccgtaacgttccgtaaacggttacccgttccgggttacccccttttacccgtcgggaacccgttaacggggttccgggtcccgtaacccggtaggttaccccgggtttacggggacccgtccccgggttaacccggaaccccgtacccggtaacttaacgtttaacttacggttaacccgttacgggtacgtacccggtaacggttttcccgggttacnccccgggtaccgtacgtaacggtaacctacccgtaaccgtttaacccgtaccgttaccggtaaccggttccgttacgggtaccgtcccgggtagggtaaccccgaacgggttaaccccgg

SEQ ID NO: 251180 - DNA, 611 bp, Homo sapiens
  misc_feature: GYAE6OF01BNVOM.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatactaggttttccagtctactggatcaccgtgggtgcgcagaagcccggtaaaggccgtggagtggagtgggggaggtattggactcccgagtcgactctcacatcaactacacgcccgtccttccgaaggcccacgtcacctatctcagctacgacacgtccatcagtacctcgtcccttcgtgcaggtcggcgcacggccgtgggacggtcccgtacggacccacccgccaattacttacgttacctggtcgacggtacggttacccgttacgtccggccgtctacgactcctaccttaacttacccgtactaccggttcgtacgggtaccgttacgggtcggggcccgaaacggggtacccg

SEQ ID NO: 251181 - DNA, 629 bp, Homo sapiens
  misc_feature: GYAE6OF01CGHY4.16.35.D02.1.454.CMB.1.raw
  modified_base (441)..(441): a, c, t, g, unknown or other
  misc_feature (441)..(441): n is a, c, g, or t
  modified_base (526)..(526): a, c, t, g, unknown or other
  misc_feature (526)..(526): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaaggcccggggagtctctgaggatctccgtgttaagggttctggatacgtaggttttccagctactggatcaccgtgggtgcgccagaacgccggtaaaggcctggagtggagtgggggagatttgactcccgagtcgactctcacatacaactaccacgcccgttccttaccaaggcccacgtcaccatctcagctgacacgtcatcacgtactcgtccttcctgctagtggccncgacgtccgtgggacggcccgtcggaccacccggtctaagttaactactttaccgtggtacgtcggtaccggttcccggtttacncccgggtcccgacgtaacgtacctaccgtaccttaaccgttaccctacgttaccgggttctacgggtaccgtacgggtcggggacccgaacggggtaaccccg

SEQ ID NO: 251182 - DNA, 788 bp, Homo sapiens
  misc_feature: GYAE6OF01C453N.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatccctcaccctcctcctggctgttctccaaggagtctgtgccgaagtgcagctggtgcaggtccggagcaggaggtagaaaaaggcccggggagtctctggaggtatctccgtggttaagggttctgggtatacgtacggttttccagctacgtggatccgaccgtgggtcgccgaccgaacggtaacggacccggtaaggccgtagggaggtggaggtgggggagtattcgactcccgagtcgctctacactactaccaactaccacgtccccgttccttaccgaacggtccctaacggtccaaccgtatccgtacaggtctacgaacctaacgtcctatacgtaacgttacctcggttaccccttcggtcgtacgtacggttcggccgtaccggtaccggtccggtacggggacccgtaccccggtaccgggaaccctacccgtacccgttaagtttaacgttacgtttacgtcggttaccggtacgggttaccggttaccgggttacgtaccccggtacgaccgtaacggttaccgtaaccctaaccgtttaaacccgttaaccgttacccggttaccggggttaccttaaccgggggttacccggggttaccgggttaacccggggggaaccccgtaaacccgggggtaacccccgg

SEQ ID NO: 251183 - DNA, 662 bp, Homo sapiens
  misc_feature: GYAE6OF01AJ88P.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacggcccggggagtctctgaggatctccgtggtaagggttctggatacgtaggttttccagtctactggatccaccgtgggtgccgccaggaacggccggtaaaggccgtggaggtggaggtgggggaggtattgactcccgaggtcgactcacacataccaactacacgtccccgttaccttaccgaacggcccacgtaccacctactctcagtctacgaacaacgtaccactactacgtactccgtcccttccgtgacgtaggtcggaccgcgacggtaccgtcgggacgcccgtacggaccacccgactattacgtacttacgtcggtcgacggtacggttaccgttacgtccggaccgtctaacgtaccgtaccgtaaccttacgtaacccgttaccgtacggtccgtacgggtaccgtaccggtacgggggacccgtaaccgggaacccgg

SEQ ID NO: 251184 - DNA, 602 bp, Homo sapiens
  misc_feature: GYAE6OF01CKR32.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaaggttctggatacgtaggttttccagctactggatcaccgtggtgcgccagaacgcccggtaaaggcctggagtggagtggggaggtattgactcccgagtcgactctcacatccaactacacgtccccgttccttacgaacgcccacgtccaccatcctacacgctagaccaacgtccatacgtatactcgtccttcctcgcgtaggtcggtcgcgacgccgtgggacggcccgtacggaccgacccgctactacttacttcgtgtcgtcgtacgtccggttactccgccgtcacggtactccgacttaccttaccgtacgtacggttcgtacggtaccgtacggtcgggccgaaccgggtacccg

SEQ ID NO: 251185 - DNA, 683 bp, Homo sapiens
  misc_feature: GYAE6OF01DGEO1.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaaggcccgggagtctctgaggatctccgtggtaaggttctaggatacgtaggttttccagtctacgtggactccaccgtgggtcgccgtaccgaagaacggacccgggtaaaggccgtgggacgtggagtgggggagtattgacgtcccgagtcgactctacgactatacaacctacaccgtccccgttccttaccgaacgggccctacgtaccacctaacgttcctacgacgtcctagaacctaacgtacccataccaagttacctcgtcccttccgtcgcgtaaggtcggcgtcgacgtcccgtgggccgtcccgtacggacccaccgactattactacgtttactggtagccgtacggttacccggttacgtccgaccgtcaacggtacctacctaaccgttaccttaaccttaccgtacggttaccgtcgggttaaccgttccggaaccggggtccgtaaaccggtaaccccgg

SEQ ID NO: 251186 - DNA, 786 bp, Homo sapiens
  misc_feature: GYAE6OF01CS0LK.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacggccggggatctcgtgaggactctccgtagtaacggtcttcgtagattacgtaggttttccagccttacgtggacttcgaccgttgggtcgccgaccgtaacggaacggtaccccgggtaaaacggtcccggtaggtacgggtagggtagggtagggggtaaggtactttagggacctccccgtaaggttcgaccttccgtacaacctataccgtaaacctacgaccgttccccgttaccttacccgaacggtcccaaccgtccaacctacttaccgtacgacgtactacgaaacgtaaccgtcctaactacgtacgttacctacgtcccttccgtacgacggtacggtcggacccgtacgtaccggtacccggtacgggaccgggttaccccgtaccgaaccccgtaccggtacccttaagttacctttaacgtcgttcggtaccggtcggttaccggttacccggttacgcccgtacccgagtaacgtacttacctaaccgttaaccgttacccgttaaccggttcgggtacgttacgggttaccggtaccgggtccgggaacccgtaacccgggg

SEQ ID NO: 251187 - DNA, 740 bp, Homo sapiens
  misc_feature: GYAE6OF01BNKSQ.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaaggcccggggagtctctgaggatctcctgtaaggttctggatacgtaggtttcagctacgtggatcaccgtgggtgcgccgagaacgaccggtaaggccgtggaggtggagtgggggagtagttgactcccgagtcgacctctcaactactacaactacaccgtccccgttacctaccgaacggccctaacgtccaacctactacctacacgtctacgaaccaacgtccaattcctacgttacctcgtaccctttcgcgacgtacggtcggcccgtacgacggtccgtagggccggtccccgtacgggacccctacccgctaagttaacgttacttaccggttggtaccggtaaccggtacgggtttacccggttaacgtcccgggtacccgtacgtaaccgtacgttacccgtaaaccccgttaaccttaaccccggttaaccggttaaccccgggttccggttaccggggtaacccggttttaccggggtaacccgggggaacccccggtaaaaccgggggttaccccccgg

SEQ ID NO: 251188 - DNA, 629 bp, Homo sapiens
  misc_feature: GYAE6OF01DGV98.16.35.D02.1.454.CMB.1.raw
  modified_base (559)..(559): a, c, t, g, unknown or other
  misc_feature (559)..(559): n is a, c, g, or t
tcagtgtactactccacgaccggtgctcgatttagcacacgatagttgggtttggggctccttcaccacccagctgggatctcagggcttccttttctgtcctcctccaggatggggccaaccgccatccctcaccctcctcctggctgttctccaaggagtctgtgccgaagtgcagctggtgcagtccggagcagaggtagaaaaacggcccggggagtctctgaggatctccgtgttaagggttctggatacgtaggttttccagtctacgtggatcgaccgtgggtcgccgccgaagaacggcccggtaaaggccgtaggagtggagtgggggagtagttgactccgagtcgactctacacatacaactacacgtcccgtccttaccgaacggtcccacgtacacctactcacgagtctagaacctacgtcctatacgtacgtacctcgttacccttcgtcgtctaggtcggccgcgacggtccgtcggacgtcccgtacggaccacccgactaactacttacttacgtgtcgcgtacgttccggtagtccgcgnacgtactacctactaaccttacgtacgtcgtacgtcgggtaccgttaggcgggaccgaacgggtaccccg

SEQ ID NO: 251189 - DNA, 818 bp, Homo sapiens
  misc_feature: GYAE6OF01DQ28L.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaacggcccggggagtctcgtggaggtatcctccgtggttaagggttctggattacgtaggttttccagtctacgtggatcgaccgtggggtgccgccgagaacggcccggtaaaggccgtggacggtgggaggtgggggaggtagttcggactcccgagtacgactctacactagtaccaactacgacgtcccgttccttaccgaacggccctacgtaccaccgtacgtcctacgacgtactacgaactaaacggtccctaacgttacgtaaccgttaccgttaccgggttcccctttacccgttacggtacctacgggtaccggggtacccgtaccggaaccggttcccggttaccgggaccgggttccccggttaacccgggaacccgacccccggtaccgtaacgtttaaccgtttaacgttttacccgttacggttacggtacccgggtttaacggtttcccgggtttaaccgtaccccggcccggtaccgttacgtaaccgttcccttaaccgttaaccgtttaccgttaacccggttacgggttacccgttacgggttacccggtacgggttacccgggggaaaccccgtaggggtaaacccccgg

SEQ ID NO: 251190 - DNA, 839 bp, Homo sapiens
  misc_feature: GYAE6OF01C4NMF.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaagggagtctgtgccgaagtgcagctggtgcagtccggagcaggaggtagaaaaacggccggggagtctcgtgaggatctcgtaggtaaggttctggtatacgtacggttttcagtctacgtggtactcgaccgtgggtcgcgaccaggaacgtacccgggtaaaggtccgtgggaggtagggaggtaggggggaggtagttacggacgtcccgtaggttacggtacctaccgtacgtaaccaactaccctaaacctaccgtaaccggtcccccgtttaaccccgttaaccgaaccggggccctaacccggtaccaaccccgtaacttccgaccgtaacgtccgtaaccggtaactaaacccgggttccctacttaccgtaacgtttaaccgttccgggtaccccttttacccggcgtaaccggtacgggttaccgggacccggtaaccgtacggtcccgggtacggggtaaccggtcccggttaaccgggaacccgacccgtaaccttaacgtttaaccttaacctttaacggttcggttacggtaacccggtcggttacccggtttacgtcccggtaccgtaccgaacggtaaccttcgtaaaccttacccgtacgttaacccgtaccgggttctaccggggtaaccctgggttacccgggacgtaaacccggggtaccccgg

SEQ ID NO: 251191 - DNA, 810 bp, Homo sapiens
  misc_feature: GYAE6OF01E29OH.16.35.D02.1.454.CMB.1.raw
  modified_base (353)..(353): a, c, t, g, unknown or other
  misc_feature (353)..(353): n is a, c, g, or t
  modified_base (497)..(497): a, c, t, g, unknown or other
  misc_feature (497)..(497): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcgaggaggtagaaaaacggcccggggatctctggaggactctccgtggttaagggttctgggatacgtaggttttccagcttacgtggactccgacgttggggcgccgaccgtaaggaacggaccgggtaaagccgtagggagtgggagtgggggaggtnttagactcccgaggtcgaccttcgtacactataccactaccgaccggccccgttactccgaaacggccctacgtccacctctccgtacacgtctacgaactacgtacccataccgtacgttaccgttccggtccttcggtaacncgtacgggtaccggccgtacggaccggtaccggttacggggacccggttccccggaaccgggaacccctccccggtaagtaacgtttaacgttaccggttttccgggttacggaccgggtaccgggtttaacccggtttcccgggttaaacgttccccgggaccgttaaacctaaggtaccccctttaacgtaaaaccccggttttacgttaaacccgttacccgggttacccgggtttacggttaaccccggggtacgggttttaaccccggggagggggttaacccccggtaaacgggggttaaccccccg

SEQ ID NO: 251192 - DNA, 589 bp, Homo sapiens
  misc_feature: GYAE6OF01BWGI2.16.35.D02.1.454.CMB.1.raw
  modified_base (385)..(385): a, c, t, g, unknown or other
  misc_feature (385)..(385): n is a, c, g, or t
  modified_base (438)..(438): a, c, t, g, unknown or other
  misc_feature (438)..(438): n is a, c, g, or t
  modified_base (467)..(467): a, c, t, g, unknown or other
  misc_feature (467)..(467): n is a, c, g, or t
  modified_base (507)..(507): a, c, t, g, unknown or other
  misc_feature (507)..(507): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctggtaagggttctggatacgtaggttttccagctactggatcacctgggtgcgccagaacgccggtaaagcctggagtggagtgggggagattgactcccgagtgactctcacatacaactacacgcccgtccttaccgaagcccacgtcaccntctcagctagacacgcactcacgtactctcccttctcgacgtaggtcggccgnacggtccgtgggaccgccgtacgggaccnccgcaattactattcgtagtcgacgtacggttccgttacnccggccgacagtactcctacttactaccgtaacgttcggtcgtacggtacgttccggcggggaacccgacggggtaaccccg

SEQ ID NO: 251193 - DNA, 632 bp, Homo sapiens
  misc_feature: GYAE6OF01EG6E5.16.35.D02.1.454.CMB.1.raw
  modified_base (283)..(283): a, c, t, g, unknown or other
  misc_feature (283)..(283): n is a, c, g, or t
  modified_base (437)..(437): a, c, t, g, unknown or other
  misc_feature (437)..(437): n is a, c, g, or t
  modified_base (541)..(541): a, c, t, g, unknown or other
  misc_feature (541)..(541): n is a, c, g, or t
  modified_base (560)..(560): a, c, t, g, unknown or other
  misc_feature (560)..(560): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaacgcccggggagtctcgtgaggatcgtcctgtaagggttctggatacgaggttttccagtctactgatcacctgggtncgcagtagccggtaaaggcctggagtggagtggggagattagactccagtcgacctctacgacatacaaactacaacgcccgttaccttaccgaaacgggccctacgtacacctatcgtcagctgaactagtccaagtcaatactgacccttcngacgtacggtggccggacaacgtccgacgggtaaccggcccgtacggaaccctaccccggacctaagttaactacgttacgtgttcgcgtacggtacccgttanccggaccgtagaacgttanaccctaatacccttaacaacgttacgggtactagggacccggttagtaccgggggtaccaacgggaaccccg

SEQ ID NO: 251194 - DNA, 744 bp, Homo sapiens
  misc_feature: GYAE6OF01EISBH.16.35.D02.1.454.CMB.1.raw
  modified_base (145)..(145): a, c, t, g, unknown or other
  misc_feature (145)..(145): n is a, c, g, or t
  modified_base (162)..(162): a, c, t, g, unknown or other
  misc_feature (162)..(162): n is a, c, g, or t
  modified_base (560)..(560): a, c, t, g, unknown or other
  misc_feature (560)..(560): n is a, c, g, or t
  modified_base (601)..(601): a, c, t, g, unknown or other
  misc_feature (601)..(601): n is a, c, g, or t
  modified_base (632)..(632): a, c, t, g, unknown or other
  misc_feature (632)..(632): n is a, c, g, or t
  modified_base (652)..(652): a, c, t, g, unknown or other
  misc_feature (652)..(652): n is a, c, g, or t
  modified_base (670)..(670): a, c, t, g, unknown or other
  misc_feature (670)..(670): n is a, c, g, or t
tcagtgtactactccacgaccggtgctcgatttagcacacgatagttgggtttgggctccttcaccacccagctgggatctcagggctttccttttctgtcctcctccaggagtggggtcaaccgccatcctccaccctcctccnggctgttcctcgaaggngtctgtcgaccgaagtgcagtcgtggtacgcgaggtccggagacgaaggaagggtaaacggaaaaccggcccggggtagttctcggtaaggacggtacttcgtaccgtaggttaacggttcgtaggtaacttacgttacggtttccgacgtacgttacgtacggaccttccggtacggttcggggacggaccggtaaccggtaaacgggtaacccggggtaacccggtaaacgggtccggtaaggggtaggttacgggggaggtacgggggtagttacgttcgaacgtcccgtagtcgacctctacgaactactaccgtaaccgtaccgtcccgtaccgttaccgaacgaccgtaccgaaccgtaccacgtactgacctaagctaacgaactcgtacngttaacgcgttcgtccgttacgtcgtacgacggtcggtacncgtcgacgtcgacggtcgaccacgaccgacnctattacgtactgtaccggngtaccgtacgttccgacnccgcgtaatccgtacgtacgtaactcggtacgttcgtacgcggttcgacgggttacggcgttcgaaccgtccgg

SEQ ID NO: 251195 - DNA, 632 bp, Homo sapiens
  misc_feature: GYAE6OF01B4Y4N.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggagtctctgaggatctccgtgtaagggttctggatacgtaggttttccagtctactggatcaccgtgggtgcgcagaacgccggtaaaggcctggagtggagtggggaggattgacgtcccgagtgactctcacatcaactacgacgcccgttcctaccgaacggcccacgtccaccatcctacagctgaacaacgtcccatccagtacctcggtccttcgtgcgaggtggccgtcacggtccgtagggaccggcccgtacgggacccacccgtcaattaacttagttaccgtggtacgtccggtacggtttcccggtaactcccggaccgacgtaagtacttacccgaacgttaccttaaccgttaccgtaccggtcgtacgggtacgtacggacggggacccgaagggtaaccccg

SEQ ID NO: 251196 - DNA, 849 bp, Homo sapiens
  misc_feature: GYAE6OF01DA1VX.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatccctcaccctcctcctggctgttctccaaggagtctgtgccgaagtgcagcgtggtgcaggtccggagcgagaggtagaaaacggcccggggagtctcgtagaggacttccgtccgttaggttaacgggttcgtaggtactaccgttacggttttccagtaccgtacgtggtactccgtaccggtggggtcgccggaccgaacggtaaaccggaacccgggttaaacggccgtagggtaggtagggtagggtagggggtaaggtagttacggaccgtacccggtaggttacgtaccttacgacctaacgtaacttaacctaaaccgtacccgacccgtccccgtttacccgttaacccgaaccggtaccctaacccgtccaaccgtactccctacacgtactacgtaaccgtacgtacctacgtaccgtaaccgtccgttccgtacccttcctcggaccgtagggtccgaccgaccggaccgtaccggttcgggaccggtcccgtaacccggacctaccgtactaacgtttacgtttacgttacgtacgggttacgtaccgggttaccggttaccgtacgtcccggaccgtacgttaacccgaccgttaaccctaaccctttaaacgttcccggttaacggttcccgggttacggttacccgggttacccggtaccgggggttaacccgggaaccccgggttaaaaccgggtacccccggg

SEQ ID NO: 251197 - DNA, 694 bp, Homo sapiens
  misc_feature: GYAE6OF01CZ8MW.16.35.D02.1.454.CMB.1.raw
  modified_base (159)..(159): a, c, t, g, unknown or other
  misc_feature (159)..(159): n is a, c, g, or t
  modified_base (243)..(243): a, c, t, g, unknown or other
  misc_feature (243)..(243): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtgccgaagtgcagctggtgcagtccggagcagaggtgaaaaacggcccggggatctctgagatctcctgtaagggttcnggatactaggtttccagctactggatcaccgtgggtgcgccagaacgccggtaaaggcctaggaggtggagtgggggagtattgactcccgagtcgactccgtcgactatacaaactacgacgtaccccgttccttacccgaaaggcccctaaccgtacccaaccgtactccgtacacgtctacgaactacgtccatacacgtactcgtccttcgtgctaggtcgcgccacggtccgtgggaccggtccctcggacctcccgacctattacgttacgttacgtagtcggtaccgtacggttcccggtttacgtacccggtacccggacgtacgtaacgtttaacccaaccgtttaacccttaacccgttaaccgggtttcccggtacggttacggggtaaccccggtttcggggtacccggggggaacccgtaaacgggggtaacccccgg

SEQ ID NO: 251198 - DNA, 643 bp, Homo sapiens
  misc_feature: GYAE6OF01EAKP5.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctctcctggctgttctccaaggagtctgtgccgaagtgcagctggtgcagtccggagcagaggtagaaaaagcccggggagtctctgaggatctccgtgtaagggttctggatacgtaggttttccagctactggactcaccgtgggtcgcgccgagaacgccggtaaaggccgtggagtggagtgggggagtagttgactccgagtgacctctacacgatacgaactacgaccgtcccgtccttaccgaaacggcccaacgtccactactcgtacagtctacggaactacgtcctatcaacgtacctcgtaccttcgtgacgaggtcggccgctacggcgttacggacgcccgtacgacctacccggaccaatacttaacgttacgtaggtcgtacggtacgttaccggttactccgggcctacgaagtacgtccgtaacttaccgtacctacggttaccggttacgtacggtaccggttacgtcgggggacccaaggggtaccccg

SEQ ID NO: 251199 - DNA, 1027 bp, Homo sapiens
  misc_feature: GYAE6OF01AJ3M1.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaacggcccggggagtctctgaggatcctcctggtaagggttctggactacgtacggttttccgagtacgttacgtgggtaactccgtaacccggttgggggtccgcccggtacccgaacggtaaaccggggtacccccggggttaaaaacggggtccccggttacgggggtaacgggttacggggtaaacggggttaccggggggggggtaaagggttaaacggttttacgggtaaacccgtttacccccggtaggtttaaccgggtaaccctttaccccggtttaccaaaccggtaactttaaccccgaaaaccgtttaacccggtaacccgggttaccccccggtttacccccttttaaccccggaaaacccggggttcccccgtaaccggtttaccccaaaccccgttaacttcccgttaaccgaacgtacccggttaacggtaaacccgtaaaccggttacccctaacgttaccgtaaccgggtttaaccctccggtttaaccccgtttcccgttacgggtaccgtaacgggttccgggacccgtacccggtaacccggggttcccggtacggggtaacccggtacccccgggtaccgggtaacccctacccccgggtaacctaactttaaacgtttaccgtttaaccggttggttccggaccggttaccggttacccggttaaccgttcccggacccgtacgtacggtaccctaccgtaacccttacccgttaaccttacccgggttaccgttaccgggtaccggtacccgggtttacgggtaccggggtaacccggaaaccgggggttacccccg

SEQ ID NO: 251200 - DNA, 810 bp, Homo sapiens
  misc_feature: GYAE6OF01BQFNR.16.35.D02.1.454.CMB.1.raw
  modified_base (156)..(156): a, c, t, g, unknown or other
  misc_feature (156)..(156): n is a, c, g, or t
  modified_base (180)..(180): a, c, t, g, unknown or other
  misc_feature (180)..(180): n is a, c, g, or t
  modified_base (190)..(190): a, c, t, g, unknown or other
  misc_feature (190)..(190): n is a, c, g, or t
  modified_base (292)..(292): a, c, t, g, unknown or other
  misc_feature (292)..(292): n is a, c, g, or t
tcagtgtactactccacgaccggtgctcgatttagcacacgatagttgggtttgggctccttcaccacccagctgggatctcagggcttccttttctgtcctcctccaggatggggtcaaccgccatcctcaccctctcctggctgttctcaaggngtctgtcgcgaagtgcagctggtncagtccggancgagaggtagaaaacggccggggtagtctgtagagactctcgtaggttaaggttcgtaggtacgtacgttacgtttaccagtctagtggactcgacgtggcncgacgagacggtaccggtaagcgtaggacggtggtacggtggggaagtgttacgacgtaccgtaggtcgtaccttacactaacgtactaaccgtaaccgttaccggacgttccccggttaccgttaaccgaaccgggtacctacggtaccaccgtactacgtaaccgtacgtacgttacgaaccggtaacttccgaacgttaccgtaacggttaccgtcggtaccccgttttaccggacggtacggttaacgggtccgaccgggtaaccgttccgggtaacgggtacccgggtaccggttacccccggtaacggaacccggtaaccccgtaacggttaacttaaccttacggttaccggttacggacggtacggttaacccgggttaccgttaacccggcggtacccgaccgttaacgttccgtaaccgtacccgttaacgttacccgaacggtttcccggacgtaaccgggttacccggttacgggaaccggggaaccggtaccgggtaaccccggg

SEQ ID NO: 251201 - DNA, 677 bp, Homo sapiens
  misc_feature: GYAE6OF01E3KAH.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcaccgtgggtgcgccagaacgcccggtaaaggcctggagtggagtggggagattgatcccagtgactctcacatcaactacacgcccgtcctacaacggcccacgtcaccatctcagctagactaacgtccatcagtactcgtccttcctgcgtagtcggtcgacagcccgtagggacggtccccgtacggacccgtaacccggcctaacttaagttaactttaccgttcgggttaccggtacgggtaccggttacccggtttaaccgtcccggaccccgtaccgaacggtaacttaccctaacccttaaaccttaacccgttaaccgttaacccgggttacgttaccggggtaacccggttacccgggttccggggggaaccccgtaaaacggggggtaaccccccg

SEQ ID NO: 251202 - DNA, 748 bp, Homo sapiens
  misc_feature: GYAE6OF01C9Z6E.16.35.D02.1.454.CMB.1.raw
  modified_base (160)..(160): a, c, t, g, unknown or other
  misc_feature (160)..(160): n is a, c, g, or t
  modified_base (554)..(554): a, c, t, g, unknown or other
  misc_feature (554)..(554): n is a, c, g, or t
tcagtgtactactccacgaccggtgctcgatttagcacacgatagttgggtttggggctccttcaccacccagctgggatctcagggctttccttttctgtcctcctccaggatggggtcaaccgccatcctcaccctcctcctggctgttctccaaggngtctgtgccgaagtgcagctggtgcaggtccggagcgaaggtaggtaaggaaaaaccgggccccggggtagttctcgtaggaaggtacttccgttaccgttagggttaacggttcgtaggtacttaccggttacggtttaccgagtcttacgtaggtactccgtaccggtggtcgaccgaccgaggaaccggtaccggtaaggtccgtagggaggtgggtaggtagggggacgtagtttacgaccgtcccgtagtacgcctactacactactaccaactccgaccgtcccttactaccgacggccctacgtaccacctctaccgacgtacgtctaacgacctacgtacctactcgtacgttaccctcgttcccttcgtgacgtaggtcggaccncggtaccgtccggtcgggaccgtacccgtacgacctaccgtacttaacgttacgttagttccgtaggttccggtaccgttacggtaccgttacgccgtaccgtacaacgttacctaccgttaaccttaccgtaccgttacggttccggtacggtacgggtaccgtaccggggtccggaaccggtcgtaccccgg

SEQ ID NO: 251203 - DNA, 844 bp, Homo sapiens
  misc_feature: GYAE6OF01EHI6H.16.35.D02.1.454.CMB.1.raw
  modified_base (160)..(160): a, c, t, g, unknown or other
  misc_feature (160)..(160): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctccaccctcctcctggctgttctccaaggngtctgtgacgaagtgcagcgtggtgcgacggtccggagcgaggaaggtacggaaaaacgggcccggggtattctcgtggaggtacttccgtcgttagggttaacgggtttcgtagggtaacttaccgttaacggttttccgagtaccgttacgtaggtacctaccgtaccggtcgggtcgaccgtaaccgaaacggaaccgggtaacccggtaaacggtccgtaggggacggtagggtacgggtagggggtaggttaacgttacggaccgtaccgtacggttcgtaccgttacgtacgaaccttacgtaaccctaaccgtaccgaccccggttacccgttacccttaaccggaacccgggtaccctaacccgttccaaccctacgttcgacgtaccggtactaaccgtaacgtaaccgtcctaacgtacgtaacgttccgtacccggttccttcggtaacgtcgtacgggtacggcctaaccggcggtaaccgtggacccgtcccgacgaccctcgaacttagttaccttagttacgggcgttaccgggtacgttaccgggttacggttccgaccgacccgtagtaccgtaacttaccggtaaccttaacggttccgtaacggttccgggttaacggtcggtccggtaacccggggtccgggtaacccggaacgttaccccggg

SEQ ID NO: 251204 - DNA, 847 bp, Homo sapiens
  misc_feature: GYAE6OF01EE7OA.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggatctgtgccgaagtgcagcgtggtgcacggtccggagcgaggaggtagaaaaacggccggggagtctcgtgaggtactcgtccgttaggttaagggttcgtaggtacttaaccgttacggttttaccgacgtacgttaccgttagggtacgttaccggttaccgggtcggggtccgacccggtaaccggtaacgggtaacccgggtaacccgggttaacgggtaccggtaggggtagggtagggtagggtagggggtaagttacgttacggtaccgtaccgtagtacgtacctacctactaactacgtaacctaaccgtaccgtaccggttcccgttaccgtaaccgaccggaccgtaccgtaccgtacctactccgtactacgtactaacgaaccgtacgtacctactaccgtaacgttaccgtccgttcccgttacgtcgtacggtacggtcggtaccgtacgccggtaccggtcgggtacccggtaccggtaccgaacccgtaccgtacgtaactttacgttaccgtacgggtacgtaccgggtacgggtttaccgttaccggttacgcccgtacgtacgtaacgtaccttaccgttaaacgttaccggttaaccgtacggttaccggtacggttacccggtacgggttaaccgggtaaccgggtaaccggtaaccggtaacccgg

SEQ ID NO: 251205 - DNA, 835 bp, Homo sapiens
  misc_feature: GYAE6OF01CIB2H.16.35.D02.1.454.CMB.1.raw
tcagtgtactactccacgaccggtgctcgatttagcacacgatagttgggtttgggggctcctttcaccacccagctgggatctcagggcttccttttctgtcctcctccaggatggggtcaaccgccatcctcaccctcctcctgctgttctccaaggagtctgtgccgaagtgcagctggtgcagtcggagcaggaggtagaaaacggccggggagtctcgtgagtatctccgtaggtaaggttcgtggtactacgtacggttttccagtccgtacgtaggtactcgaaccgttggggtcgaccgaccgtaaggaaccggtaccgggtaaacggtccgtagggacggttagggacggtaggggggagtagttacgacgtcccgagtcgtactaccgtacgactaacttaccgaaacgttaccgaccgtccccgttacccgttaccgaaacggcccgtaacgtaccacctacgtcctacgacgtcctaacgaacctaaccgttaccacttacgtaaccggtaccgttccgttaccccgtttacgtacggtacgtacgggtccggtcccgtaccgacgttacccgggtacgggtacccggtcccggaacccggtaccgaaccccgtaccgttattaacctttaacgttacggttccgttaacgggccggtttaaccggttcccggttaaacgtccccgggtaccgtaccgtaacgtaaccgtcccgtttaacctaacccgtttaccgtaaccggtttccggttaaaccggttccgggttaccccgggttccgggttaaacggggtaaccccggtaaccggggttaaccccccggg

SEQ ID NO: 251206 - DNA, 789 bp, Homo sapiens
  misc_feature: GYAE6OF01DPFTL.16.35.D02.1.454.CMB.1.raw
  modified_base (537)..(537): a, c, t, g, unknown or other
  misc_feature (537)..(537): n is a, c, g, or t
tcagtgtactactccacgaccggtgctcgatttagcacacgatagttgggtttaggggcgtccgttcaccacccagctgggatctcagggcttccttttctgtcctcctccaggatggggtcaaccgccatcctcaccctcctccgtggctgttctccaaggagtctgtgccgaagtgcagtctggtgcaggtccggagcgagaggtagaaaaacggcccggggatctactggaggatctcgttaggttaaggttctaggactacgtaggttttaccagtcctacgtggatccaccgtggggtcgaccgaccgaaggaaccggtacccggggtaaaggtccgtaggggtacgtgggtaaggtggggggaggtaatttcggaaccgtcccggaaggttcggacttccgtacaactactaccgaacctcgaccggtcccttaccgtaccgaacgccctaacgtccaacctacgtcctacacggtctacgaacgtaacgtaccctagttacgtaacgttccctcgtaccccgttttacgnggtaccgtaagggttccggaccggttacgtaccggtccggttaacggggcccggtacccgtttaaccggaaccctacccgtacgttaaactttaccgttacgtttaaccgtgggttccggtaacgggtaccgtttaccgggttcgtacccggcgtaaccgtaaggtaccctacgtacctttaacccgtaacgtacccgttacgggttaccttcggggactttccgggaccggtaccggtacgggtacccccg

SEQ ID NO: 251207 - DNA, 800 bp, Homo sapiens
  misc_feature: GYAE6OF01AR9OL.16.35.D02.1.454.CMB.1.raw
tcagtgtactactccacgaccggtgctcgatttagcacacgatagttgggtttgggggctccttcaccacccagctgggatctcagggcttccttttctgtcctcctccaggatggggtcaaccgccatcctcaccctcctcctggctgttctccaaggagtctgtgccgaagtgcagctggtgcagtccggagcgaggaggtagaaaaacggcccggggagtctcgtggaggatctccgtaggttaagggttctggatacgtaggttttccagtctacgtggactcgaccgtgggtcgccggccaggaaccgacccggtaaaggccgtgggagtcggagtgggggagtattcggactcccgtagtgacctcgtaccactagtaccaaccgtaccgaaccggtccccgttacccgtttaccgaaacgggtcccctaacccggttaccaacccctactttaccgtacctaacggtaccgttaacgaaaccgtaaccgttaccctaacgttaccgtaacggtttaccgtaccggttacccctttcccgttaggtaaccgtacgggttccgggaccgcgtacccgggtacccggtacgggacccgggtcccgtaacccgggtaaccctacccggtaccctaaacgttacctttacggttacgttaccgggttagtaccggttaccggtttaccgggttacgtcccggtaccgtacgacgtaacgtcccttaactaccgttacctaaccggttcgttcggtaccggtaccggtcggtaccggggaccgtaccggggtaaccccg

SEQ ID NO: 251208 - DNA, 825 bp, Homo sapiens
  misc_feature: GYAE6OF01CZK6J.16.35.D02.1.454.CMB.1.raw
  modified_base (199)..(199): a, c, t, g, unknown or other
  misc_feature (199)..(199): n is a, c, g, or t
  modified_base (323)..(323): a, c, t, g, unknown or other
  misc_feature (323)..(323): n is a, c, g, or t
tcagtgtactactccacgaccggtgctcgatttagcacacgatagttgggtttggggctccttcaccacccagctgggatctcagggtcttcctttttctgtcctcctccaggatggggtcaaccgccatcctcaccctcctcctggctgttcctccaaggagtctgtgccgaagtgcagcgtggtgcacggtccggancgaggaggtaaggaaaaccggcccggggatctcgtaggaggtactcgtcgttaggttaagggttctaggtaactacgttacggttttccacgtactacgtcggtactaccgtacggtcggggtnaccggtaccaacggtaaccggacccgggttaaaggccgtagggtaggtacggggagttaggggggattagttacgaccgtccgtaggtctacgtactacaagtacctactaacgtaccgcccgtaccccttaccttaccggaaaccgcccgtaacgtaccaaaccctcgtacctacgactcgtacgaacctacgtccagtacctaccggtacttcccgtccgttaccgtcggtaccgtacggtccggtaccgtaccgtccgggtaccggtcgggacccggttacccggacccggtaacccgaccccgtaacttaaccgttaacgttaaccgtttccgggtacggtacggtacccggttacgggttaccgttacccggaccgtccgtaaacggtacctaccgggtaacccttaccgttaaccgttaaccgttacgggttacccggttacggtcccgggttacggtacccggggtaacggtacccgggaaacggtaccccgggg

SEQ ID NO: 251209 - DNA, 685 bp, Homo sapiens
  misc_feature: GYAE6OF01DXE40.16.35.D02.1.454.CMB.1.raw
  modified_base (326)..(326): a, c, t, g, unknown or other
  misc_feature (326)..(326): n is a, c, g, or t
  modified_base (407)..(407): a, c, t, g, unknown or other
  misc_feature (407)..(407): n is a, c, g, or t
  modified_base (450)..(450): a, c, t, g, unknown or other
  misc_feature (450)..(450): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaacggcccggggatctctggaggatcctcctaggttaaggttctggatacgtacggtttccagtctacgtggactcgaccgtggtcgcgccaagaacgccggtaaagcctaggagtggagnggggaggattgactcccgagttgactctacacatacaactgaccgcccttcctaccaacggccaccgtcaacgtctctacngctacgaactaacgtaccactactactactcgtcccttaccgngtcgacggtcggccgaccgtagtccccggtagggaccgtcccggtaccggaccccgacccgtaaccctagttaactttaacgttcgtaggttacgcccggttacggtttcccggttaactcccggccgacgtagtaaccgtactacccttaacttaacccggttaaccgttacccggttaccggttcgggtaaaccggtccgggttaccggggacccgtaaccggggtaaccccg

SEQ ID NO: 251210 - DNA, 702 bp, Homo sapiens
  misc_feature: GYAE6OF01D4S4P.16.35.D02.1.454.CMB.1.raw
  modified_base (252)..(252): a, c, t, g, unknown or other
  misc_feature (252)..(252): n is a, c, g, or t
  modified_base (470)..(470): a, c, t, g, unknown or other
  misc_feature (470)..(470): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcaggtccggagcagagggtagaaaaacggcccggggagtctcgtggaggatcctcctaggtaaggttcngatacgtacggtttcagctacgtggacttcgacgtggtgccgacgaggaacgaccggtaaggccgtaggagtggaggtggggaggtagttcgactccgtaagtcgactctacgaactataccaacgtacaccggtccccttacctaccgacgcctacgacaccactcacacgtcaagacctaacgacctacgtcctaagtacctccgttcccttacgngaccgtggtacgggccacgtacggtccgtagggacccgtacccgtacgggacccctccggtaactagtttacctaacgttccgtaggtaccgtccggtacggttaccggtttaccgccggtaccgagtaacggtacctaaccggtaacccttaacgttaccgttaccggttaccggttcgtaaccggggtaccgttcccggggaacggggaccctaaacccggggtaccccg

SEQ ID NO: 251211 - DNA, 992 bp, Homo sapiens
  misc_feature: GYAE6OF01B9H6Y.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacggcccggggagtctcgtaggaggtactccgtccgtaggttaacgggttcgtagggtaactaacgttacggtttttccaggtaccttacgtagggtactacccgtaaccggtttgggggtcgacccggaaccggaaacgggtaaaacccggggtaaccccggggttaaaaacggggtcccggttagggggtaacgggttagggggtaagggttaacgggggggggtaaaggttaacgttttaccggggaaaccgtttacccccggtaagggttaaccggttaaccctttacccggttaacctaaaccggttaaaccgttaacccctaaaaacccggtttaaccccggtaacccgggttaaccccccccggtttaccccgtttaaaccccgggtaaaacccgggacccccttaaaccgggttaccccgaaacccccgttaactttccccggtaacaaccgggttacctaaccgggtaaaccttaaaccccggtacctaaacggtttaacccgtaacgggttaacccttccggtttacccctttccggacggtaacccggtaacggggttcgggaccccggaccgttaacggggtcccgttacggggaccccgtacccgtaaccgggaccctaacccgtaacgttaataaccgtttacgttacggtggtaacccgtcggttaaccgttaccggtaaccgtccggaaccggacctaaggtacctaccttaacgtactacccgttagtacggtactcgggtacgtcgggacggtaccggaacggtaccg

SEQ ID NO: 251212 - DNA, 823 bp, Homo sapiens
  misc_feature: GYAE6OF01DRRBT.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcgaggtccggagcgaggaggtaggaaaaacggcccggggtagtctcgtaggaggtacttcgtccgttaggttaacgggttcgtaggtaattaccgttacggttttccaggtaccttacgtggtactccgtaccggtggggtccgaccggaccgaaggaaaccgggtacccgggtaaaggtccgtaggggaggtgggtaggagggggtagtagttcgactcccgaggtcgtctactacactactaccaaactaccgaccgtacccgtacctacgaaccggtctaaccgtcctaacctactccgtacgaccgtctaacggtaacctaacgtacctaacgtccgttaacgttaccgttcccgttacccgtttccgtaggtaccgtacgggtcggtacccggaccgtaccgggttcccgggtcgggtaaccccgggtccccggtacccgggaaccctaaccccgttacgtaaacgtttacgttttaaccgttaccgttagggtacccgtacggtttacggtttacccgtacgtcccggtacgactaaccgttaacgtccctaaccgttaccgttaacggtacccggtttacgtccggtaccgggtacggttacccggtacggggaacccggtaccggtacccgg

SEQ ID NO: 251213 - DNA, 710 bp, Homo sapiens
  misc_feature: GYAE6OF01BA29M.16.35.D02.1.454.CMB.1.raw
  modified_base (160)..(160): a, c, t, g, unknown or other
  misc_feature (160)..(160): n is a, c, g, or t
  modified_base (501)..(501): a, c, t, g, unknown or other
  misc_feature (501)..(501): n is a, c, g, or t
  modified_base (589)..(589): a, c, t, g, unknown or other
  misc_feature (589)..(589): n is a, c, g, or t
tcagtgtactactccacgaccggtgctcgatttagcacacgatagttgggtttggggctccttcaccacccagctgggatctcagggcttccgttttctgtcctcctccaggatggggtcaaccgccatcctcaccctcctcctggctgttctccaaggngtctgtgtccgaagtgcagctggtgcagtccggagcagaggtagaaaacggccggggatctcgtggaggtactctccgttaggtaacgggttctaggattaacgtggttttccagtctacgtggactcgaccgtgggtacgccgtacgaagaacggaccgggtaaagccgtagggagtgggaggttaggggagtattacggacttccggtagtacgtacctcctacactactacctaactacgtaccgccgttaccgttaccgaaacggtcctaccgtaccacccgtataccgtacgagtaccgtacggaaccgtacgtccaacgttaccgaacgttaccncggttccccttacgtcgaccgttacgggcgaccgacctacgggtcccgtcgggaccgtccgtacgcctaacccgtatattacgttacnccgtaggtcctacgtacggttaccgtgaccgtacggactaagtcctcgtaacccttcgttaaccgaagttccggttacgacgggttcccgacgggttaacgggcccgttaagggtaccccg

SEQ ID NO: 251214 - DNA, 780 bp, Homo sapiens
  misc_feature: GYAE6OF01DDUEG.16.35.D02.1.454.CMB.1.raw
  modified_base (160)..(160): a, c, t, g, unknown or other
  misc_feature (160)..(160): n is a, c, g, or t
tcagtgtactactccacgaccggtgctcgatttagcacacgatagttgggtttggggctccttcaccacccagctgggatctcagggcttccttttctgtcctcctccaggactggggtcaaccgccatcctcaccctcctcctggctgttctccaaggngtctgtgccgaagtgcagctggtgcgagtccggagcaggaggtacgaaaaacggcccggggagtctcgtaggaggacttcctccgttaggttaacgggttctggtactacgttacggttttccagtacgtacgtggactaccgtacggtggtcgaccgaccggaacggaaccggtaccggtaacggccggtaggtaggtggagggtaggggagtagtcgacgtccgtagtcgtactctacgactactaccgaactaccgaccggtcccgttaccgtaccgaccggaccctaccgtaccacctactccacgacgtaccgacgaactacgtacctactacgtacgttccgtccgtccgttcgcgtcgtacggtcggccgacgtacgtccggacggcccggtcccggtaccggacccgtaccgtaccttaacgttacgttacgttacgtcggtaccgtaccggttacggtttcccggttaccgtcccggaccgtaacgtacgtacccgttaaccggttaaccgtttaccggttaaccggttacccgggttaccgggttacgggttaccgggttacccgggttacggggttaaccccggggaacccggtaacccgggtacccgg

SEQ ID NO: 251215 - DNA, 917 bp, Homo sapiens
  misc_feature: GYAE6OF01EL1VR.16.35.D02.1.454.CMB.1.raw
  modified_base (163)..(163): a, c, t, g, unknown or other
  misc_feature (163)..(163): n is a, c, g, or t
  modified_base (609)..(609): a, c, t, g, unknown or other
  misc_feature (609)..(609): n is a, c, g, or t
tcagtgtactactccacgaccggtgctcgatttagcacacgatagttgggtttgggctccttcaccacccagctgggatctcagggcttccttttctgtcctcctccaggagtggggtccaaccgccatcctccacccctcctcctggcttgttctcgaaggntctgtcgccgaagtcgcagtcgtggtgcacggtccgagcgagaggtaagaaaaccgggccgggtagtccgtcgtaggacgtactccttcgtaggttaaggttcgtagtaacgttaccgtacggtttaccagtaccttacgtggtacctccgacggttgggtaccgccgaccgaacggtaaccggaccggtaacggccgtagggtaggtgggacgggtggggaacgtagtacgtacgcccgtagtcgtaccgtctaccgaactacgtacctaaccgtaaccggtacccgtcccgttacccgtaacggtaaccccgaccgttaacccgtaaccctacccgtacgttcccgaacgtacgtacctaaaccggtaaaccctaacccgttaccgttaacgttaggtaacctttaccggttacccgtcccgttttaccgacggttaacccggnggtccgggtaccgtaccgtaccggttacccggtcggggacccgtttacccccggaggtaaacccccgacccggttaactaacctttaacgggtttaccggttaccggtaaccggttccggttacccgggtttaaccggtttcccggttaccggtacccggtacccttaccgggtaaacctagtttacccccgttaacgtttaaccccgttaacccgggttaacccgttacccgggtacgttaccccgggtaacggggtttacccggggtaacccgggaaaacccggggcccccgttaaaccccggggg

SEQ ID NO: 251216 - DNA, 665 bp, Homo sapiens
  misc_feature: GYAE6OF01DUYMS.16.35.D02.1.454.CMB.1.raw
  modified_base (162)..(162): a, c, t, g, unknown or other
  misc_feature (162)..(162): n is a, c, g, or t
  modified_base (185)..(185): a, c, t, g, unknown or other
  misc_feature (185)..(185): n is a, c, g, or t
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
  modified_base (529)..(529): a, c, t, g, unknown or other
  misc_feature (529)..(529): n is a, c, g, or t
tcagtgtactactccacgaccggtgctcgatttagcacacgatagttgggtttgggggcgtccttcaccacccagctgggatctcagggcttccttttctgtcctcctccaggactggggtcaaccgccatcctcaccctcctcctggctgttctccaaggngtctgtgcgaagtgcagctggtncagtccggagcagaggtgaaaacgcccggggagtctctgagatctcctgtaaggttcngatactaggttttccagctactggatacacgtggtgcgcagacgaccgaagcagganggagtggggagattgatccgagtacgactcgtacaacataccgaactacgtacgtcccgtactttaccgaacgtcccgacgttaccaacactctcgagtcctaggaactaacgttacctagtacctaacgttaccgacgttccctttacctaggtacgaacggttcggcgtacgcgtacccgtgggacggcccgttacgaccaccggtctaaagttactaactttacgngttacgacggttaccggttaccgttacgtcgtaccgacgtaagtacgttaccgaaagttacttaaaccgttaacgtaccggttaacgttggtaaccgttcccgggtaacggggacccggtaaacgggtaaccccgg

SEQ ID NO: 251217 - DNA, 836 bp, Homo sapiens
  misc_feature: GYAE6OF01BU0GZ.16.35.D02.1.454.CMB.1.raw
  modified_base (572)..(572): a, c, t, g, unknown or other
  misc_feature (572)..(572): n is a, c, g, or t
tcagtgtactactccacgaccggtgctcgatttagcacacgatagttgggtttggggctccttcaccacccagctgggatctcagggctttccttttctgtcctcctccaggagtggggtcaaccgccatcctcaccctcctcctggcttgttctccgaaggagtctgtcgccgaagtgcgagcgtggtcgcgacggtccggagacgaggagggtaaggaaaacggcccggggtatcgtcgtaggacggtacttccgtacgttagggttaacggttcgaggtacttacggttacggtttaccagtactacgtcggtatccgtacggtggtcgaccgtacgaacggtaaccggtaccggtaaggccggtagggtacggtggggaggtagggggacggtattacggacgtccgtagtacgtaccgtactacaacgtactacctaaaccgtccgaaccgttaccccgtacgttaccgaaccgtacccgtaacgacctacctaactcaccgtactacgtacgaacgtaccgttactaagtcccgttaacgtaccttcccggtacccttcgggtacncgggttacggtccggaaccgtcgggaaccggtccggaacgggttacccccggaccgacccggtaactaccggaactttaacgttaccggttaacgtcggttacgggtaccgtacggttaccccgtttcggggtacctacccgacggttacgaaccgtttacccgaaccttaaccgtttaccgtaaaccggtttcgggtaaccgttcccgggtacggttaacgggaccgggttacccggggaaaccgtccccggggttaaacccg

SEQ ID NO: 251218 - DNA, 671 bp, Homo sapiens
  misc_feature: GYAE6OF01A69VD.16.35.D02.1.454.CMB.1.raw
  modified_base (296)..(296): a, c, t, g, unknown or other
  misc_feature (296)..(296): n is a, c, g, or t
  modified_base (577)..(577): a, c, t, g, unknown or other
  misc_feature (577)..(577): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacggcccggggatctcgtagaggatcctcgtggttaagggttctggtatactaggttttccagtactacgtggactcgtaccgtgggtcnccgccgtaagaaccggtaccggtaaaggccgtagggagtagggtaggtagggggacggtagttcggaaccttcccggagtctaccgtctacgactactaccaactacaccggtcccttaccttaccgaacgcctacgtaccaccactcacagcctagaccacgtccatacgtagtactcgtcccttacgagacgtggtcggcgacgtacggtccgcggtaccgcccgtacgaccgaccgctaattacgtacttacgtcgagtccgttacggttaccgttancccggcgtacgactacgtacctaacgtaccgttaaccgacggttaccggtcgttacgggaccgttaccggtccgggaaccgacccgggtacccg

SEQ ID NO: 251219 - DNA, 813 bp, Homo sapiens
  misc_feature: GYAE6OF01EXXG3.16.35.D02.1.454.CMB.1.raw
  modified_base (161)..(161): a, c, t, g, unknown or other
  misc_feature (161)..(161): n is a, c, g, or t
tcagtgtactactccacgaccggtgctcgatttagcacacgatagttgggtttggggctccttcaccacccagctgggatctcagggctttccttttctgtcctcctccaggatggggtcaaccgccatcctcaccctcctcctggcttgttctccaaggngtctgtgccgaagtgcagtcgtggtgcaggtccggagcaggtagggtaaggaaaacggcccggggtatcgtcgtggacggtattcctcgttaggttacgggttctaggtacttacgttcggttttccagtcttacgtggtactccgtacggttgggcgccggtaccgaagaaccggaaccgggtaaacggtccggtagggtaggtacggtagggtagggggtacggtgttaccggacctacccggtagtcgtacctctaccactaactacgtaaccgtaccgtacccgtccccgttaccgttaaccgaacgtcccgtaacctaccacctcgttacctcgtacgtacgtacaacgtactctaacgtcgtaaccgttaccttacgtcccttacggtgtacgaggtccggacgtcgaccggccggtaccggaccggtcccgtacgacccgtaccgacttaacgttacgttaacgttccgggtacgttacgggtaaccggttacccgttaccgggtttaccggacccgttacccggtacgtaaacgtaccgttaacccgtaaccttaaccggttaacccgttaaccggttaccgggtcgtaacggggttaccggtacccggggtaaccggggcccggttaaacggggtacccccgg

SEQ ID NO: 251220 - DNA, 689 bp, Homo sapiens
  misc_feature: GYAE6OF01DDX8Q.16.35.D02.1.454.CMB.1.raw
  modified_base (157)..(157): a, c, t, g, unknown or other
  misc_feature (157)..(157): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctcaggngtctgtgccgaagtgcagctggtgcaggtccggagacgaggaggtacgaaaacggcccggggatcctcgtggaggattcctacgttaggttaacgggttctaggtactacgtacggttttccagtctacgtggactcgtacgtggcgacgaccgaaggaccggtaccggtaacggccggtaggtaggtagggtagggtggggtagtacgttacggtaccgtccgtaggtcgtactcgtacactactaccgaactccgaccgtcccgttacgtaccgaacgtcctacgtacctaccgtctcaccgacgtacgtacgaactacgtaccgtacgtacgtacgttaccgtcgttccttcgtgtacgtacggtccgtacgcgtacggtccggcggtccgccggtaccgaccgacctcttaacgttacgttacgttcgtaggtcgtaccggtacgttcggtcgtccggcacgtagtactacgtacctacgttacgtacggtacgtcgtacggtacggtacgggaccggcgtaccggcg

SEQ ID NO: 251221 - DNA, 1009 bp, Homo sapiens
  misc_feature: GYAE6OF01EPDQF.16.35.D02.1.454.CMB.1.raw
  modified_base (158)..(158): a, c, t, g, unknown or other
  misc_feature (158)..(158): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctctcctggctgttctccaaggngtctgtgccgaagtgcagctggtagcgagtcccggagcgaagagggtagaaaaacggcccggggagttctacgtagaaggtattccgtccgttagggttaaacgggtttccgtaggtacgttaacgttacggtttttacccgaggtaccttaacgtggacttaccgtaccgttaggggttcaccgtaccgaacggaaaccggtacccgggttaaaacggccgtaggtacgggtaggtaaggtaggggggaacggtacttacggaccgtacccgaggttaccgacttcacgaaactattaaccgaaacgttaccgaccggttaccccttaccgttaaccggaaacccggtcccttaaccgtacccgtaaacctacccggttaactccgggtaaacgtcccgtttaaacggaaacccgtaaaccgggttacccctaacgttaacccgtaaacggttttacccctttaccggttaccccctttacccgttaacgggtacccttaacgggggtaccggacccggtaaccggtaaaccgggttcccggtaaaccggggtaccgggttaccccgaacccgggggtaacccctaacccccgggtaaaccctaagttttaaaccttacggttttaaaccgggttccggtttacgggaaccgttaacccggggttttacccgggtaccttaacccgggttacccgtaccggtaaaaccgtttacccgtaacccggtttaacccctttaaaacgtacccccggttttaaaacccgggtcggtttccgggttaacccggggttaaccggtttaacccgggaacccggggttaaacccgggggaaaaacccggttcccccggg

SEQ ID NO: 251222 - DNA, 849 bp, Homo sapiens
  misc_feature: GYAE6OF01A91IU.16.35.D02.1.454.CMB.1.raw
  modified_base (606)..(606): a, c, t, g, unknown or other
  misc_feature (606)..(606): n is a, c, g, or t
tcagtgtactactccacgaccggtgctcgatttagcacacgatagttgggtttggggctccttcaccacccagctgggatctcgagggctttccttttctgtcctcctccaggagtggggtaccaacccgccactccctccacccctcctcctggcttcgttcctaccgaaggtcgttctggtcgaccgaagtcgcagcgtggtgacgtacggtccggagcgaagggtaagggtaaacggaaaaaccggggtccggggtattccgttcgtaggaacggtacttccgttaccggttaagggttaacgggttcgtaacggtacttaaccggtttacggtttaccacgtcgttacgtgactaccgtccggtgggtccgaccgacgtaacggaaccggtaccggtaacggccggtagggaggtagggagggtagggtacggttagttcgaccgtccgtagtcgtacctcgtaccacttacctactaaccgtaccgtacccggtccctaccgtaccggacgaccctacgacctaccgtactaccgtacgacacgtacgacctacgtcacgtactacgttcctcttaccgttcgacgacgtcgggtccgacncggtaccggtcgggccgacccggtccgaacccgtacccggaactcgtaacgtttaacttacccggtgggttaccggtaccggttaccgttaaccgggttccgtaccggtcccggaacgttaccgaaacgttcccgttaaacgtacccgttaaaccccgttaggttacccccgggtcggttaaccgtcccggggtacggttaccggggaacccgggttaaccccgggtaaacccggttccccgg

SEQ ID NO: 251223 - DNA, 1032 bp, Homo sapiens
  misc_feature: GYAE6OF01AG7PW.16.35.D02.1.454.CMB.1.raw
tcagtgtactactccacgaccggtgctcgatttagcacacgatagttgggtttgggctccttcaccacccagctgggatctcagggcttcctttttctcgtcctcctccaggagtggggtccaaccgccactccctccaccctccgtcctggctgttctaccgaagggtacgtctgtgaccgaagtcgcagtcgtggtcgcgacggtccggagacgaggtaacgggtaacggaaaaaccggccggggattcgtacgtaggtacggacttccgttaccgttagggttacgggttctaggtacttacgttacggtttaccagtcgtacggtgtactaccgtcggttgggtaccgccgtaccggaacggtaacccggtaaccgggtaacggtcggtaggtaggtagggaacggggttggggtaagttcgttaccggaccgtaccgtacggttaccacttccgacctaactaaccgtaaaccgtaaacccgaccggttaccccgttaccccggtttaaccccgttaaccggggtaaaccccggacccgttaacccggtacccttaaaccgtccgttaccgtaaccggtaccggtacccgtaaaccggtaaccttaaacccgtcctaacccgtttaccggtaacccgtttccccggtttaacccctttacccggttacccgggttacgtaaccgggtaccggggacccggttacccggacccggtacccggggtttacccgggttacccgggaacccgggttcccccgggtaacccggtaaccccgtacccggggttaaccttttaactttacccgggttttaaacgtttaccggggtaccgggttaccccggttaacgggttacccgggtttacccgggttacccggaccggtaccggtaaacgtacccgtaaccctttacccggttaaaccgttaaccccgtttacgggtaacccgtttccgggaccgggttttcccgggaaccggggtttaccccggggaacccgggttaccgggtaaacccggtacccccggg

SEQ ID NO: 251224 - DNA, 739 bp, Homo sapiens
  misc_feature: GYAE6OF01DML4K.16.35.D02.1.454.CMB.1.raw
  modified_base (159)..(159): a, c, t, g, unknown or other
  misc_feature (159)..(159): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtgccgaagtgcagcgtggtgcaggtccggagcaaggaggtagaaaaacggcccggggagtctcgtaggaggacttctaccgttaggttaacgggttctagggtattaccgtaggttttccagtctacgtggactccgtaccgtgggtcgacggtaccaaggaaccggaccggtaaaggccgtaggaggtgggaggtcggggtaaggtattcggtactcccgagtcgtacctctacgactataccaaactaccgtaccgtccccgttaccttaccggaaccggtccctaaccgtccgaaccctactaccgtacgacgtcctacggaactaacgttccaatacgtactaccgtcgtccttcgagtctaggtcggaccgcgacgtcccggtggacccgtcccgtacggaccctacccgtaccgtaattcgttacgttacgtcggtacgtcggttaaccgttccggttaacgccccgtcggaccaggtacctaccaaccgttaccctaacgttaccgttacccgggtacgttcgggtacgttaccggggtacggggaacccggtaccggtaaccccggg

SEQ ID NO: 251225 - DNA, 1018 bp, Homo sapiens
  misc_feature: GYAE6OF01EXIFR.16.35.D02.1.454.CMB.1.raw
  modified_base (572)..(572): a, c, t, g, unknown or other
  misc_feature (572)..(572): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctctcctggctgttctccaggagtctgtgccgaagtgcagctggtgcagtccggagcagaggtaggaaaaacgcccggggtagtctctgaggatccgtctggtaacgggttctagggtattacgtacggtttccgagtcgtacgtgggtactcgtaacccggtttggggtcgacccgacccgaaggtaaaccggtacccggggtaaaaggtccccggttagggtaaggttcggggtaagggttacggggggtaagggttacgtttaacgggtaaccttaccccggttaagggttaccggtaaccctttaccgtacctaactaacgtttaccaaaaccctttaaccggaccggttacccccgtttacccgttaaccccggaaaccgggtccccgtaacccggtaccctaacccgtaacgttcctacccgggtaaaccnccggttaaccgacgtaaacccgtaccgttaactaccgtaacggtttaacccgtccgttaccccgtttaaccttcgggtaaccgttaacggtcgggacccgttacggaccgggtacccgggtacgggtaacccgggtacccggttacccgggaaaccccgaaccccgggtaaccccttaaacgggtttaaaccggttaaccccgtttaagggttaccgggttaacggggttaccccgggtaaccggggttttacccccggggtttaaccgtttaaccccgggggaccccgttaacccggtaacgttaacccggtacccgtttaaacccgtaaacccgtttaaaccccggtttacccggtaaacccggggtttacccggtaacggggttaccccgggttaacccggttaccggggggttaacccccggaaaacgggggttcccccggg

SEQ ID NO: 251226 - DNA, 819 bp, Homo sapiens
  misc_feature: GYAE6OF01C9PPP.16.35.D02.1.454.CMB.1.raw
  modified_base (159)..(159): a, c, t, g, unknown or other
  misc_feature (159)..(159): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtcgaccgaagtgcagtcgtggtgacacggtccggagcaggaggtacggaaaacggccggggatctcgtggagtatctccgtaggtaacggttcaggtatacgttacggtttacagtactacgtgacttaccgacgttgggtcgaccgtaccgaacggtaaccgggtaacccggtaaaggtccgtagggtaggtcgggtaaggggtcgggggagttaacgttcggaccgtcccgtagtccgtaccgttacacctaacgtaactaccgtaaacccgttacgacccgttaccccgtttcccgtaaacccgaacggtacccctaccggttaacccaacccgtacgttaccgtaaccggtacgtccgtaacccggtaaacgtaaaccgttaccccttaagtaacccggttaccgttacctttccggttaccccgtttccggtagtaccgggtacgtccgggaccgacgtaccggtcccgtaacgggcccgttacccggtaacccgacctacccgtactaatttacgttaccgtacgggtcgtaccggaaccgttggttccgtacggcctaccggataccgtacgtaccgtaaccttagttacccgtacgtttcgacggtaccggttacgttgggaacccggacggtacccggtaacccgg

SEQ ID NO: 251227 - DNA, 671 bp, Homo sapiens
  misc_feature: GYAE6OF01B7B3Y.16.35.D02.1.454.CMB.1.raw
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
  modified_base (502)..(502): a, c, t, g, unknown or other
  misc_feature (502)..(502): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcgaggaggtagaaaaacggcccggggatctcgtgagtatctccgtggtaaggttctggagtacgtacggttttccagtactacgtgactcgtacgtggtcgaccgaccgaaggaaccggtaccgggtaaacggccggtaggaggtagggaggtagggggaggtacgttagacttacccgngtacgacttacncaacactaccgtaacctaccgcccgtacccgttacccgttaccgaaccggtccacctaccaacctactctcgacgtacctacgactaacgtccatccgtacgtacttcgtccttacncgacgtagcggacgcgacgtcgtacggacgtccgtaccggaccgaccgtctaagttacgttactttacggtcgtacggtacgtacggttaccgtcgtccgcgacgtagacttaccgataacctactaccgtagtcgtacggtcgtaccgggacggaccgacggtaccgg

SEQ ID NO: 251228 - DNA, 801 bp, Homo sapiens
  misc_feature: GYAE6OF01APRXF.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtcgaccgaagtgcagcgtggtgcgaggtcccggagcgaggtacgggtaacggaaaaacggccccgggggatccgtcgtaggaggtacttccgtaccgttaggttaacgggttctagggtaacttaccggttacgggttttccaggtccgtacgttacggactccgtaccggttggggtccacccgacgaacgggtaaccggtaacccggggtaacgtccggagggtacgggttcgggaacgggtaggggggtaagtacgttcgacccgttaccggtagtccgtacctacgtctaactacaccgtaacctaccggtcccggtaccccgttacctaaccggaccgacccgtacgtccaaccgtctacgtaccgagtaccgagtacctaaccgtccacgtccgtatccgtcgtaccctcgtagcgtaggtccgactcggtacccggcggacgggtacccggtccgtaccggacctaccggaccttaattacggttaccgttacggtccggtggttacccggtaacgtttccgggtaccgtaccggcgtaaggcctaacgtcccgtacgttaaccgtccgttacccgtgttaccgggtaccggacgtaccgggaccgtaacccggggtaagtacccccggg

SEQ ID NO: 251229 - DNA, 810 bp, Homo sapiens
  misc_feature: GYAE6OF01EMMJI.16.35.D02.1.454.CMB.1.raw
  modified_base (184)..(184): a, c, t, g, unknown or other
  misc_feature (184)..(184): n is a, c, g, or t
tcagtgtactactccacgaccggtgctcgatttagcacacgatagttgggtttggggctccttcaccacccagctgggatctcgagggcttccttttctgtcctcctccaggatgggtcaaccgccatcctccaccctcctcctgctgttctcaaggatctgtgccgaagtgcagctggtgcgngtccggagcgagaggtaagaaaaacggcccggggtatctcgtaggaggtacttccttaccgtggttaaaggtttcgtggtaattaccggttacgggttttaccaagtcgttaacgtggtaactccgttaaccggtcgggtccgaccggaccggtaaacggtaacccggtaacccggggtaaacggccggttaggggacggttaggggagggtagggggaaggttacgttacggtacccgtaccgtaaggtaccgtaccttacctactacctaacgtaacctaaaccgtacccgtaaccggttcccccgttaccctaaccggacggtaccctaccgacctacctaccgttacctacgacgtaccgtaagaacctaccgtacctactacgtaccgttaccgtcgtcccttaccggtcgacgtacgtacgggaccgtcgtaccggtccggaacggtccggtacccgtaccggaacccacccgtaactaacgtttaactactttaccggtggttaaccgtcggttaccggttccgtaacggttcccggactacggaactccgtaaccttacttaccgtacgtaccggtacgttcgtcggtacgtaggtccggacgggtaccgtacccggg

SEQ ID NO: 251230 - DNA, 804 bp, Homo sapiens
  misc_feature: GYAE6OF01A4TRL.16.35.D02.1.454.CMB.1.raw
  modified_base (199)..(199): a, c, t, g, unknown or other
  misc_feature (199)..(199): n is a, c, g, or t
tcagtgtactactccacgaccggtgctcgatttagcacacgatagttgggtttgggctccttcaccacccagctggatctcagggcttccttttctgtcctcctccaggatggggtcaaccgccatcctcaccctcctcctggctgttctccgaaggagtctgtggccgaagtgcgagcgtggtgcgaggtccggaganaaggaagggtaaggaaaaacggcccggggtatctcgtagaggacttcgtcgtaggttacggtgtacgacgttacgttacgttccgagtaccgtagtacgtctcgtacggttcgggcgccgtaaccgaacggtaaccggtaccggtaacggtcggtaggacgggtgtaacgggtgggaagtcgtagaccgtcgtagtacgtctaccgtacgacctcgtaacctaacgtaccacccggttccctaaccgtaccgaacggcctaaccgtaccaactaccgttgaccgtacgactaacgaacgtacctaccaacgtcttaacgtccgttaccgttccctcgtcgacggttacggcgacccgtaccgtcgggtaacgtcccgggtaacggtccctaccgggtaacccctaccgtaacgttaacgttaacgttaccgttaggttacggtccggttaaccggttacggttcccgtaacggttcccgacgtaccggtaacgtacccgttaacgttaacccgtaacccggttaccggttaaccggttccgttacgggttaacccggttacgggtacccgggtaacgggtaacccgggacccggttaaacccggg

SEQ ID NO: 251231 - DNA, 788 bp, Homo sapiens
  misc_feature: GYAE6OF01C8NYB.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggatctgtgccgaagtgcagctggtgcagtccggagcaggaggtacgaaaaacggcccggggatctctggaggatctcgttaggttaagggttctaggactacgtgttttaccagtctagtcggatccgaccgtgggtcgcgacccgaaggtaaccggaaccggttaaacggccgttaggaggttagggaaggttcgggggggaattaggttacgtacgtacccgtaggtacggaacttcctactaactaacgtacctaaacgttacccgacggttccccctttaccgtaacccggtaaaccggtaccccacggttaacccaaccgtaacttcccgttacgacgttacctacggaaccttaacgtacccgttaacaccggttaaacttcccgtaaccgttcccgttaccgttacggccgtaacgggtccggaccggttccgaaccggtccggttaacgggccggttaccccgtaacggaacccctaccggtaactacgttaacttacgtttacgtcgggttaaccggcgttaccgggtttacccgtagtcccggtcgacgtacacgtacctaccttaacgtacccgttacgttcgtacgttcgacggttcggaaccggcggaaggtaccccg

SEQ ID NO: 251232 - DNA, 1012 bp, Homo sapiens
  misc_feature: GYAE6OF01BJLI7.16.35.D02.1.454.CMB.1.raw
tcagtgtactactccacgaccggtgctcgatttagcacacgatagttgggtttggggctccttcaccacccagctgggatctcgagggtctttccttttctcgtcctcctccgaggagtcggggtaccaaccgccactccctccaccctcctccgtggtcttcgttcctaccgaaggtacgttccgtcggtacggaccggtaaggtcgacacggtcgtgggtcgaccgacgggtccggagacgaagggtacggtaacggaaaaccgggtccggggtattcgtacgtaggaacggtacttccgttacggttagggttaacgggttccgtaggtaacgttaccgttaccggtttaccgacggtaccgttacggtacgtacctaccggtacggttgggtacgaccggacgtaaccgggtaacccggtaaccggggtaacgggtaccggtagggggtaacgggtaggggaaggggtagggggtaggttacgttaccggaccgtacccggtagtaccgtacctacctactaacgtacgtaacccgtaaaccgtaccggtaccccgttaccccgttaccgtaaccggaacccggtaccctaacccgtaccctaaccgtacctccgtaacgtacgtaaccgaaccggtaaccgtaaccgtaccgaaccgttaccgttaaccgttaccgttcccgttaccccgttacggtacggtacgggtacgggtaccggaccgttacccgggtcgggtacccggtacggggtaccccggtaccccggtaacccggaaccccggtaacccgttaactttaacggtttaacttacccgggttaacggtccgggtaccggttaacccgggttaccggtttaccggtaccggtacccggtaccgttaccgtaaaccttacccgttaaccgttaacccgttaacgttaacccgtaaccgggttaccggtccggtaaccgggttaccgggtaccggggtaaccccggaaacccgggttaccggtaacccccgg

SEQ ID NO: 251233 - DNA, 927 bp, Homo sapiens
  misc_feature: GYAE6OF01ENEUZ.16.35.D02.1.454.CMB.1.raw
  modified_base (158)..(158): a, c, t, g, unknown or other
  misc_feature (158)..(158): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctctcctggctgttctccaaggntctggtgccgtaagtgcagcgtgggtgcgtaggtccggagtcgaggtaaggtagaaaaacgggcccggggtagtcgtcgtaggaggtacttccgtcgttaggttaacgggttcgtacggtaattaccgttacggttttccgagtacttacgtacggtacttaccgtaccggtcgggtaccggaccggtaccggtaacgggtaaccgggtaacccgggtaacgggtcggtaggggtaggttacggggtacggggtggggtaacggttagttaccggtaccgttaccggtacggtaccgtaccgttaccgtaaccgtaacgttaaccgtaaaccgtaacgtacccggtacccggttacccccgtttaccgtaacccggaaccggtacccgtaaccgtacccgtaacgtaccgtaccgtacgtaccgtcgtaaccgtaaccgtaaccgtaccgttaccgttaccgttaacgttaccgtccgttacccgttcggacggtacgtacggtcggaccgtaccgggttaccggtaccgggtacggacccgggtacccgtacccggtaacccgtaccgttaacgttaacgttaaccgttacgttacgggttcggttaccgtaccggttaccggtttaccggtacgtccgtaccggtacgtaccgttaccgttaaccgttaccgttaaccgtttacccgggttaccggttacggttacccgggtacggttacccgggttaccggggtaccccgggttaacccggtaacccggtaccccg

SEQ ID NO: 251234 - DNA, 739 bp, Homo sapiens
  misc_feature: GYAE6OF01EZ7Y2.16.35.D02.1.454.CMB.1.raw
tcagtgtactactccacgaccggtgctcgatttagcacacgatagttgggtttggggctccttcaccacccagctgggatctcagggctttccttttctgtcctcctccaggatggggtcaaccgccatcctcaccctcctcctggctgttctccaaggagtctgtgccgaagtgcagctggtgcaggtccggagcagaggtagaaaaaggcccggggagtctctgaggactcttccgttaggtaagggttctggtatacgtgttttccagtctacgtggactcgaccgtggtcgcgccgagaacgcccggtaaaggcctaggacgtggaggtggggtaaggtgttgacgttcccgtaggtcgaccttcgtacacgactacgtaaacctaccgtacccgtcccggtttacccttaccgaaccggccctaccgtaccaacccgtactcctacgaacgtccgtagaacctaacgttccatacgtacgttacccgtcttccccgttcctggtaccgtacgggtcgtacccggacgtccggtccggtacgggtaccggtacccgtaccggacccggaaccgtactaacgttaacttaccggttagttcggtacggttcgtacggtttaccggttcgtaccggtccgtataccgttagttaccgtacttaacctaccgtttaccgtcgggttaccgtacgggttaccggtacccgggccggggcccgtaaacgggttaccccgg

SEQ ID NO: 251235 - DNA, 827 bp, Homo sapiens
  misc_feature: GYAE6OF01AWLQW.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcgaggaggtagaaaaacgcccggggagtcgtcgtgaggtactctccgtaggttaagggttctggacttacgtacggttttccagtctacgtggtactctaccgtgggtcgccgtccgaacgaaccggtacccgggtaaacggccgtagggtacggtgggtaaggtcggggggtagtaagttcggaccgttcccgagtacggtacctcgtaccactacgtacaaacctacgtaaccgtccccgttaccgttacccgaacggtacccctaccgtaaccacctactcctacgtaccgtacgttacgaaaccgtaccgtccgtaacttaccggttacgttaaccgttaccggtccccgtttaccgtacgaccggttaggtccggacccggtaaccgtaccggtaccggtacggggttaacccgcccggttaaccgggtaacccacccggtaacttaaccgttaacgtttaacgtttaaccgggttcggtacggttaccgttccgggttaccgttaccggtacccggtaccgtcgtaacgtacgttaccctaacccgttaaccttaaccggttacccgttaggtcccgggttacgaccggttacgggtaacccgggacccggttaacggtaaccccggg

SEQ ID NO: 251236 - DNA, 754 bp, Homo sapiens
  misc_feature: GYAE6OF01BDWDV.16.35.D02.1.454.CMB.1.raw
  modified_base (158)..(158): a, c, t, g, unknown or other
  misc_feature (158)..(158): n is a, c, g, or t
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctcaaggngtctgtgccgaagtgcagcgtggtgcaggtccggagcgaggaggtagaaaacggccgggatctcgtgagntctcgtgtaggtntgtatacgtcgttcngtctagngtatcgacgtggtcgcgacgagaaccggaccggtaacggtccgtaggaggtagggtacgggtaggggaggtagtacgtaccgtaccgtagtcgaccttaccgtctaactaacgtacctaaacgtaccgtaccgttaccccgttacccgttaaccggaacccgtaccctaaccggtaccaaccgttacgtacctaccgtaacgtcctaacggaaccgtaaccgtacctaacgtaccgtaacgttacccttaccgttcccgttaccgacggtacgtacgggtcggtaccggtacggtccggtacggtaccgggtaccggtccgttacccggacccgtacccgtacgtaacgttacgttaccgttaccggtacgttaccggtacgttacccgggttaccggtaacgtcccgtaccgaccgtaacgtacgtacctaaccgttacttacgtaccgttcgtcgtacgtcggtacggccgggtaccgccgggtacccg

SEQ ID NO: 251237 - DNA, 531 bp, Homo sapiens
  misc_feature: GYAE6OF02IZGOS.16.35.D02.1.454.CMB.1.raw
  modified_base (420)..(420): a, c, t, g, unknown or other
  misc_feature (420)..(420): n is a, c, g, or t
  modified_base (456)..(456): a, c, t, g, unknown or other
  misc_feature (456)..(456): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagccccggtaaaggcctggagtggatggggaggattgatcccagtgactctcacatcaactacagcccgtccttccaaggccacgtcaccatctcagctgacaagtccatcagtactgccttcctgcagtggcncagcctggacggcctcggacaccgccatatattacngtcgcgagtccggttancgccgnagactcactactactactacggtctggaccgttcgtcgggaccaagggaccc

SEQ ID NO: 251238 - DNA, 545 bp, Homo sapiens
  misc_feature: GYAE6OF02HNTP6.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagccccggtaaaggcctggagtggatgggggaggattgatcccagtgactctcacatcaactacacgcccgtccttccaaggccacgtcaccatctcagctgacaagtccatcagtactgccttctgcaggtcggcgcagccgtggacggcctcggacacccgcatatattactgtcgcgtagttccggttatccgccgcagtactcacttactacctacgtacggtctgggaccgttcgtcggggcccaagggacccg

SEQ ID NO: 251239 - DNA, 527 bp, Homo sapiens
  misc_feature: GYAE6OF02IYPKW.16.35.D02.1.454.CMB.1.raw
  modified_base (411)..(412): a, c, t, g, unknown or other
  misc_feature (411)..(412): n is a, c, g, or t
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
  modified_base (469)..(469): a, c, t, g, unknown or other
  misc_feature (469)..(469): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggtttccagctactggatcactgggtgcgccagaagccccggtaaaggcctggagtggatgggggaggattggatcccagtgactctcacatcaactacagcccgtcttccaaggcccacgtcaaccatctcagctgacagtccatcagtactgcccttcnncagtgcncagctggacgcctcggaccnccgcatatatactgtcgcgtagtccgttancgccgcagactcactactactacgtcggtctggacgtcgtcggggtccagggtacccg

SEQ ID NO: 251240 - DNA, 640 bp, Homo sapiens
  misc_feature: GYAE6OF02JAJGT.16.35.D02.1.454.CMB.1.raw
  modified_base (525)..(525): a, c, t, g, unknown or other
  misc_feature (525)..(525): n is a, c, g, or t
tcagtgtactactccacgaccggtgctcgatttagcacacgatagttgggtttggggctccttcaccacccagctgggatctcagggcttccttttctgtcctcctccaggatgggggtcaaccgccatcctcaccctcctcctggctgttctccaaggagtctgtgccgaagtgcagctggtgcagtccggagcaggaggtagaaaaaggcccggggagtctctgaggatctcctgtaagggttctggatactaggttttccagctactggatcacctgggtgcgccagaacgcccggtaaaggccgtggagtggagtgggggaggattgactcccgagtgactctacacatcaactacacgcccgtccttaccaaggccacgtccaccatctcagctcgaacacgtccatcaagtacctcgtccttcctgcagtcggccgccagcccgtagggacggtcccgtcgggaccacccggcctaattacttacgttactggtcgaccggttcggttacccggtttancccgtaccgacctaaggtactaccgtaaccttacctaacctttaccgttaacccgggttcgttacgggttacccggttcggtacccgggggtaccgaaccgggggtaacccccgg

SEQ ID NO: 251241 - DNA, 822 bp, Homo sapiens
  misc_feature: GYAE6OF02I4X9Q.16.35.D02.1.454.CMB.1.raw
tcagtgtactactccacgaccggtgctcgatttagcacacgatagttgggtttgggggcgtccttcaccacccagcctgggatctcagggcttccttttctgtcctcctccaggatggggtcaaccgccatcctcaccctcctcctggctgttctccaaggagtctgtgccgaagtgcagctggtgcagtccggagccagagggtagaaaacggcccggggagtctctggaggatctccgtaggtaagggttctaggatacgtaggtttccagctactggatcaccgtgggtgcgccaagaacggcccggtaaaggcctagggagtgggagtgggggaggagttgactcccgagtcgactcgtacactactacaactaccacgtccccgttccttaccgaacgggtcccaccggtaccaaccctaattcctacgaccggtcttacggaaaccgtaaccggtaccctaacgttaccctaacgggtttaccctccggttacccccgtttcctaccggtacgttaaccggggttcggcccggtaaccacgggttcccgtagggggtaacccgggttccccttacccggggaaacccgtaccccgggtaccctaaagtttaaacccgtttagttttaacccgttaagggttcccggggaaaccgggttacgggtttaccccgggttttaacgcccggttcccggaccgtacggaacccttcgtaaacctttaccgttaaccgttaacccgtaccgggtttaacggtcccgggttaacggtttcccgggtaacggggggttacccgaaacccgggggttaaccccgg

SEQ ID NO: 251242 - DNA, 545 bp, Homo sapiens
  misc_feature: GYAE6OF02H25P1.16.35.D02.1.454.CMB.1.raw
  modified_base (279)..(279): a, c, t, g, unknown or other
  misc_feature (279)..(279): n is a, c, g, or t
  modified_base (407)..(407): a, c, t, g, unknown or other
  misc_feature (407)..(407): n is a, c, g, or t
  modified_base (435)..(435): a, c, t, g, unknown or other
  misc_feature (435)..(435): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtncgccagaagcccggtaaaggcctggagtggatggggagattgatccagtgactctcacatcaactacagcccgtccttccaaggccacgtcaccatctcagctgacaagtccatcagtactgccttcngcagtggcgcagcctggcgcctggaccnccgcatatattctgtcgcgtacggttccggttatccgccgcagtactccacttaacctacttaaccgtacggttctcgggaccgttggcggggtacccaagggtaccccg

SEQ ID NO: 251243 - DNA, 526 bp, Homo sapiens
  misc_feature: GYAE6OF02FQDOC.16.35.D02.1.454.CMB.1.raw
  modified_base (411)..(411): a, c, t, g, unknown or other
  misc_feature (411)..(411): n is a, c, g, or t
  modified_base (453)..(453): a, c, t, g, unknown or other
  misc_feature (453)..(453): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagccccggtaaaggcctggagtggatgggggaggattgatcccagtgactctcacatcaactacagcccgtccttccaaggcccacgtcaccatctcagctgacagtccatcagtactgccttcngcagtgcgcagcctggacgcctcggacaccgcatatattacngtcgcgagtccggttatccgcgcagactcactactactactacggtctcggactcgcggggccagggtacccg

SEQ ID NO: 251244 - DNA, 563 bp, Homo sapiens
  misc_feature: GYAE6OF02JB0IM.16.35.D02.1.454.CMB.1.raw
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
  modified_base (498)..(498): a, c, t, g, unknown or other
  misc_feature (498)..(498): n is a, c, g, or t
tcagtgtactactccacgaccggtgctcgatttagcacacgatagttgggtttgggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcaccgtgggtgcgccagaacgcccggtaaaggcctggagtgggatgggggagattgactcccgagtcgactctcgacagtcaactacacgcccgtccttccaggccacgtcaccatcncngctnacgacgtcatcngtactgccttcngctagcgcgcacgtcgtggacggtcccgcgggaccaccggacagttacttacttacgtcggtgcgtacggtccggtttanccgtccgctaggctccaacttctacgttctacggtctggtaccgtcgtcgggaccagggtacccg

SEQ ID NO: 251245 - DNA, 567 bp, Homo sapiens
  misc_feature: GYAE6OF02HWY52.16.35.D02.1.454.CMB.1.raw
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (382)..(383): a, c, t, g, unknown or other
  misc_feature (382)..(383): n is a, c, g, or t
  modified_base (386)..(386): a, c, t, g, unknown or other
  misc_feature (386)..(386): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcaccgtgggtgcgccagacgacccggtaaaggcctggagtggatggggagattgatcccagtgactctcacatacaactacacgccctcctaccacgccacgtcaccntcncnnctnacagtccatcagtacngccttcngctagtgcnacgtctggacgtcctacggaccaccgctactatagttactacgttcgacgcgttccggtacgtcgacccgtgacgtactactacctacgtaaccttaccgttacggtcctcggtaccggttaccggtcgggtaccgaccggtaacccgg

SEQ ID NO: 251246 - DNA, 595 bp, Homo sapiens
  misc_feature: GYAE6OF02FZGPH.16.35.D02.1.454.CMB.1.raw
  modified_base (314)..(314): a, c, t, g, unknown or other
  misc_feature (314)..(314): n is a, c, g, or t
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
  modified_base (408)..(408): a, c, t, g, unknown or other
  misc_feature (408)..(408): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggatctctgaggatctccgtgtaaggttctggatacgtaggttttccagctactggatcactggtgcgcagaagccggtaaagcctggagtggatggggagnttgatccagtgactctnacatcaactanacgccgtctcagtccacgtcacactctcagctagaactacgtcctataccagtactcgacctttcncgccagtcggcncgacnccggtaggcgtcctcgggaccctaccggcctaagtaacttacgttaacgtggtcgtacgtacgttaccgggtaatcccgtacgccgtaggtacctccgtaacttaaccgtaccttaacggtaccgtccgttacggtacccgttagccggggtaaccgacggtaaccccgg

SEQ ID NO: 251247 - DNA, 718 bp, Homo sapiens
  misc_feature: GYAE6OF02HX5EK.16.35.D02.1.454.CMB.1.raw
  modified_base (480)..(480): a, c, t, g, unknown or other
  misc_feature (480)..(480): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctctgtaaggttctggatactaggttttccagctactggatcaccgtgggtcgcgccaagaacgcccggtaaaggccgtggagtgggagtgggggaggagttgacgtcccgagttcgacttcgtcaactatacaactacgacgtccccgttccttacccgaacggacccacggtccaaccgtactacctcaagtccttacggaacctaacggtccctaagtacgtaacgttaccgttcggtccccttttccgngtaccgtacggttcgggccgccgaaccggtcccgtttagggggacccggtcccgttaccgggaaccccaacccggtacccgtaagtttaaccttaacgttttaccgtcggttacggaccggttaaccgggttccggtttaacgtcccggcccgtagacggtactccgtaaccttactaccgtttaccggaccggttcgtacgggacccgttcggacgggtaccgtaacggggtacccg

SEQ ID NO: 251248 - DNA, 538 bp, Homo sapiens
  misc_feature: GYAE6OF02I266X.16.35.D02.1.454.CMB.1.raw
  modified_base (417)..(417): a, c, t, g, unknown or other
  misc_feature (417)..(417): n is a, c, g, or t
  modified_base (477)..(477): a, c, t, g, unknown or other
  misc_feature (477)..(477): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatgggggaggattgatcccagtgactctcacatcaactacagtcccgtccttcaaggccacgtcaccatctcagctgacagtcatcagtactgccttctgcagtggcncagcctgggagccctcggacaccggccagtatattctgtgcgagttccgttagtcgccgnagactcgacttactactaacgttccggtctcggacgttcgtacggggaccctagggacccg

SEQ ID NO: 251249 - DNA, 745 bp, Homo sapiens
  misc_feature: GYAE6OF02IFPYP.16.35.D02.1.454.CMB.1.raw
  modified_base (158)..(158): a, c, t, g, unknown or other
  misc_feature (158)..(158): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctcaaggntctgtgaccgaagtgcagctggtgcaggtccggagcgaaggaggtaagaaaaacggcccggggatctgtagaggactctcgtaggtaacgggttctaggacttacgtacgtttcagtctacgtggtactcgaccgttgggcgccgaccgaaggaaccggtaacccggtaaaggccgtagggtacgtaggtaggttgggggaaggttagttcgtaaccgtaccgtaggtacgtacctactacactatacctaaactacgacccgtccccgttacctacccgaacgtccgtaacctaccaacgtatccgtacaagtcaacgtacgtaactcctaactacgtattaccctcgttaccccttacgtcgacggtacgggtgcccggtacaccggtccgtacgggaccggtcccgttacggaaccccgtaccgtaactaacttaattaccgttagtcgtaccgtcgttaccggttaccgttacgtccgaccgtactacggtaccttaaccctaacttacgtaacccgtttaacgtccgggttacgtcgggtaccggttacgggaacccggggtacccggaacgggtaccccgg

SEQ ID NO: 251250 - DNA, 735 bp, Homo sapiens
  misc_feature: GYAE6OF02JYMOF.16.35.D02.1.454.CMB.1.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (420)..(420): a, c, t, g, unknown or other
  misc_feature (420)..(420): n is a, c, g, or t
tcagtgtactactccacgaccggtgctcgatttagcacacgatagttgggtttggggtcgtccttcaccacccagctgggatctcagggcttccttttctgtcctcctccaggatggggtcaaccgccatcctcaccctcctcctgctgttctccaaggagtctgtgccgaagtgcagctggtgcaggtcccggagcaggaggtagaaaaacggcccggggagtctctgagatctcctgtagggttcnggatacgtaggttttccagtctactggatcaccgtgggngcgccaggaacggcccgggtaaaggccgtagggaggtggaaggtgggggaggtattcgactcccgtaggtcgtactcgtaccaacactaccaactcaccgtcccgtccttacgaaccggcctacgtccaaccntcctcgacgtctaggaactacgtccactcgtaacgtcttaccgtcccttacgcgcgtacggtcggccgtcaacgggttccctaggggacccgtcccgtaccggaccacccgtactaagttaactttacttacgtggacgtacccggttaacggttacccggttgtaccccggacccgttagaaacggtttacctaaccgtttaaaccccttacgtttaaaacccccggttagttaaccccggggtttccgttacggggtaaccccggtttccggggtaacgggggttaaccccgaacccggggttaaccccccgg

SEQ ID NO: 251251 - DNA, 699 bp, Homo sapiens
  misc_feature: GYAE6OF02FPAN2.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatactaggttttccagctactggatcacctgggtgcgccagaacgcccggtaaaggcctggagtggagtgggggaggtagttgactcccgaggtcgactctcacatacaactacacgcccgttccttaccgaacggccacgtcacctactctacacgctacgaacaacgtccatccgaagttactcgtccctttccgtgcgtacggtcgggccgacgacggtcccggtagggaccgggtcccgttcgggacccacccggcctaacttaacttacgtttaacgttggttacggaccggttaacggttcccggtttaagccccggtacccggtacgaaccggtacttcccgtaaacccgtttaaccttaaacccgttaaccgttaccgggttaccgtacggggttacccggttaccgggtacggggggtaaccccgtaaccgggggtaacccccgg

SEQ ID NO: 251252 - DNA, 770 bp, Homo sapiens
  misc_feature: GYAE6OF02IL73J.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatactaggttttccagctactggatcacctgggtgcgccaagacgacccggtaaaggcctggacgtggagtgggggagtagtttggactcccgagtcgaccgtctacgacattacaactacacgtcccgtccttaccgaacggtccaccgtcaaccacgtctacgacgtctacggacctaacgtcccaattaccgaacgttaaccttcggtaccccttttcccgtaggtaccgtacgggtcgggcccgtacgtaaccggtcccggttacggggaccggtaccccgttacgggaaccccgtaacccggtcctaaacgttacgtttacgtttaaccgttcgggttacgtacccgggttaacgggtttacccggttttaaacgtcccggtaacccggtacggttaaacgtaccgttacccgttaacccgttaaccgtttaacccttaaccggttaaccggggtttccttacgggggttacccgtttaccggggtacggggtaaccccggtaacgggggtaacccccgg

SEQ ID NO: 251253 - DNA, 707 bp, Homo sapiens
  misc_feature: GYAE6OF02I2IT2.16.35.D02.1.454.CMB.1.raw
  modified_base (465)..(465): a, c, t, g, unknown or other
  misc_feature (465)..(465): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaaggcccggggagtctcgtgaggatctcctggtaagggttctggatacaggttttccagctacgtggatccaccgtgggtcgcgccaagaagacccggtaaaggcctggacggtggagtggggaggattggactcccgagtcgactctacacatcaactacgacgtccctccttaccgaacggcccacgtccaacctactccgtcaagtctacgaaccgtaacgtacccataccgtaacgtacctcgtacccccgttttcncggtaccgaacgggttcggaccgacccggtaccggtcccggttaggggaacccgggtcccttaacccggggaccctacccggacctaacttaacgtttaacgttacgttacgggtaccggtaccgtacggtttacccggtttaagtcccgtaccgaccgtacggtaactcctaaccgttactaacccgttacgtaaccgggttcacgggtaccgttcgggtcgggacccgtagggtaacccg

SEQ ID NO: 251254 - DNA, 858 bp, Homo sapiens
  misc_feature: GYAE6OF02JBEHM.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggagtctctgagatctcctgtaagggttctggatactaggttttccagtctactggactcaccgtgggtgcgccgaagaacggaccggtaaaggcctagggagtggagtggggaggtagttgactccgagtcgactctacacatcaactacacgtcccgtccttaccgaacgccctacgtccacctactcctacgacgtctacgaacgtaacgtccaactaccgtaacgttaccgttccggttaccccctttcccgtaggtaccgtacgggttccgggacccgtaccgtaaccgggtacccggttacgggggacccgggttccccggttaaacccggggacccctaacccccgggtaccttaaacgtttaaccgttaaccgttttaccggttacgggttaccgggtaacccgggttttaaccggggtttaccccggtttacggtaccccgggtacccggtaacccggttaaacggttaacccgtttaccccggttaaacccggtttaaacccctttaaaaccccgggttaacccggtttttaaacccgggggttcccggttaaacccggggggttaccccggtttacccggggggtaaccccggggggttaacccccgggtaaacccggggggttaaccccccgg

SEQ ID NO: 251255 - DNA, 604 bp, Homo sapiens
  misc_feature: GYAE6OF02GGY2S.16.35.D02.1.454.CMB.1.raw
  modified_base (283)..(283): a, c, t, g, unknown or other
  misc_feature (283)..(283): n is a, c, g, or t
  modified_base (426)..(426): a, c, t, g, unknown or other
  misc_feature (426)..(426): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacgtaggttttccagtctactggatcacgtggtgcnccagacgccggtaaagccgtggagtggagtggggagattgactcccgagtcgactcgacacatcaactacacgcccgtacctcgaacgccacgtcacgactctcagctagactacgtcctatcgacgtactcgtcccttccgngcgtagtcgggccacgacggtcccgtgggaccggtcccgtaccgggaccctaccggctaatacttacgtttcgtggtcgtacgtccggttcgtaactccgcgacagtctaccgtaacttaccgtaccttaaccgtcggtacgtcgggtaccgtcggaccgggaccgaacggtacccgg

SEQ ID NO: 251256 - DNA, 652 bp, Homo sapiens
  misc_feature: GYAE6OF02G3HVS.16.35.D02.1.454.CMB.1.raw
tcagtgtactactccacgaccggtgctcgatttagcacacgatagttgggtttggggctaaccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacggcccggggagtctctggaggatctcctggtaagggttctggatacgtaggttttccagtctacgtggatcaccgtgggtcgcgaccagaacggacccggtaaaggccgtagggagtggagtggggagtagttgactccgagtcgactctacactaagtctaaactacgacgtccctccttacgaacggcctacgtcaacctactcctacacgcgtacgactaacgtcctatcgaacgttactcgtcccttctgactaggtcggccgcacgtcgtcggacgtcccgtacggacctaccggcctaagttacgttacttaccgttggacgtccgtaacgtttcccggttacgtccggaccctacgacgtaactccgtaacgttacctacgtaaccgtccgggtactcgggtacgttccggtacggggacccgaagggtaccccg

SEQ ID NO: 251257 - DNA, 686 bp, Homo sapiens
  misc_feature: GYAE6OF02GXKM3.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaagcccggggagtctctgaggatctcctgttaagggttctggatactaggttttccagctactggatcaccgtgggtgcgccagaacgcccggtaaaggcctgggagtggagtgggggaggagttgactccgagtgactctcacatacaactacacgcccgtaccttccaacggccacgtcaaccatcctcacgctagaccagtccatcacgtactcgtcccttccgtgcgtacggtcggaccgccgacggtccgtcggggaccggtcccgtaccgggtacccgaaccccgtccgtaacttaacgtttaacttaccgttaggttccggacggtttaaccgggttcccggtttaaacgtccccgggtacccgcgtaacgtaccgtacctaacccgttaaccttaaccgttaaccgttaccgggtcgttacgggtaacccggtttccgggtaccgggggacccgtaaccggggtaaccccgg

SEQ ID NO: 251258 - DNA, 609 bp, Homo sapiens
  misc_feature: GYAE6OF02IAS6K.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcaccgtgggtgcgccagaacgcccggtaaaggcctggagtggagtggggagattgatcccagtgactctcacatacaactacacgcccgtccttacccgaaggcccacgtccaccatcctcacgctacgactaacgtccatcaagtcctgtcccttcctgctagtcggcgacgacggccgtgggacggcctaccgggaccacccgctaacttacgttacttacgtgtcgacgttacggttacccggttactccggccgtacaaggtactaccgaacttacctaccttaacgtaccggttctacgggtaccgttccggtcgggtacccgaaggtaccccgg

SEQ ID NO: 251259 - DNA, 612 bp, Homo sapiens
  misc_feature: GYAE6OF02JI8Y0.16.35.D02.1.454.CMB.1.raw
  modified_base (420)..(420): a, c, t, g, unknown or other
  misc_feature (420)..(420): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaacgcccggtaaaggcctgggagtggatgggggaggattgatcccgagtgactctcacatcaactacagcccgtcttccaaggccacgtcaccatctacacgctagacaacgtccatcaagtactgtcccttccngcctagtcggccgcgacgcccgtagggacggcccgttcggaccacccggacagttaatacttacgtggtacgcgtaacggttcccggttaagccggaccgtctaaggaccttaccgtaaccttaacctaaccgttaccgtaccgggttcgtacgggtacccgttcggtcgggggacccgaacgggtaccccg

SEQ ID NO: 251260 - DNA, 612 bp, Homo sapiens
  misc_feature: GYAE6OF02G564N.16.35.D02.1.454.CMB.1.raw
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (459)..(459): a, c, t, g, unknown or other
  misc_feature (459)..(459): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaaggcccggggagtctctgaggatctcctgtaagggttctggatactaggttttccagtctactggatccaccgtgggtgcgccagaacggcccggtaaaggccgtggagtggagtgggggaggattgactcccgaggtcgctctacacatcaactacacgtcccgttccttaccaacggccacgtcaaccactctccatcctagacaacgtccatcatacncgtccttcgtncaggtcgccncgacgtccgngggacgcctacgggaccaccgcctatacttacttcgtgtcgacggtacgttccggtagtccgccgcgagtactaccaacttaaccgtaacctaccggtttaccggtacgttacgggaccgttccgggacgggtacccggaacggggtccccgg

SEQ ID NO: 251261 - DNA, 647 bp, Homo sapiens
  misc_feature: GYAE6OF02I7P8X.16.35.D02.1.454.CMB.1.raw
  modified_base (342)..(342): a, c, t, g, unknown or other
  misc_feature (342)..(342): n is a, c, g, or t
  modified_base (389)..(389): a, c, t, g, unknown or other
  misc_feature (389)..(389): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggagtctctgaggactctcctggtaagggttctggatacgtaggttttccagctactggatcacctggtgcgcagaagccggtaaaggcctggagtggatggggaggagttgatcccagtgactctcanaatcgaaactacacgcccgtaccttccaaggccacgtccaacctacncttttcagtctacgaacaacgtccagtcagtactgtaccctttcgtgacgtacgtaggcgacgacgaccgtacggacggccgtaccggtaaccacccggtacctacgtaacgttactttaccgtggttacggtaccgtaggttacccggtttaacgtccggtaccgactaacgactaccgtaacgttacctaacgttaaccgttaacgtaccgttacggtaccggttcgtacggggtaccgtaaacgggtaaccccgg

SEQ ID NO: 251262 - DNA, 806 bp, Homo sapiens
  misc_feature: GYAE6OF02GJQHK.16.35.D02.1.454.CMB.1.raw
  modified_base (293)..(293): a, c, t, g, unknown or other
  misc_feature (293)..(293): n is a, c, g, or t
tcagtgtactactccacgaccggtgctcgatttagcacacgatagttgggtttggggcgtccttcaccacccagctgggatctcagggcttccttttcttgtcctcctccaggatggggtcaaccgccatcctcaccctcctcctggctgttctccaaggagtctgtgccgaagtgcagctggtgcagtccggagcaggaggtagaaaaaggcccgggagtctcgtgaggatctcctggtaacgggttcgtggaactacgtagttttccgagtcgtatggactcgacgttggngcgacgagtaacggacccggtaaaggccgtagggagttagggaggtagggggtagtacgttggaaccttcccggaggtacgaaccgtcctcgaactactacctaaacgtacgaccgtcccgttacccgtttaaccgaaccgggtccaaccggttaccaacccgtaacgttctaccgacgtctacgtaacacgtacctactactacgtacctcgttaccttccgttgaccgttagggccgggtccaccggtacgtaccgggtaccgggtaacggtccccggtaacgaccccgtacccgggtaaccctttaagtaactttaaaccggttaccgttcggtaccggaccggttaacccgggtttccggtttaaccgtccgggtacccccgtagtaacggcctttaaacccgaaccgttttacccgttaaacgtttacccggttaccggtttaccgggtcggtttaaccccgggtacgggttccccgggggaaccgggtaaacccggttaaccccggg

SEQ ID NO: 251263 - DNA, 570 bp, Homo sapiens
  misc_feature: GYAE6OF02F9F0U.16.35.D02.1.454.CMB.1.raw
  modified_base (281)..(281): a, c, t, g, unknown or other
  misc_feature (281)..(281): n is a, c, g, or t
  modified_base (341)..(341): a, c, t, g, unknown or other
  misc_feature (341)..(341): n is a, c, g, or t
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
  modified_base (487)..(487): a, c, t, g, unknown or other
  misc_feature (487)..(487): n is a, c, g, or t
  modified_base (506)..(506): a, c, t, g, unknown or other
  misc_feature (506)..(506): n is a, c, g, or t
  modified_base (539)..(539): a, c, t, g, unknown or other
  misc_feature (539)..(539): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggagtctctgaggatctcctggtaagggttctggatacaggttttccagctactggatcacctgggtncgcagacgccggtaagcctggagtggagtggggagattgactcccagtgacctctacacntacaactacacgcccgttaccttcgaacggccacgtcacnctctcagcngacacgtcatcgaactactcgtcccttcgtgactacggtcggccacgtacgccgtgggacgtcccgtacggacctaccgaccataactacttaccgngtcgacgtacgtccgttanccgcgctagactcgaacttactactacgtcgtntacggaccgtcggagggacccgaggtacccg

SEQ ID NO: 251264 - DNA, 582 bp, Homo sapiens
  misc_feature: GYAE6OF02H6N4R.16.35.D02.1.454.CMB.1.raw
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (476)..(476): a, c, t, g, unknown or other
  misc_feature (476)..(476): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaacgccggtaaaggcctggagtggagtggggaggattgatcccgagtgactctcacatcaaactacacgtcccgtccttccgaaggccacgtcaccatctcagctggacaacgtccatctagtactgtcccttctgcagtcggcncncggccgtggacggcccgtacgaccgaaccgcaatacttattacngtcgacgtacgttccggtacgtccgccgcgtagtactacaccttactaaccgttacgtaccggttctacgggtaccgttcggtacggggacccaagggtaaccccg

SEQ ID NO: 251265 - DNA, 833 bp, Homo sapiens
  misc_feature: GYAE6OF02F957F.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggatctcgtggaggatctccgtaggtaagggttcgtggtatacgtaggttttccaggtctacgtggatcaccgttgggtgcgacaggaacggaccccggtaaaggccgtagggagtaggaggtgggggaacggtattgactcccgtagtgtactccgtacacgtataccaacgtacaccgtcccgttcccttaccgaacggtcccgtaccgtacacccgtactcgactacgtcctagaaccgtaacgtccctaataccgtagttaccgtcccgtaccctttccgtagccggtacggttaccggccggaccgtaccggtcccggtaccgggtaccggggtacccctaacccgggtaccccgtaaccccggacccttaacggtaaaccgttttacgttaacccgttgggttaccggtaaccgggttaacccggtttacccggggtttaacgccccgggttaaccccgtacggtaaccgtaaccggtttccccgtaaacggtttaaacccgttaacccggtttaaaacccgggttcccgggttaaccggttacccgggggttaccggtttaccccggggtacccgggggttaacccccggtaaacccgggggttaacccccgg

SEQ ID NO: 251266 - DNA, 722 bp, Homo sapiens
  misc_feature: GYAE6OF02FXALV.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatccccctcaccctcctcctggctgttctccaaggagtctgtgccgaagtgcagctggtgctaggtccggagcaggaggtagaaaaacggcccggggagtacctcgtggaggatccttcctggttaagggttcctaggtatacgtaggtttttccgagtcgtacgtggacttcaccgttgggtacgcgaccagaacgccccggtaaaggcctgggacggtggacgtgggggagtagttcggactcccgaggtgaactcttacgactacgtcaacctacgaccgtcccggtccttaccaacgggtcccaccgttccaaccgtacttacctaccgagtaccgtcggaaactacgtacccgtaactaccgtaacgtactcggtccctttaccgcgtcgtaggtcggacgtccgagtccgtacggcggttcccgtacgggacccacccggctaactagttacgttaaccgtgtcggtacttcggtaccgttcgaccgtccgactcgtaacgttcaccgttaccctaaccgtttacggtacggttcccggttcggttaaccgttaccgggtcccgggtaaccggaccggggtaacccccgg

SEQ ID NO: 251267 - DNA, 611 bp, Homo sapiens
  misc_feature: GYAE6OF02JENIF.16.35.D02.1.454.CMB.1.raw
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
  modified_base (342)..(342): a, c, t, g, unknown or other
  misc_feature (342)..(342): n is a, c, g, or t
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
  modified_base (514)..(514): a, c, t, g, unknown or other
  misc_feature (514)..(514): n is a, c, g, or t
tcagtgtactactccacgaccggtgctcgatttagcacacgatagttgggtttggggctccttcaccacccagctgggatctcagggcttccttttctgtcctcctccaggatgggggtcaaccgccatcctcaccctcctcctggctgttctccaaggagtctgtgccgaagtgcagctggtgcagtccggagcagaggtgaaaaagcccggggagtctctgaggatctcctgtaagggttctggatacgaggttttccagctactggatcactgggtncgcagaagccggtaaaggccnggagtggatgggggagattgatcccgagtgactctcactancaactacacgtccctccttcccaacgggccaccgtcaccagtcctacgagctagaactaacgtccatcgacttccgntcccttccgngccgaggtcggccgnacgccgtgggacgccgtacggaccacccgcaattacgttacttacgtgtcggtcgacggttcccggttanccggtcccgacgtagtactaccaaccttaaccttaccgtaaccgttacgggtccgtaggttacccggtacggtcggggacccgaaggggtaaccccg

SEQ ID NO: 251268 - DNA, 849 bp, Homo sapiens
  misc_feature: GYAE6OF02H6HT8.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggagtctctgaggatctcctggtaagggttctggatacgtaggttttccagtctacgtggattccgaccgtggggtgccgccaggaacggccccgggttaaaggccgtagggaggtagggagtggggggaaggtagtttacggacgtacccgtaggttacggaccttcctaccgaactactacctaaaccttaccaccggtccccgttacctttacccgaaacggtccctaacggtacccaacccgaacttccctaccgtacgtaccgtacggaaccctaaacggtccctaacgttaccaacggtttaccccttcggttacccccgttttcccgtacgtaccggttaacgggtcccggggaccgtaccggaacccggtcccggtttacggggaacccgggttcccgtaccggggaacccgaaccccggtccttaaacgttaacgtttaccgtttaccgtggttaccggtaccgggttaaccggtttacccgggttacgttcccgggacccgttacgaacggttaccttaccgtaaccctttaccgtaaccccgttttaacgtaccccgggttcgttaaccggggtaccggtttacccgggttaccgggggaacccccgtaagggggtaccccccgg

SEQ ID NO: 251269 - DNA, 790 bp, Homo sapiens
  misc_feature: GYAE6OF02IHTU1.16.35.D02.1.454.CMB.1.raw
tcagtgtactactccacgaccggtgctcgattttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacggcccggggagtctctaggaggtactctccgtaggttaagggttcgtaggattacgttacggttttccagtctacgtggatcaccgtgggtgccgccgagaacgaccggtaaaggcctaggagtggagtggggagtagttgactccgagtagctctacactatacaaacttacacggtccccgttccttaacccgaacggacccctaaccgtccaaacctactacctacgacgtctacgaccgtaacgtcccaattccgtaacgtactcgtacccttccttacgacgtacggtacggcccgacgtaccggtccggttacggggacccggtaccccgtaccgggaaacccgacccgaccgttaaagttaactttaaccgttacgttcggtacggttaccggtaaccggttttacccggtttaccgtacccgggtacccgtaccgtaaggttacccgttaacctaaccctttaaccgttaaccgtttaacccgggtttaccgggtttaccggttaccggggttaaccccgggtttcgggggtaacccggggttaaccccggtaacgggggttaaccccccggg

SEQ ID NO: 251270 - DNA, 684 bp, Homo sapiens
  misc_feature: GYAE6OF02J22X1.16.35.D02.1.454.CMB.1.raw
  modified_base (159)..(159): a, c, t, g, unknown or other
  misc_feature (159)..(159): n is a, c, g, or t
  modified_base (528)..(528): a, c, t, g, unknown or other
  misc_feature (528)..(528): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtgccgaagtgcagctggtgcagtccggagcaggaggtagaaaacggcccggggagtctcgtacggaggactccgtcctaggttaacgggttctaggtataccgttaggttttaccaggtcctacgtggtactccgtaccggtggtcgcgaccgaacggtaaccggacccggtaaaggtccgttagggaggttggaggtagggggagtagttagacgtacccgtagtcgtactcctacgacactaccgtaacctaccgcggtacccgttcccgttaccgaaccgggtcccaccgttaccacctacgttcctacgaacgtctacgaacctacgtccctatacgtacgtacttccgtcccgttccgngcgtacggtcgctccgacgtccgtacggcgtccgacggccaccgacctattactacgttacgtcgttacgcgttccgtacgtacgccgcgactacgtctacctacaccgttacctacgacgttcgcggaccgttcgacgggtaccaccggttaccg

SEQ ID NO: 251271 - DNA, 686 bp, Homo sapiens
  misc_feature: GYAE6OF02IMHBD.16.35.D02.1.454.CMB.1.raw
tcagtgtactactccacgaccggtgctcgattttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaacgccggggatctcgtgaggatctcgtggtaggttctggatacgtaggtttcagtactacgtgatcgacgtgggtcgccgtccaaggaaccggacccggtaaaggccgtaggagtgggagtgggggagtagttcggactaccgtaggtcgacctccgtacaacactaacaactaccgaccgttccccgttcccttaaccgaacggtacccctaccgtaccaccctacttacgtcgaacgtctaacggtaacctacgtacccacttaccgtaaggttaccttcgttaccctttcctcgacgtggtcggtccgtcctacggtcccggtagggcccgtacccggtaccggacccacccggtataaccgttatacgttacgtagtcggtccgttaccggttacgtacgtccgccgagactacgtcctaccttatacctacgtcgttcgtacggtaccgtcggacgggtacgtaccggtacccgg

SEQ ID NO: 251272 - DNA, 636 bp, Homo sapiens
  misc_feature: GYAE6OF02HCAV6.16.35.D02.1.454.CMB.1.raw
  modified_base (159)..(159): a, c, t, g, unknown or other
  misc_feature (159)..(159): n is a, c, g, or t
  modified_base (359)..(359): a, c, t, g, unknown or other
  misc_feature (359)..(359): n is a, c, g, or t
  modified_base (425)..(425): a, c, t, g, unknown or other
  misc_feature (425)..(425): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtgccgaagtgcagctggtgcagtccggagcaggaggtgaaaaagcccggggagtctctgaggatctcctggtaaggttctggatactaggtttccagctactggatcacctgggtcgcgcccaagaacgccccggtaaaaggcctagggtaagcgggaatgggggaggattgactcccaggtgaactcgtaccanataccaacttaccgaacgtccccgtccttacccgaaggccctacgtccaaccatctcaagctcganaacgtcactcgaagtacctcggtaccttacccgtgcctaaggttcggactcgacggtccgtagggacgtcccgcggtaacacccggacaattactaagttacctgtacggcgtaacgttccggttatccggaccgtgaacgtagtccgaactacgttaacctacgtacgttcgtacggtaccgtcgttacggggaccctaagggtaccccg

SEQ ID NO: 251273 - DNA, 663 bp, Homo sapiens
  misc_feature: GYAE6OF02F61EN.16.35.D02.1.454.CMB.1.raw
  modified_base (402)..(402): a, c, t, g, unknown or other
  misc_feature (402)..(402): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaacggcccggggagtctcgtggaggtatcctccgtaggttaacgggttctagggatacgtacggtttttccgagtaccttacgtggacttccgaccgtgggtgccgccaggaacggaccccggtaaaggccgtaggaggttggaggtgggggaggtagttcgactcccgagtgacctctacacactacaacctacnccgtcccgtacctaccgaaccggtccaaccgtaccacctacgtcctaccgagtcctacgaactaaccgtcaactccgaagtacctcgtcccttacgcgcgtaggtccggcgtaccaggttccgagggaccgtccggtacgaccgaccgactacgtattactacgtcgtcgacgtacgttccgttagtcccgacgtacgacgtactccaacttacctaacgttacgtcgcgttcggacgttcggacgggaccgacgggtacc

SEQ ID NO: 251274 - DNA, 845 bp, Homo sapiens
  misc_feature: GYAE6OF02I2KTJ.16.35.D02.1.454.CMB.1.raw
  modified_base (155)..(155): a, c, t, g, unknown or other
  misc_feature (155)..(155): n is a, c, g, or t
  modified_base (220)..(220): a, c, t, g, unknown or other
  misc_feature (220)..(220): n is a, c, g, or t
tcagtgtactactccacgaccggtgctcgatttagcacacgatagttgggtttggggctccttcaccacccagctgggatctcagggcttccttttctgtcctcctcaggatggggtcaaccgccatcctcacctcctcctgctgttctcaaggngtctgtgcgaagtgcagctggtgctaggtccggagcaggtaaggtaaggaaaaacggcccggggntccgtcgtaggaggtactccttaccgttaggtaacgggtttccgtagggtaacttaaccgtttaacgggttttcccgaggtacttaacggtcggtaacttcccgtaccggttggggttccgacccggtaacccgaaagggtaaaccgggttaaacccccgggggtaaaacgggtcccggttagggggaacggtaggggttaggtaggggggaacggttagtacgtaaccgtcccgtaggtaccgtactctacgaactacctacgtaacctacgtccgtaccccgttaccctaccgacggttacccgaactacctaaccgtacttacccacgcgtactacgaacctacgtacctataccgtacttacgtcgtccgttcgtcgtgtacggcggtccgacggtacgtcggtgggacccgtaccgaccggaccggtaccctaccgtaagtttaaacctttcgttaaccggtttgtacgggttaccgttacgggttacccgttaggttacccgaccggttacacggtacccttaaccggttaacctaaccgttaaacgttacgggttacgtttaccgggttacgggttcggttaccgggggtaccgggtaaccgaccggggttaccccgg

SEQ ID NO: 251275 - DNA, 619 bp, Homo sapiens
  misc_feature: GYAE6OF02GS3UR.16.35.D02.1.454.CMB.1.raw
  modified_base (332)..(332): a, c, t, g, unknown or other
  misc_feature (332)..(332): n is a, c, g, or t
  modified_base (515)..(515): a, c, t, g, unknown or other
  misc_feature (515)..(515): n is a, c, g, or t
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacgcccggggagtctctgaggatctcctgtaagggttctggatacgtaggttttccagctacgtggactcaccgtgggtcgcgccgagaacgacccggtaaaggcctggagtggagtgggggagtnttgactcccgagtgactctacacatacaactacacgcccgttccttacgaacggtccacgtcaacctactctacagtctacgaactaacgtcatctaacgtacctcgtccttcctagctaggtcggacgcgacgtccgtgggaccggtcccgtcggaccacccgctaagtacttactttacgngtacgcgtacggtccggttacnccggcncgtagtactactaacttacctaacttaccgtaccgtcgtacgggtaccgttcgggcgggaccggaacggtacccgg

SEQ ID NO: 251276 - DNA, 1026 bp, Homo sapiens
  misc_feature: GYAE6OF02HPUPA.16.35.D02.1.454.CMB.1.raw
  modified_base (98)..(98): a, c, t, g, unknown or other
  misc_feature (98)..(98): n is a, c, g, or t
tcagtgtactactccacgaccggtgctcgatttagcacacgatagttgggtttggggctccttcaccacccagctgggatctcagggcttcctttttntcgtcctcctccgaggagtcgggtaccaaccgcactcctccaccctcctccgtggcttgttcctaccgaaggtgttctgtcgaccgtaagtgacgagtcgtggtcgccgtacggtccgggagacgaagggtaggtaaacggaaaaaccggggcccggggtaacgttcctcgtagggaacggtacttcctccgtaagggtttaacgggttcgtaggtaactacggtttacgtttccgacgtacgtacgtggactaccgtaccggtgggtacgccgaccgaaggacccggtaacccgggtaacggtccgtaaggggtacggtagggtaggggtcgggggaagttacgttacgaccccgttaccggaggttaccgacccttccgtacaaccgttactaacctaaacccgttaccgacccggttaccccgtttaccccgtaaccggtaaacccggaccccgtaccggttacccaaccgttacgtaccctaccggaacggttctaaacggtaaaccccgttaacgtcccgttaaccgttaaccgttaaacccgggtttccttaccccgtttccccgtttcccggttacggaaccgttaccggggttccgggaccccgtaccggaccggtacccgggttaaccgggcccggttacccgggtaacccgggaaccccgtacccgggttaacttaaaccggtttaacgtttttaacccctttacggggttaccggttacccgggtaccgggtttttaaacccggggtttcccggtttaacccgcccccggggttaacctaccggtaacggttaaccccttacccgttaaacccgtttaaccttaacccgggtaacccggttttaccggtacggtaccgggttacccgggttaccggggtaccccggggaaacccgggtacccggggttaacccccgg

SEQ ID NO: 251277 - DNA, 796 bp, Homo sapiens
  misc_feature: GYAE6OF02JPOXN.16.35.D02.1.454.CMB.1.raw
  modified_base (161)..(161): a, c, t, g, unknown or other
  misc_feature (161)..(161): n is a, c, g, or t
tcagtgtactactccacgaccggtgctcgatttagcacacgatagttgggtttggggctcccttcaccacccagctgggatctcagggcttccttttctgtcctccctccaggatggggtcaaccgccatcctcaccctcctcctggctgttctccaaggngtctgtcgaccgaagttgcagctggtgcagtccggagcaggaggtagaaaacgcccggggagtctctaggaggatctacgtgttaagggttctaggatacgtaggttttccagtctacgtggactacgaccgtgggtcgccgaccgaaggtaaccggtacccggtaaacggtacccgtagggacggttagggaggtagggggaaaggttagttaggaaccgtacccgtaaggtacggtaacctccgtacgaacctagtaaccgaaaccgttaccgaaccggtccccttacccgttaaccgaaccggtaaccccgaacgttacccgaaaccctacgtacctacgtaagacccgttacggaaccttaaccgtaccctaacgtacgtaaacgttaccgtacggttaccccttaccgtacggtaccgtaacgtcgggacctacgtacggcccgtagggaccgtccgtacgaccctacggacctagtaccttaattccgtagtcgtaacggtcggttaccgttaacgtccgaccgtacgaaccgacgttaccgtaaactttaccgttaaccgttaaccgtaaccggttacgtaccgggtaaccgttccgggtaaccgggacggtaacccgggtaacccgg

SEQ ID NO: 251278 - DNA, 723 bp, Homo sapiens
  misc_feature: GYAE6OF02IGY73.16.35.D02.1.454.CMB.1.raw
  modified_base (282)..(282): a, c, t, g, unknown or other
  misc_feature (282)..(282): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcaggtccggagcagaggtagaaaaacgccgggagtctcgtagagatctccgtggtaaggttctggatacgtagttttcagctacgtgactcgacgtggngaccgcgaaggaacgaccggtaacgtcgtggacgtggtaggtggggagtagtgtacgtccgagtacgcgtactcaacaactacctaaacctaccgtaccgtccccgttaccttaccccgaaacggtccctaaccgtaccaacctacgtacctacgacgtacctacgaacctaacgtaccctaagtcccgaaacgtttaccctcgttaccccgtttaccgtcggacgtcggtacggcgtacgaccggttcggtacgggacccgtccgtaccgacccgtacccgtactaacttagttaaccttacgtcggttacggtaccgttacgttacccggttagcccgggccacgtaacgtacctaaccgttacttaaccgttaacccgttacgtaccggttcgtaaccgggttccgttacgggaccgggtaaccccggacgggtaccc

SEQ ID NO: 251279 - DNA, 779 bp, Homo sapiens
  misc_feature: GYAE6OF02HSWYI.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagcgtggtgcagtccggagcagaggtagaaaaacggcccggggagtctctgagatcgttcctggtaagggttctggatacgtacggttttccagctactggatctaccgtgggtgccgccgaaggaacgacccggtaaaggccgtggaaggtggagtggggggaggtattcggactcccgtagtcgtacctctacaacataccaaactaccgaccgtcccgttaccttacccgaacggtccctaacggtaccaaccgtacgttacctacgacgtacgtacggaacctaacgtcctactaccgtacgttaactccgttccctttaccgtcgacgtacgggtcggtacccgacggaccgtacccggttcggggaaccggtcccggttaacccggaccctacccggacccgtaagtttaaccgtttacgtttacgttccgggtacgtaccgggttaaccgggttccggttacgttacccggcccgtacggtaacggttaacctaccgtaaccgtttaacccgttacccgttaaccggttaaccggttccggttacgggtaaccggttcccgggtaaccggggaacccggtaaacccgggtaccccgg

SEQ ID NO: 251280 - DNA, 714 bp, Homo sapiens
  misc_feature: GYAE6OF02IADEB.16.35.D02.1.454.CMB.1.raw
  modified_base (223)..(223): a, c, t, g, unknown or other
  misc_feature (223)..(223): n is a, c, g, or t
  modified_base (281)..(281): a, c, t, g, unknown or other
  misc_feature (281)..(281): n is a, c, g, or t
  modified_base (316)..(316): a, c, t, g, unknown or other
  misc_feature (316)..(316): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaagcccggggagtctcngaggatctcctggtaagggttctggatacgtaggttttcagctactggatcacgtggngcgcgagacggccggtaagccgtaggaggtggagngggggagatttggactccgtagtcgactcgtacgacactacctaacacgtaccgtcccgttaccttacccgaaggccctacgtaccgaacctacgtcctacgtactcgtacgaacctaacgttcccattaccgacgtttacctaccggttccccttccgtagtccgacggtaccgggtcgccgtaacggtcccggttagggcccgggtacccgtaccgggaccctacccgtcgtaaacttagttacttacgtcggtacgtaccggtacggtttccggaacgtccgtcccgtacgacggttaacgtccctaaccgtaacgttacccgttaaccgttaccgggttcgttacgggtaccgtttccggggtaccgggggaaccccgtaacgggttaccccgg

SEQ ID NO: 251281 - DNA, 736 bp, Homo sapiens
  misc_feature: GYAE6OF02GEXIK.16.35.D02.1.454.CMB.1.raw
  modified_base (528)..(528): a, c, t, g, unknown or other
  misc_feature (528)..(528): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatccctcaccctcctcctggctgttctccaaggagtctgtgccgaagtgcagctggtgcagtccggagcagaggtagaaaaacggcccggggagtctcgtgaggacttcgtcgtggtaacgggttctaggtatacgtaggttttccaggtccttagtcggaactctaccgtgggtcgccgaccgaggaaccggtacccggtaaacggccgtagggacggttagggaggtaggggggaaggtagttaggtaacgtcccgtagtcggacctaccttccgaaactactaaccgtaaacctaccgaccgtaccccggttcctttacccgaacggtacccaccgttaccaccctacgttcacgactcgtacgactacgtacctagtcaacgttactccgtcctttcncgtccgaggtcggaccgtcgacgtccgtacgggaccggtccgtaccgaccctaccgaccgtaagttactacgttacggttcgtacggtccggttaccgttacggttacgtcccgaaccgtctaccgtatccaaccgttaacctacccgttacgtaccgtaccgtacggtaccggttcgggaccgggtaacccggtacggtaaccccgg

SEQ ID NO: 251282 - DNA, 780 bp, Homo sapiens
  misc_feature: GYAE6OF02HFRO5.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcgagtccggagcgaggaggtaagaaaaacgggcccggggagtctcgtggaggacttccgtccgttaggttaacgggtttcgtggtacttaacgttacggttttccagtccttacgtaggtactcctaccggtgggtcgccgaccgaaggaaccggtacccgggtaaaggccgtaggacggtggaggtgggggaggtagttgactacccgagtcgtactccgtacactaactacaaaccgttacgaccgtccccgtacccgttaccgaaccggtacccctaccggtacctaccgtaccttccgaccgaacgtaccgtaacgaccgtaaacgttccgtaactacgtacgttacctccgtttcccttccgtcgccgtacggtcggccgccgacgtccgggtacgggccggtacccgtaccgaccgaccgtaccgtaattaacgtttcgtaacgttggtccggtacggttaccggttaccggttacgtcccggtaccgcgaacgtaccgttaacctaaccgttaacctaaccgttaacggttccggttacggttccggttaccggttacgggtaccggggtaccggaacggggtaccccgg

SEQ ID NO: 251283 - DNA, 802 bp, Homo sapiens
  misc_feature: GYAE6OF02IWY0F.16.35.D02.1.454.CMB.1.raw
  modified_base (243)..(243): a, c, t, g, unknown or other
  misc_feature (243)..(243): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctcaggagtctgtcgcgaagtgcagctggtgcagtccggagcagaggtagaaaacgccggggatcgtctgaggatcctcctggttaagggttntaggatacgtaggttttcccaggtcctacgtggactccgtaaccgtggggtgccgaccgtaagaacggaccccgggtaaagtcccgtgggtaacggtggacggtagggggaaggtgtttacgacttcccgagtacgactccacgtacacgtacctaaacgtacaacgtccccgtacttacccgaacggaccctaccgttacaacgtacttcgactagactagaacctacggtccatacctaagtaaccttcgtacccgttacctcgttacgaggttaccggcggtacgaccggtacccgtttggggacccgggttacccaccgggaaccccgtacccggacccttaagtacgtttaaccgtttaaccgttcgggttaacggaccgggtttaaccggtacccggggtttttacgaacccggacccgggctaaccggtaaccgttcccctaaaacccgttaaccttaaccggttaacccgtttaacccgggtttacccgtacccgggtttaccgggttacccggttccggggaaccccggtaaccgggggttaacccccgg

SEQ ID NO: 251284 - DNA, 808 bp, Homo sapiens
  misc_feature: GYAE6OF02GRKEF.16.35.D02.1.454.CMB.1.raw
  modified_base (157)..(157): a, c, t, g, unknown or other
  misc_feature (157)..(157): n is a, c, g, or t
tcagtgtactactccacgaccggtgctcgatttagcacacgatagttgggtttggggctccttcaccacccagctgggatctcagggcttcctttctgtcctcctccaggatggggtcaaccgccatcctcaccctctcctggctgttctccaaggngtctgtgccgaagtgcagctcggtgcgaggtccggagcgagaggtagaaaacggccggggagtcgtgtgagtacgtctcgtaggtaggttcaggtactacgtagtttccgacgtacttacgtaggtacgtaccgtaccggtgggtcggtaccgtaccggaacggtaaaccgggtaaccccggggtaaacggtccggttaggggtaaggttaggggaacggttaaggggggtacggtagttcggtaaccgttacccggaggtccgttaaccgtaccgtaccgaaccttaacgtaaccgtaaaccgtaccggtaccccggtacccgttaacccggttacccgaaaccggtccctaaacccggtacctaaaccctcttacctacgtaacgaccgttacggaaaccgtaccgtacctacgtacgtaccgtacgttccgtccgtcgtacggcgtaggtcgcgctacggtcgtacggaccgttccgacccggacacccgtacgtacgttacttacgttcgtacggtacggttacggtaccggttacggtccgtcccgcgtaccgtacgtacgtacctaaccgttaaccgtacccgttacggttaccgtaccggtacgggtaaccctcgggtaaccgggcccggtacggtaccccggg

SEQ ID NO: 251285 - DNA, 866 bp, Homo sapiens
  misc_feature: GYAE6OF02IQEA2.16.35.D02.1.454.CMB.1.raw
  modified_base (159)..(159): a, c, t, g, unknown or other
  misc_feature (159)..(159): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtgccgaagtgcagctggtgcagtccggagcaggaggtagaaaaacggcccggggagtctcgtaggaggtactctccgtggttaagggttctaggactacgtacgttttcgtacgacgtacttaggacgtactaccgtcggtcggtcgaccgtacgaacggtaccgggaaccggtaacgcggtaggtaggtaggtaggggtagggaagttagtacgaccgtacggtacgtacgtcctacgtaactacgtactaaccgttaccgaaccgtcccgttaccccgttaaccgtaaccgtacccgggtacctaacccgtacctaaaccgttcgttcctaacgtaccggtacctaacggttaacgacccttacgaacgttacgacgttacgttccttcccgtacgtcgtaacggtcggtccgacgtccgaaccggttcggtaccggaccggtttacccggaaccggtaccccgaaacccgttacgttaaacccgttacgtttaaaccggtttaccggtaccggtaaccgggttccggtttaaccggggttttaaccctccgggttacccggaaccgtaacggttaaccgttaacccgttaccgtttaaaaccgttacccgttaaccgggttaacccggttaccgggttaacgggttacccggttacggggttaccccggggtaacggtaaaccccgggtaaccccgggg

SEQ ID NO: 251286 - DNA, 689 bp, Homo sapiens
  misc_feature: GYAE6OF02FPZ4Z.16.35.D02.1.454.CMB.1.raw
  modified_base (362)..(362): a, c, t, g, unknown or other
  misc_feature (362)..(362): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctctgtaaggttctggatactaggttttccagctactggatccaccgtgggtgcgtccagtaagcccggtaaaggccgtaggacgtggagtgggggagtagttgatcccaggtgacgtctacgacatcaactacncgtcccgtcttaccgaagtccacgtccaccgaattccacaagcttacggacaacgttaccaattcgtaaacgtctcgttacccgttccgtcgcgtacggttcggaccgtcacgtccgttagggacgtccccttacgggaaccaccggtacccaacttaagtacgtttaaccgtttcggtacgtaccgtaaccgtttacccggtagtttaccggacccgtacgtaacgaccgtttaccaaaccgtttaacccgtaacgtttaacctaaggggttccctagggggttccgttacccgggacggggttaacccaaaggggttaacccccg

SEQ ID NO: 251287 - DNA, 727 bp, Homo sapiens
  misc_feature: GYAE6OF02JXJ88.16.35.D02.1.454.CMB.1.raw
  modified_base (193)..(193): a, c, t, g, unknown or other
  misc_feature (193)..(193): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggancgagaggtagaaaacgccgggagtctctgagtatctcgtgtaggttctagtatacgtacgtttccagtctacgtcggtactcctaccggtggtcgccgaccgtaaggaaccggtaccccgggtaaaggccgtagggaggtcgggtaggtgggggaagttacgttagactacccgtggtctaccgcttacgactacgtaccaacgtaccgacgtcccgttccttaaccgacggccaccttacgaccctctacctcgaactaccgtacgaactaaccgtctaactacgtaacgttctaccgttcccttcctggtaccgcggtcggctaccgtcgggtacgtacggaccgtcccgtacggaccctacggtactacgtaacctttactacgttgccggtacgttaccggttaccggtagtccccggactaccgacttaccgtaccgttaacccttacttacccgttaacccggtcggttaccggtccggggtaaccgttcccggggtaacgggtaccgggtacccgggttaaccccgg

SEQ ID NO: 251288 - DNA, 807 bp, Homo sapiens
  misc_feature: GYAE6OF02HTDCK.16.35.D02.1.454.CMB.1.raw
  modified_base (259)..(259): a, c, t, g, unknown or other
  misc_feature (259)..(259): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatccctccaccctcctcctggctgttctccaaggagtctgtgccgaagtcgcagcgtggtgcagtccggagcgaggaggtagaaaacggccggggagtcgtcgtaggaggtactctcgtaggttaacgggttntaggtattacgtacggttttaccagtactacgtagtactaccgtacggtgggtacgccgaccgaacggaaccggtaaccgggttaaacggccgtaggggagggttagggaacgggtagggggtacggtattcggtaaccgtaccgtaggtacgacctaccgtaaccacgtaactaccgaaacccgttaccgacccggttaccccgtacccgtaccgtaaccggacctaccgtacacccgttactacctcgtaacgtacgtaacgtaacgtaccgtaccgtactacgtaacccgtcttacccgttccgttaccgcggtacgtaccgggacggtaccgtacgtacccggtcggtacggggccggaacccgtacccgggaacctaacccggattaaccgttaacgttacgttacccggttagtacgggttaccgttcggttaacggttccggtaccgaccgtagtactacccgtacttaacctaccgttaaccgttaaccgtcggttaacgtcggtaccggtacgggtaccgggaccggtaccggacccgg

SEQ ID NO: 251289 - DNA, 625 bp, Homo sapiens
  misc_feature: GYAE6OF02F83Q2.16.35.D02.1.454.CMB.1.raw
  modified_base (242)..(242): a, c, t, g, unknown or other
  misc_feature (242)..(242): n is a, c, g, or t
  modified_base (441)..(441): a, c, t, g, unknown or other
  misc_feature (441)..(441): n is a, c, g, or t
  modified_base (542)..(542): a, c, t, g, unknown or other
  misc_feature (542)..(542): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggagtctctgaggatctctgtaaggttcnggatactaggtttccagctactggatcaccgtgggtgcgccagaacgccggtaaaggccgtggagtggagtgggggagagttgactccgaggtgtacctcgtacactataccaactacgaccgtccccgtccttccgaacggccacgtccaccatctacagtctagacaacgtccactctaacgtactcgtcccttccnggacctaggtcggcgtcgcggtccgtgggaccggccgtccggaccacccgactatactttattaccgtggtcgtaccggtacgttccggttatccgaccgngtaacgtacgtacctaacttaccctaacgtaacgttcggtcgttacggtaccgttcgggtacgggacccggtaagggacccgg

SEQ ID NO: 251290 - DNA, 673 bp, Homo sapiens
  misc_feature: GYAE6OF02F9G5S.16.35.D02.1.454.CMB.1.raw
  modified_base (500)..(500): a, c, t, g, unknown or other
  misc_feature (500)..(500): n is a, c, g, or t
tcagtgtactactccacgaccggtgctcgatttagcacacgatagttgggtttggggctccttcaccacccaactgggatctcagggcttccttttctgtcctcctccaggatggggtcaaccgccatcctcaccctcctcctggctgttctccaaggagtctgtgccgaagtgcagctggtgcagtccggagcagaggtgaaaagcccgggagtctctgaggatctcctaggtaagggttctgggatacgtaggttttccagcttacgtggatcaccgtgggtgccgcaaggaacgacccggtaaaggcctaggagtaggagttgggggagattggactcccgaggtcgacttctacacgtatacgaaacttacgacgtaccccggttcccttacccgaaagggccctaacggtccaaaccctaacgtcctacaacgtctacggaactaacgtacccaatcgaacgttactcgtcccttacgtagccgtagtcgggccncgacgtccgttagggagtcccgtaacgggaccaccgctaatactattacgtggtctacgtagttcccggtttatcccggactacggattacgtccgtaaacgtccttaaccgtacgtacgttccgacgggtaccgttacggtacggggaccctaaggggtacccctaaccggg

SEQ ID NO: 251291 - DNA, 733 bp, Homo sapiens
  misc_feature: GYAE6OF02F9O77.16.35.D02.1.454.CMB.1.raw
  modified_base (159)..(159): a, c, t, g, unknown or other
  misc_feature (159)..(159): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtgccgaagtgcagctggtgcagtccggagcagaggtagaaaaacggcccggggagtctcgtgaggatctccgtggtaacgggttctaggtactacgtaggttttccagtcctacgtggactccaccgtgggtcgccgcgaagaacgaccggtaaacggcctgggtacgtggaggtagggggagtagttggactcccgtagtcgtactctcaactactactaacacaccgtccccgttactacccgaacggcctaccgtaccaacctacgtcctacgacgtcctacgtaactacgtaccacgttacgtaccgtactaccggttccctttcgtcgtaccgtacgggtcggaccgtccgaacggtccggtacgggacggtcccgtaaccgggacccacccggaccttattaacgttcgttacggttacgtcgggtacgttaccggttaccggttacgtcccgtaccgtagtaccgtaactaaccgttaaccgttaaccgttaccgttaaccggtaccggttcgtttacggggtaaccgttccgggtacggggtaccgtaaccgggtaccccg

SEQ ID NO: 251292 - DNA, 829 bp, Homo sapiens
  misc_feature: GYAE6OF02H6BN6.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaacgcccggggagtctctgaggatctctggtaagggttctggatactaggtttcagtctactggatcacgtgggtcgcgccgagaacggacccggtaaggccgtggaggtcggaggtcggggggaaggtagttacggacgtcccgtagtcggacctcgtacaactactacctaaaccgtacgaccgtcccggtcccttacccgaaacggtccaaccgttcctaaccctaactccgttaccgacgtccgtacgtaaaccgaacgtacccgtaacgtaccgtaacgtttaacccgtcgtttcccccgtttaccgtacggtaccgttaacgggttacgggcccggtacgtaccggtcccggttacgggaaccgggttccccgtaacggggtaaccccgacccgtaccgtaacgtttaacgttacgtttaacccggtggttaccggtacccggtttaaccgggtttacccggttaccgttccggtacccggtacgtaacggtaccgttacccgtaaccgtttaaacccttaaccggttttaacccgaccgggttttaccgtcgggggttaaccccggttaccggggttaacggggggtaccccgtaaacgggggttaaccccccggg

SEQ ID NO: 251293 - DNA, 736 bp, Homo sapiens
  misc_feature: GYAE6OF02JX3GI.16.35.D02.1.454.CMB.1.raw
  modified_base (159)..(159): a, c, t, g, unknown or other
  misc_feature (159)..(159): n is a, c, g, or t
  modified_base (364)..(364): a, c, t, g, unknown or other
  misc_feature (364)..(364): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtgccgaagtgcagctggtgcagtccggagcagaggtagaaaacggcccgggagtctcgtgaggatcgtcctggtaagggttctggaactacgtacggtttccagtactacgtaggactcctaccgtgggtcgacgccaaggaccgaccgggtaaacggccgtaggcggtaggaaggtggggagtagttagaccgtaccgngtacgtactactacgacattaccaaaccgtacgaccgtcccgttcctaccgacggccacgtaccacccgtatcctacgaagtccgagtaccaacgtaccgtacgtactaacggtcttacggtccctttacgacggtacctacgggttacggaccgtaccggtaacgtcccgggtacggtaacccgggtcccgttaacccgggaccctacccggttaccttaaacgttacgttaccgtttacccggtaaggttccgaccggttaacggttcccggtactacccgggcgttacgacgtaccgtaactacttacccgtacgttacccgttcggtactccgggaccgtcggtacgggacccgtacggtaaccccgg

SEQ ID NO: 251294 - DNA, 785 bp, Homo sapiens
  misc_feature: GYAE6OF02HL27C.16.35.D02.1.454.CMB.1.raw
  modified_base (365)..(365): a, c, t, g, unknown or other
  misc_feature (365)..(365): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcaggtccggagcaggaggtaggaaaacgcccggggatctcgtgacggatccgtcgtaggttaacggttctaggtattaccgtacggttttccagtctacgtggactccaccgttgggcgaccgccgtaggaaccggtccggtaaaggccgtgggaggtggaggtaggggacgtagtacgacnccgagtcgactcgacatactcaactacaccggtcccgttaccctacggacgtaccctacccgtacaccgtacgtcctacggacgtaccgtacgaacgtaaccttacctactacgtaacgttccgttaccgtcccctttaggtccgtaagtacgggtacgggtaccgccgtaaccgtcgggtacgggtacccggtccgtaaacccggacccgtccgtaacgtaccgtttaacgtacgtttacgttcggtacggttaaccgggttcggttaacccggttaccgtacccggacgtaccggtaacttaacccggttcgtaaaccccgtttacgttaaccccggttaaagtacccgggtttaccgccggggttaaccgggtttcccgggaaacccgggtacggggttaaacccggtcccccgggg

SEQ ID NO: 251295 - DNA, 864 bp, Homo sapiens
  misc_feature: GYAE6OF02F5HU5.16.35.D02.1.454.CMB.1.raw
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggcctgttcgtccaacggagtctgtcgccgaagtgcacgtctgggtgcagtccggagtcgaggtaggtagaaaacggcccggggagtctacgtgaggatcctcctggtaagggttcgtaggatacgacggttttccagtctacgtggactcaccgtgggtcnccgcaggacgccggtaagccgtggaggtgaggtaggggagtnttgactccgagngactcacgactatacgaactacgtaaccgtccccgttaccttacccgaacggtaccctaccggttaccaacccgtattaccctacgacgtaccgaacggtaacctaaccgttaccacgtacgtaacgttaccgtcgttaccccctttccggtacggtccgtaacgggttccgggcccgtaacgtaccgggttaccccgggtacgggaacccgggtccccgttacccgggaaccccggttaaccccgaccgtttaaacgtttaacgtttaaccgttttaccggttaccggtaaccgggtacccggggttaacccggttttaacccgggttaccgttaccccgggtacccggttaccgaaaccggttacccgttacccgttaaacccgtttttaaaacccggttaaccgtttaaccgggtttacccgggttacccggtttacgggggttacccgtttaccgggggtaccccgggggttaacccgaaacccggggggtaacccccggg

SEQ ID NO: 251296 - DNA, 718 bp, Homo sapiens
  misc_feature: GYAE6OF02I9D3L.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacgtaggttttccagtctactggatcaccgtgggtgccgccagaacgcccggtaaaggcctggagtggagtggggagtattgactcccgagtcgactctacactactacaacctacacggtccccttacccgtttaccgaaacggtccctaacggtacccaccctacttcctacgacgtcgtacgaacgtaacgtccctaataccgaacgttaccttacgtcccctttccgagtaccgtaggttcggacccggtcgaccggtacccgtgggtaccggccccgtacggacccgtaacccggacccttaattacgttaacgtttaccgtagggttaccgtaccgggttacgttacccggtttacgtcccgtaccgtcgtaacgtacttacccgtaacttacccttaccgtaaccgttaccggttacgttacgggtaccgttcggtacggggacccgtaaccgggtaaccccgg

SEQ ID NO: 251297 - DNA, 795 bp, Homo sapiens
  misc_feature: GYAE6OF02G67XB.16.35.D02.1.454.CMB.1.raw
  modified_base (159)..(159): a, c, t, g, unknown or other
  misc_feature (159)..(159): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtgccgaagtgcagctggtagcagtccggagcaggaggtagaaaaacggcccggggagtcctcgtagaggatctcgtaggttaaggttctggatacgtaggttttccagtctacgtaggatcctaccgttgggtcgccgaccgaacggtaaccggaaccccgggtaaacggcccggtagggtaggtacggggtaggtagggggaggttagttcggtactcccggtaggtacggccttacgtaccgaacctaataaacctacgaccgtccccgttaccgttaccgaacgggtacctacgtacccaaccgtaacgtccgtaccgtaagcccgtacgtaaaccgtacggtaccacgtttacctaacggttacccttaccggttcccctttaccggtcgtacgtaccgggttacggccgtaccgtaccggttaccggttacgggacccggtcccggtacccgggaaccctaccccgtacggtaactttaacgtttaacgtttacgtacggttcggtcggttaaccgggtttcgttaaccggtccgcgtactacggtacttacgacctttaacgtaccgtaccgttacggtagttacggtacggtccggtacgggtaccggtaccggtaccgaccgg

SEQ ID NO: 251298 - DNA, 855 bp, Homo sapiens
  misc_feature: GYAE6OF02F7NEA.16.35.D02.1.454.CMB.1.raw
  modified_base (159)..(159): a, c, t, g, unknown or other
  misc_feature (159)..(159): n is a, c, g, or t
  modified_base (665)..(665): a, c, t, g, unknown or other
  misc_feature (665)..(665): n is a, c, g, or t
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggngtctgtgccgaagtgcagctggtgcagtccggagcaggaggtagaaaaacggcccgggggatcctcgtagaggtactccgtccttgggttaacgggttctagggtaacttacgttacggttttacccaggtccttaacgtggtacttacccgtacccggttagggtcggcccggtaaccgaaacgggttaaaaccggacccccgggttaaaacgggtcccgttagggggtaacgggttacgggggtagggttaggggggggaacggttagtttacggtaacccgttcccggtagggttaccgtaaccgttccgttaccgaacctaggttacccctaaaacgttacccgaccggtacccccttacccgtttacccgaaacgtccccgtaaccgttacccgaccgtaactccgttacacgttcccgtacgacgtaaaccgtcaactacaacggttacctccggttccttaccgtcgtacggtacgtcggccgtaacggccgtaccggngggtaacccggtcccgtaaccgccgttaccggtactaaacggttattacgtttccgtagggttcgtaccgttacgttacgttccgtccgtaccgtcgtaagtcccgttaaacgtacctaaccgttaccgtacgtttaccggtcggtccgggtaacgttccgggaccgggtaaccgtcccggtaaccccgg

SEQ ID NO: 251299 - DNA, 818 bp, Homo sapiens
  misc_feature: GYAE6OF02I9X6R.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacggcccggggagtctcgtggagatctccgtaggttaacgggttctggtatacgtacggttttccagtctacgtaggtacttccgaccggttgggtcgcggaccgtaaggaaccggtaccccgggtaaaacggccgtagggaggtggtacggttggggggaggtattcgtactaccgtagtcgacctctacactactacaactacgaccgccccgttcctaaccgacggaccctacgtaccaccctacttcctacgacgtctaccggaactaaccgtaccctacgttaccgtaacgttaccgttaccgttcccctttaccggtcgtaccgttacgggtccgggaccgtaccgtaccgggtccggtacggggaccggtcccgggtacccggacccgtaccccgtactaacgttaacgtttaaccgttacgttacggttacggtacccgggttaacggtttacccggtttaaccgccgggtacccgtacgtacgttaaccctccgttaaacccgtttaacccgttaacccgttaaccggttacgggttaccggttaccgggttacccggttaccggggtaacccggggtacccggtaaacgggtaacccccggg

SEQ ID NO: 251300 - DNA, 761 bp, Homo sapiens
  misc_feature: GYAE6OF02FVF4B.16.35.D02.1.454.CMB.1.raw
  modified_base (307)..(307): a, c, t, g, unknown or other
  misc_feature (307)..(307): n is a, c, g, or t
  modified_base (601)..(601): a, c, t, g, unknown or other
  misc_feature (601)..(601): n is a, c, g, or t
tcagtgtactactccacgaccggtgctcgatttagcacacgatagttgggtttggggctccttcaccacccagctgggatctcagggcttccttttctgtcctccctccaggatggggtcaaccgccatcctcaccctcctcctggctgttctccgaaggagtctgtgccgaagtgcagctggtgacagtccggagcgagaggtagaaaacggcccggggatctcgtggaggtatccgtcgtaggttaaggttcgtggacttacgtaggttttccagtccgtagttggactccgaccgtggggtacnccgaccgaaggtaccggtacccgggtaaaggcccgtaggggtaggtaggtaggtggggggtagtagttcgggtaactaccccgtaggtacgtaccttcgtaccgaccgttacggtaaccctaaccgtaccgtaccggttccccccgttacgttacccgaaggtacccccgtacgttccaaacgtctaccgtcgacgtctaccgacgtaacgcctaacgtccgaacgttcgtccgtccttcgtcgcgtacgtcgaccgcgtaccgtcgggtacggaccggtcccgaccggtaccnccggtacctaacgttaccttaactccgttggtcgacgttccggttcgtaccgtccgaccgtgtaacggttctccggtaaccgttcttaaacccgttcggtaccggttccgttaacgggtacccgttcggggtaaccggtaccgggacggttaaccccggg

SEQ ID NO: 251301 - DNA, 804 bp, Homo sapiens
  misc_feature: GYAE6OF02FLYYB.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaacggcccggggagtctcgtggaggtatcctccgtggttaagggttctggatacgtaggttttccaagtcctacgtggtactccgtaccgtggggtcgccgaccgaaggtaaccggtaccccgggtaaaagggcccgtagggtaggtcgggtagggttagggggggaaggtacgttaggtaccgttcccgaggtccggtaaccttcgtaccaacgtaactacctaaccgtaccgaccggtccccgtttaccgtttacccgaaccggtcccgtaaccggtaccaacccgtactttccgaccgtacgtccgtacggtaaccgtaaccgtacctaacgtaccttaacggttaccgttacgttccccgtttacgtaccggtaccggttacgggtccgggtacccgcgggtaaccggtccggtacgggtcccgggtccggtacccggtacccggaccgtaccctaagttacgttactttacgtacggtcggtaccgttcggttacccggttcgtcccgaccgtacgaccgtactaaccggtacttaacctacgtacgttcgtaccggttggtaccgtacgggtccggaccgtacgggtacccg

SEQ ID NO: 251302 - DNA, 746 bp, Homo sapiens
  misc_feature: GYAE6OF02H4BT3.16.35.D02.1.454.CMB.1.raw
  modified_base (148)..(148): a, c, t, g, unknown or other
  misc_feature (148)..(148): n is a, c, g, or t
  modified_base (154)..(154): a, c, t, g, unknown or other
  misc_feature (154)..(154): n is a, c, g, or t
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
  modified_base (530)..(530): a, c, t, g, unknown or other
  misc_feature (530)..(530): n is a, c, g, or t
  modified_base (652)..(652): a, c, t, g, unknown or other
  misc_feature (652)..(652): n is a, c, g, or t
tcagtgtactactccacgaccggtgctcgatttagcacacgatagttgggtttggggctccttcaccacccagctgggatctcagggcttccttttctgtcctcctcaggatggggtcaaccgcatcctcaccctctctggctgttcncaaggngtctgtgtcgaagtgcagctggtgcaggtccggagcgaggaggtaagaaaaaccggcccggggtatcgtacnggaggacttctccgtaggttaacgggttcaggattacggtacgtttccagtctagtggactcgaccgtgggcnccgacgaagacgaccggtaaggccgtaggtacgtggagtcgggggtaatcgttagccgtacccggtagtacgactcgtacactacgtactaaccgtaaccgtccgtacccctttacccgtaccggaaccgtacccgtaccgtaccgaaccccgtatttaccaaccggtcgtaccgtacgtaacaccgtacgtactacgtaccgtacctcgttccccttacggtattacggngtcggccgtacgtcggtacgttccggtaaccggcccgtaccggaacccgtaccggacttaccgttattaaccttacgttggttaaccgtcggtttaccggttaccggttacgaccgtaccgntaaccggtacttaaccggtaaccttaaccgttacgttaccgttaccggtacgtaccgggttacgaccgggttacgggaccgtacgggtaacccg

SEQ ID NO: 251303 - DNA, 726 bp, Homo sapiens
  misc_feature: GYAE6OF02IG8GE.16.35.D02.1.454.CMB.1.raw
  modified_base (538)..(538): a, c, t, g, unknown or other
  misc_feature (538)..(538): n is a, c, g, or t
  modified_base (657)..(657): a, c, t, g, unknown or other
  misc_feature (657)..(657): n is a, c, g, or t
tcagtgtactactccacgaccggtgctcgatttagcacacgatagtttgggtttgggggctccttcaccacccagctgggatctcagggcttccttttctgtcctcctccaggatggggtcaaccgccatcctcaccctcctcctggctgttctccaaggagtctgtgccgaagtgcagctgggtgccaggtccggagacaggaggtaggaaaacggcccggggatctcgtgaggactctcgtaggtaacgggttctggatacgttacggtttaccgagtctacgtagactcctaccggtcgggtcgtccgaccggaacggaaccggtaaccccgggtaaaggtccggtaggtaagggtgggtacggtagggggtaggtagttcgacgtacccgtgtacgtactccgtacactacgtaccaacgtacaccgtcccgtaccttaccgacggtcccaccgtaccacctacgttccacgtacgcgtactaaccgtaaccgtccctagtacgtacgtttacccttccgtacccttcggtcgngtaccggtccggaccgacgccggtaccgtggaacccggccgttacccgggaccgtaacccgtcctaagttacgttattaccgtgtaccgggtcgttacggtccggttccacggccgtanacgtactccgtactaccgtaacttcgtacgtcgtcggtacgccggtacgggacccgtacgggtaccccg

SEQ ID NO: 251304 - DNA, 753 bp, Homo sapiens
  misc_feature: GYAE6OF02FKLQV.16.35.D02.1.454.CMB.1.raw
  modified_base (158)..(158): a, c, t, g, unknown or other
  misc_feature (158)..(158): n is a, c, g, or t
  modified_base (175)..(175): a, c, t, g, unknown or other
  misc_feature (175)..(175): n is a, c, g, or t
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (397)..(397): a, c, t, g, unknown or other
  misc_feature (397)..(397): n is a, c, g, or t
tcagtgtactactccacgaccggtgctcgatttagcacacgatagttgggtttggggctccttcaccacccagctgggatctcagggcttcttttctgtcctcctccaggatggggtcaaccgccatcctcaccctcctcctggctgttctccaaggngtctgtgccgtagtgcngctggtgcagtcggancagagtagaaaacgccgggatctngagactctcgtaggtacggttctaggactacgtacggtttcacgtcctagtggtactcgtaccgtgggtcgccgcgaacggaaccggtaccccggtaaaggtccggtagggagtgggtacgtggggggtagtatggactcccgtaggtcgaccttcgtaccacgactaccgtaaaccgtacnccgtaccccggttcccttaccgaacggtccccaccgttaccgacctacttcctcacgttcccgacgtaaacaccgtaccgacttaccgaagtaccttccgtccctttaccgtcgtctacggtaccggtccacggccgtcccggtggcccgtacccggaccgacccgtaccctaaccgtaagttaccttaacggtttactcggtacgttaccggggttaaacctttcggtaacgtccctaccggcgttaacgtaccgtcctaaccgttaaaccctaccgttaacccgtaaggtttacccggttacccggtaccggttccgggaaaccggggtaccccggtaaacgggtaccccccgg

SEQ ID NO: 251305 - DNA, 844 bp, Homo sapiens
  misc_feature: GYAE6OF02HJ8J2.16.35.D02.1.454.CMB.1.raw
  modified_base (254)..(254): a, c, t, g, unknown or other
  misc_feature (254)..(254): n is a, c, g, or t
tcagtgtactactccacgaccggtgctcgatttagcacacgatagttgggtttggggctccttcaccacccagctgggatctcagggcttccttttctgtcctcctccaggatggggtcaacgccatcctcaccctctcctggctgttctccaaggagtctgtgccggtaagtcgcagctggtcgcgacggtccggagcgaggagggtagaaaaacggcccgggagtctcgtgagactctcgtaggtacggttnggtatacgtcgtttccagtctagtggtatccgtacggtggtcgccgacaaggaaccggtaccgggaaaggtccgtagggtaggtagggtacggtagggggagtagttgtactccgtaagtcgtaccgtctaccgaactacgtaccgtaactaccgacgttaccccgttaccgtaccggaacgtaccccgttaacgtaccgaactaaccgttaccgacgtaaccgtacgttaacgaaacccggtaacgtttacccgaactaacccgggtaacgttaaccgttcccgttaccccgtttacccgtcggtaacgtacgggggttccgaacccgtacggtaaccgggtccgggttaacgggacccggttacccgggtacccgtaacccggacccggtttacccgtaaagtttacccggttaacgtttacccgggtcgttacgggacccgtttaaacgggttccccggtttacgtaacccggtcccggttacaccggtttaaccggtacctttaaccgtaccgttaaccggttaaccggtaccggtgtttaaccgggccgttacggggtacccggacggtaaccgggtaaaccccg

SEQ ID NO: 251306 - DNA, 804 bp, Homo sapiens
  misc_feature: GYAE6OF02GGYKB.16.35.D02.1.454.CMB.1.raw
tcagtgtactactccacgaccggtgctcgatttagcacacgatagttgggtttggggctccttcaccacccagctgggatctcagggcttccttttctgtcctcctccaggatggggtcaaccgccatcctcaccctctcctggctgttctccaaggagtctgtgccgaagtgcagctggtgcaggtccggagcaggtaggtaggaaaaacggcccgggggtagtctctggaaggatctcctggtaaggttctggatacgtacggttttccagtctacgtggatcctacgtggtgcgccagacgaccccggtaaggcgtggagtggagtgggggacggtagttagactacccgtgtcgactctcgacgatacaactacgaccgtcccgtcttaccacggcctacgtcccacctactcctagacgtcgtcgaacctacgtctaactactacgttactccgtcccttccgcgtacttcggggtacgcccgtcgacggttacccggtaggggtacccggtaccccgtccggtaaaccccgccgtaccccgtaaaagttttaacctacggttttaaccgttacgggtaccgggttaacccgggttacgggtttaccccgggtttactccccgggggtacccgtaccgggttaaccttaacgggttccccctttaaaacggttttaaccgtttaacccccgttacccgggttttaaacccggggtttacgttttaacccgggggtccccgggtttacccggggtaaccccggggggaaccctttaaaaccccggggggttaccccccgg

SEQ ID NO: 251307 - DNA, 818 bp, Homo sapiens
  misc_feature: GYAE6OF01CO4OX.45.18.B07.1.454.CMB.1.raw
  modified_base (807)..(807): a, c, t, g, unknown or other
  misc_feature (807)..(807): n is a, c, g, or t
tcagacgcgatcgacacgaccggtgctcgatttagtcgctgcgtaaagggaaggaaaggggcagtaagtctctctcgagtacaaggacacagacatggacatgagggtccctgctcagtcctccgtgggactctgctgctctggctcccagactaccagatgtcgacctccagactcgaccctagtctccatcctacgtgtcctcgcctcgtggttacggacgtacgagacgtcaccatcctacgttggcccgggacgtagtcgaaggtactaagttacgaactaagtttacgtcggttacggtcgttaggtactacgaacggtaaccgtaaaaaaccgtacgggtaaacgtttaccgttaagggttaccgtttacgggttaccttaacgttcggtcgttacggtttacccttaaacgttaaaccggtttttaccgggtaaccgggttttccggggggttaccccttacgtttaccggttaactttaccggacggtaccggtacgtaacgggttcgggttaccggttacgggaacctaaccgttactttaccgaccgttcctacctaacctagttaccgacggtaccgtaacgtccgttacggaacctcggacccgttaggtacttagtactttttaccgaactttaaacgtttacgttaaccgtacgtaacccggtaaacgtagttaacgttaacgttaacgtttaaccggttacgttaaccggttacggtaccggtaacccgggtaaggtaccggtaaacgggtaacgtaaactacggttaaacaacgttcgtacgcgtactacnccgtacttccg

SEQ ID NO: 251308 - DNA, 679 bp, Homo sapiens
  misc_feature: GYAE6OF02GTQMI.45.18.B07.1.454.CMB.1.raw
tcagacgcgatcgacacgaccggtgctcgatttagtcgctgcgtaaagggaggaaagggggcagaagtctctctcagtcaggacacagcatggacatgagggtccctggctcagctcgtgggactcctgctgctctggctcccagataccagatgtgacctccagatgacccagtctccatcctacgtgtctgcctctgttggagacagacgtcaccatctacttggccgggcgagtcaggacattagactaattatgtaggctggtatcagacaaaaccgagggtaacttacgtaaggtcttggtactagtgtctgtctactaactttacgtacgttccggggtcctcgtcgtacttcgacgcggtctaggttgggtccgtgggacctactacgtttaccaccttctaccaaccacgttacaaaccgtagttcctaggtcccgaacgtcccgtagggtaacggtagtttacggtttacgaccttaaactttacgttaacgttacggtaaaccgtaaagttaccggttttaacccggttcggtttcccgtaccgtacgtttaccggtttaccgggacgggtaaccgggaccgtaagggttacggaacggtaaccttaaccggaaacggtaccgtttgggttacggccgtttaacgacccctaacgtacgttcgttacgg

SEQ ID NO: 251309 - DNA, 647 bp, Homo sapiens
  misc_feature: GYAE6OF02IJCLJ.45.18.B07.1.454.CMB.1.raw
  modified_base (184)..(184): a, c, t, g, unknown or other
  misc_feature (184)..(184): n is a, c, g, or t
  modified_base (235)..(235): a, c, t, g, unknown or other
  misc_feature (235)..(235): n is a, c, g, or t
  modified_base (274)..(274): a, c, t, g, unknown or other
  misc_feature (274)..(274): n is a, c, g, or t
  modified_base (305)..(305): a, c, t, g, unknown or other
  misc_feature (305)..(305): n is a, c, g, or t
tcagacgcgatcgacacgaccggtgctcgatttagtcgctgcgtaaaggaggaaaggggacccaaaaaccacacccctcctcgggagaatcccctagatcacagctcctcaccatggactggacctggagcatccttttcttggtggcagcagcaacaggtgcccactccaggtccagctggtncagtctggagctgaggtgaagagccgtggggcctcgagtgagggtctccgngcgcgacttcgaggtctcgctttacgatcagttggttcngtcgtgggtgacgacgacgggtaccccgganacggtacttggagtagggataggatggatcgagacgaacaaacgtagtcggagaacacaccagtatgacacgaaggtaacgggttccgggatacggtacgttccttcgttacggaaccctatacgtaccaacgtactaccggaacggacggtaacacgtaccgttaacggttagggtacggttagacgtacgtacgccgtagaaccgtactcgtacgaccgacgaccggtccttacgttaacttcgtacgtacgacgtaacggacggtacgtaacgtacggtaactcccgtaggtaccggacggtacggtaccgggaccgaacgggtaccctacggtaccgg

SEQ ID NO: 251310 - DNA, 820 bp, Homo sapiens
  misc_feature: GYAE6OF02JBALW.45.18.B07.1.454.CMB.1.raw
  modified_base (194)..(194): a, c, t, g, unknown or other
  misc_feature (194)..(194): n is a, c, g, or t
tcagacgcgatcgacacgaccggtgctcgatttagtcgctgcgtaaaggaggaaagggggcagaagtctctctcagtcaggacacagcatggacatgagggttcctgctcagctcctggactcctgctgctcgtggcctccagactaccagatgtcgacctcagactcgaccctagtctacatcctacgtgtcncgcctacgtgttacgacgacagacgtcaacctagtaccacgttcggcccgggataacgtcgaacggtaactacgttacgaacctaagttaacgtacggtaacgtcgtaggttactacgtaacgtaaccgtaaaaacgtagggtaaaccgttacgttaaacggttccttaacggttaccgtaagttcggtacgtttacgtaccgttaaccgttaaacgttttaaccgtaccgggtttaccgggggttccctaacgttccgggtaacttacggtacggtaccgggtacgttaacgggttcggttaccgtacgggtaaaccacgttaacttttaccgaaccgtttcgtaaccgtacccggtaaataccgtaaaccgttaaccgttccgttacgaacgtacggtaaacccggttaggtagttaaccggtttagtaccggttaacttaacccgtttaaggtacccgtagtaaaccccgttaaaggtaaccgtttaaccggttcggtttacccgacttaaccgttaccggtacggaccggttacgggaacgtcggtaacgtaccggtaaacgtagtaaaaccgggtcgttacgggtacccgtagttaccgaccgtactaaccgttcgttccg

SEQ ID NO: 251311 - DNA, 137 bp, Homo sapiens
  misc_feature: GYAE6OF01EF6NA.4.41.D08.1.454.CMB.1.raw
  modified_base (135)..(137): a, c, t, g, unknown or other
  misc_feature (135)..(137): n is a, c, g, or t
tcagagcactgtagcacgaccggtgctcgatttagtcacgcgagaaagggaaagggagaacttgacaaacttgatggtcttcatcttcccgccatctgactacagtgctctgagcgggctggcaaggcgcatagnnn

SEQ ID NO: 251312 - DNA, 135 bp, Homo sapiens
  misc_feature: GYAE6OF02G34BC.4.41.D08.1.454.CMB.1.raw
  modified_base (135)..(135): a, c, t, g, unknown or other
  misc_feature (135)..(135): n is a, c, g, or t
tcagagcactgtagcacgaccggtgctcgatttagtcacgcgagaaagggaaagggagaacttgacaaacttgatggtcttcatcttcccgccatctgactacagtgctctgagcgggctggcaaggcgcatagn

SEQ ID NO: 251313 - DNA, 123 bp, Homo sapiens
  misc_feature: GYAE6OF02G4641.4.41.D08.1.454.CMB.1.raw
  modified_base (123)..(123): a, c, t, g, unknown or other
  misc_feature (123)..(123): n is a, c, g, or t
tcagagcactgtagcacgaccggtgctcgatttagtcacgcgagaaagggaaaggggccctgacgtgtttctgttcccgccctcctcctacagtgctctgagcgggctggcaaggcgcatagn

SEQ ID NO: 251314 - DNA, 135 bp, Homo sapiens; identical to SEQ ID NO: 251312
  misc_feature: GYAE6OF02H9AVZ.4.41.D08.1.454.CMB.1.raw
  modified_base (135)..(135): a, c, t, g, unknown or other
  misc_feature (135)..(135): n is a, c, g, or t

SEQ ID NO: 251315 - DNA, 125 bp, Homo sapiens
  misc_feature: GYAE6OF02IEEDB.4.41.D08.1.454.CMB.1.raw
  modified_base (124)..(125): a, c, t, g, unknown or other
  misc_feature (124)..(125): n is a, c, g, or t
tcagagcactgtagcacgaccggtgctcgatttagtcacgcgagaaagggaaagggggccctgacgtgtttctgttcccgccctcctcctacagtgctctgagcgggctggcaaggcgcatagnn

SEQ ID NO: 251316 - DNA, 527 bp, Homo sapiens
  misc_feature: GYAE6OF02IX1GD.4.41.D08.1.454.CMB.1.raw
  modified_base (137)..(139): a, c, t, g, unknown or other
  misc_feature (137)..(139): n is a, c, g, or t
  modified_base (142)..(144): a, c, t, g, unknown or other
  misc_feature (142)..(144): n is a, c, g, or t
  modified_base (154)..(154): a, c, t, g, unknown or other
  misc_feature (154)..(154): n is a, c, g, or t
  modified_base (159)..(159): a, c, t, g, unknown or other
  misc_feature (159)..(159): n is a, c, g, or t
  modified_base (161)..(161): a, c, t, g, unknown or other
  misc_feature (161)..(161): n is a, c, g, or t
  modified_base (165)..(165): a, c, t, g, unknown or other
  misc_feature (165)..(165): n is a, c, g, or t
  modified_base (169)..(169): a, c, t, g, unknown or other
  misc_feature (169)..(169): n is a, c, g, or t
  modified_base (178)..(178): a, c, t, g, unknown or other
  misc_feature (178)..(178): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
tcagagcactgtagcacgaccggtgctcgatttagtcacgcgagaaagggaaagggagaacttgacaaacttgatggtcttcatcttcccgcatctgactacagtcgctctgagcgggctgggcaagggcgcatagnnngcnnncgcgactgcngctcncncgcncgcncagcacgcngcgactgacncncgngcngacnctcgcacgtgctgcagcngtcgncgtctnccgtnaaccggtnacgngtaacgcgnacgacggctcgctcgaacgcgcgtacgcgttcaaacgtacgtcgtcgacgcgtcgacgtacgtcgcgtcgtacgtcgtcgtacgtcgtcgtcgcgcgtcgacgtacgtacgtacgtacgtcgtcgacgtcgtcgacgacgtacgtcgtacgtacgtcgtacgtcgacgtcgtacgtcgtcgtcgtcgtacgcgtcgtcgtacgtacgtacgtacgtcgtcgtacgtcgcgtcgtacgacgtacggtcacgtacctacgtacgtacgacgacg

SEQ ID NO: 251317 - DNA, 219 bp, Homo sapiens
  misc_feature: GYAE6OF01CR4AN.25.28.C06.1.454.CMB.1.raw
  modified_base (217)..(219): a, c, t, g, unknown or other
  misc_feature (217)..(219): n is a, c, g, or t
tcagactgtacagtcacgaccggtgctcgatttagagctcacgtattgggtttggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnnn

SEQ ID NO: 251318 - DNA, 214 bp, Homo sapiens
  misc_feature: GYAE6OF01C2DES.25.28.C06.1.454.CMB.1.raw
  modified_base (213)..(214): a, c, t, g, unknown or other
  misc_feature (213)..(214): n is a, c, g, or t
tcagactgtacagtcacgaccggtgctcgatttagagctcacgtattgggtttgggaagaggaagactgacggtcctccaggagttcaggtgctggcaccttggcacggggaggtgtgtcacaagatttgggctctgggcacagcggccctgggctgcctggtcaaggactacttccactgtacagtctgagcgggctggcaaggcgcatagnn

SEQ ID NO: 251319 - DNA, 218 bp, Homo sapiens
  misc_feature: GYAE6OF01EKWX3.25.28.C06.1.454.CMB.1.raw
  modified_base (217)..(218): a, c, t, g, unknown or other
  misc_feature (217)..(218): n is a, c, g, or t
tcagactgtacagtcacgaccggtgctcgatttagagctcacgtattgggtttggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnn

SEQ ID NO: 251320 - DNA, 255 bp, Homo sapiens
  misc_feature: GYAE6OF01A7QD8.25.28.C06.1.454.CMB.1.raw
  modified_base (255)..(255): a, c, t, g, unknown or other
  misc_feature (255)..(255): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcaccgtctggggcacagcggccctgggctgcctggtcaaggctacttccactgtacagtctgagcgggctggcaaggcgcatgn

SEQ ID NO: 251321 - DNA, 221 bp, Homo sapiens
  misc_feature: GYAE6OF01BM6WR.25.28.C06.1.454.CMB.1.raw
  modified_base (218)..(221): a, c, t, g, unknown or other
  misc_feature (218)..(221): n is a, c, g, or t
tcagactgtacagtcacgaccggtgctcgatttagagctcacgtattggggtttggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnnnn

SEQ ID NO: 251322 - DNA, 277 bp, Homo sapiens
  misc_feature: GYAE6OF01BPF44.25.28.C06.1.454.CMB.1.raw
  modified_base (260)..(277): a, c, t, g, unknown or other
  misc_feature (260)..(277): n is a, c, g, or t
tcagactgtacagtcacgaccggtgctcgatttagagctcacgtattgggtttgggacagaattcactctcaccatcagcagcctgcagcctgaagatgttgcaacgttattactgtcaaaaatttgacagtgacccgtggactgttcggcccagggaccaaggtggacatcaaacgaactgtggctgctaccatcgtgtcgttcatcttcccgccagtcgtgaactgtacagtctgagcgggctggcaaggcgcatagnnnnnnnnnnnnnnnnnn

SEQ ID NO: 251323 - DNA, 218 bp, Homo sapiens; identical to SEQ ID NO: 251319
  misc_feature: GYAE6OF01BOPGL.25.28.C06.1.454.CMB.1.raw
  modified_base (217)..(218): a, c, t, g, unknown or other
  misc_feature (217)..(218): n is a, c, g, or t

SEQ ID NO: 251324 - DNA, 219 bp, Homo sapiens
  misc_feature: GYAE6OF01AOXE9.25.28.C06.1.454.CMB.1.raw
  modified_base (218)..(219): a, c, t, g, unknown or other
  misc_feature (218)..(219): n is a, c, g, or t
tcagactgtacagtcacgaccggtgctcgatttagagctcacgtattgggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnn

SEQ ID NO: 251325 - DNA, 252 bp, Homo sapiens
  misc_feature: GYAE6OF01CO80C.25.28.C06.1.454.CMB.1.raw
  modified_base (252)..(252): a, c, t, g, unknown or other
  misc_feature (252)..(252): n is a, c, g, or t
tcagactgtacagtcacgaccggtgctcgatttagagctcacgtattgggtttgggacagaattcactctcaccatcagcagcctgcagcctgaagatgttgcaacttattactgtacaaaatttgacagtgaccgtggatgttcggcccagggaccaaggtggacatcaaacgaactgtggctgcaccatctgtcttcatcttcccgccatctgaactgtacagtctgagcgggctggcaaggcgcatagn

SEQ ID NO: 251326 - DNA, 221 bp, Homo sapiens
  misc_feature: GYAE6OF01CH3B5.25.28.C06.1.454.CMB.1.raw
  modified_base (218)..(221): a, c, t, g, unknown or other
  misc_feature (218)..(221): n is a, c, g, or t
tcagactgtacagtcacgaccggtgctcgatttagagctcacgtattgggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnnnn

SEQ ID NO: 251327 - DNA, 293 bp, Homo sapiens
  misc_feature: GYAE6OF01C6HDF.25.28.C06.1.454.CMB.1.raw
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (254)..(256): a, c, t, g, unknown or other
  misc_feature (254)..(256): n is a, c, g, or t
  modified_base (259)..(293): a, c, t, g, unknown or other
  misc_feature (259)..(293): n is a, c, g, or t
tcagactgtacagtcacgaccggtgctcgatttagagctcacgtattgggtttgggacgagaattcactctcaccatcaggcagcctgcagcctgaagatgttgcaacttattactgtcaaaaatttgacagtgacccgtggatgttcggcccagggtaccaaggtggacatcaaacgaactgtggctgcaccatctgtcttcatcttcccgcatctgaactgtacagtctgagcggntggcaaggcncatagnnncannnnnnnnnnnnnnnnnnnnnnnnnnnnnnnnnnn

SEQ ID NO: 251328 - DNA, 566 bp, Homo sapiens
  misc_feature: GYAE6OF01BZE88.25.28.C06.1.454.CMB.1.raw
  modified_base (276)..(276): a, c, t, g, unknown or other
  misc_feature (276)..(276): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctgggctcccagcttatcagatgtggcatccagatgacccagtctccatcctcctgtctggcatctgttggagacgagagtccaccatccacttgccgggcagtcagggcattggaaattatttggcctggtatcagcagaaaccngggaaagtcctaacctctcatctatgctgcatccactttgctaagtttggggtacccctctcgtaatttcaggcggctaggtcgggtctgggtacagtacttcactctacacccatcagcagcctgcaagccgtagaactatgttgactaacttattactgttaactaaaatttcgaacgtagttacgacccggttagggtacttcggttaccgggacccgtaaggggtaacccgaagggttacggaaccgtaacgttaacccggaaaaccgtaacgtcggttaaccggg

SEQ ID NO: 251329 - DNA, 256 bp, Homo sapiens
  misc_feature: GYAE6OF01AUVP7.25.28.C06.1.454.CMB.1.raw
  modified_base (252)..(256): a, c, t, g, unknown or other
  misc_feature (252)..(256): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttccgccatctgaactgtacagtctgagcgggctggcaaggcgcatagnnnnn

SEQ ID NO: 251330 - DNA, 491 bp, Homo sapiens
  misc_feature: GYAE6OF01D9MNB.25.28.C06.1.454.CMB.1.raw
  modified_base (330)..(330): a, c, t, g, unknown or other
  misc_feature (330)..(330): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggcctggtatcagcagaaaccagggaaagttcctaacctcctcatctatgctgcatccactttgcaatttggggtccctntcgattcagcggcagtgggtctgggacagaattcactctcaccatcagcagcctgcagcctgaagatgttgcaacttattactgttacaaaatttgaacagtgacccgtggagtgttcggcccgagggaccaaggtcggacaatacaaacgacgtgtacgg

SEQ ID NO: 251331 - DNA, 219 bp, Homo sapiens
  misc_feature: GYAE6OF01CSSXK.25.28.C06.1.454.CMB.1.raw
  modified_base (218)..(219): a, c, t, g, unknown or other
  misc_feature (218)..(219): n is a, c, g, or t
tcagactgtacagtcacgaccggtgctcgatttagagctcacgtattggggtttggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnn

SEQ ID NO: 251332 - DNA, 253 bp, Homo sapiens
  misc_feature: GYAE6OF01EEI99.25.28.C06.1.454.CMB.1.raw
  modified_base (253)..(253): a, c, t, g, unknown or other
  misc_feature (253)..(253): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgccatctgaactgtacagtctgagcgggctggcaaggcgcatagn

SEQ ID NO: 251333 - DNA, 224 bp, Homo sapiens
  misc_feature: GYAE6OF01C2BE7.25.28.C06.1.454.CMB.1.raw
  modified_base (218)..(224): a, c, t, g, unknown or other
  misc_feature (218)..(224): n is a, c, g, or t
tcagactgtacagtcacgaccggtgctcgatttagagctcacgtattgggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnnnnnnn

SEQ ID NO: 251334 - DNA, 258 bp, Homo sapiens
  misc_feature: GYAE6OF01A8X4F.25.28.C06.1.454.CMB.1.raw
  modified_base (257)..(258): a, c, t, g, unknown or other
  misc_feature (257)..(258): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctgggggcacagcggccctgggctgcctggtcaaggactacttccactgtacagtctgagcgggctggcaaggcgcatagnn

SEQ ID NO: 251335 - DNA, 259 bp, Homo sapiens
  misc_feature: GYAE6OF01A6EQF.25.28.C06.1.454.CMB.1.raw
  modified_base (225)..(259): a, c, t, g, unknown or other
  misc_feature (225)..(259): n is a, c, g, or t
tcagactgtacagtcacgaccggtgctcgatttagagctcacgtattggggtttgggggaagaggaagactgacggtcctcccaggagttcaggtgctgggccaccttgggcacgggggaggtggtgtccacaagtatttgggctcgtgggcacgagcggccctgggctgcctggtcaaggctacttccactgtacagtctgagcgggctggcaaggcgcatagnnnnnnnnnnnnnnnnnnnnnnnnnnnnnnnnnnn

SEQ ID NO: 251336 - DNA, 284 bp, Homo sapiens
  misc_feature: GYAE6OF01CMXFF.25.28.C06.1.454.CMB.1.raw
  modified_base (260)..(284): a, c, t, g, unknown or other
  misc_feature (260)..(284): n is a, c, g, or t
tcagactgtacagtcacgaccggtgctcgatttagagctcacgtattgggtttgggacgagaattcactctcaccatcagcagcctgcaggccctggaagatggttgcaacttattactgtcaaaaatttggacagtgacccgtggatgttcgggcccagggaccaaggtggacatcaaacgaactgtggctgcaccatcctgtcttcatcttccgcaatctgaactgtacagtctgagcgggctggcaaggcgcatagnnnnnnnnnnnnnnnnnnnnnnnnn

SEQ ID NO: 251337 - DNA, 221 bp, Homo sapiens
  misc_feature: GYAE6OF01CQ721.25.28.C06.1.454.CMB.1.raw
  modified_base (219)..(221): a, c, t, g, unknown or other
  misc_feature (219)..(221): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnn

SEQ ID NO: 251338 - DNA, 253 bp, Homo sapiens
  misc_feature: GYAE6OF01AZFVD.25.28.C06.1.454.CMB.1.raw
  modified_base (252)..(253): a, c, t, g, unknown or other
  misc_feature (252)..(253): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgcatctgaactgtacagtctgagcgggctggcaaggcgcatagnn

SEQ ID NO: 251339 - DNA, 261 bp, Homo sapiens
  misc_feature: GYAE6OF01BKWSO.25.28.C06.1.454.CMB.1.raw
  modified_base (258)..(261): a, c, t, g, unknown or other
  misc_feature (258)..(261): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctgggggcacagcggccctgggctgcctggtcaaggactacttccgactgtacagtctgagcgggctggcaaggcgcatagnnnn

SEQ ID NO: 251340 - DNA, 221 bp, Homo sapiens; identical to SEQ ID NO: 251337
  misc_feature: GYAE6OF01BFUPU.25.28.C06.1.454.CMB.1.raw
  modified_base (219)..(221): a, c, t, g, unknown or other
  misc_feature (219)..(221): n is a, c, g, or t

SEQ ID NO: 251341 - DNA, 253 bp, Homo sapiens
  misc_feature: GYAE6OF01D3HA1.25.28.C06.1.454.CMB.1.raw
  modified_base (252)..(253): a, c, t, g, unknown or other
  misc_feature (252)..(253): n is a, c, g, or t
tcagactgtacagtcacgaccggtgctcgatttagagctcacgtattgggtttgggacagaattcactctcaccatcagcagcctgcagcctgaagatgttgcaacttattactgtcaaaatttgacagtgacccgtggatgttcggcccagggaccaaggtggacatcaaacgaactgtggctgcaccatctgtcttcatcttcccgccatctgaactgtacagtctgagcgggctggcaaggcgcatagnn

SEQ ID NO: 251342 - DNA, 264 bp, Homo sapiens
  misc_feature: GYAE6OF01C62AL.25.28.C06.1.454.CMB.1.raw
  modified_base (256)..(264): a, c, t, g, unknown or other
  misc_feature (256)..(264): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctggggcacagcggccctgggctgcctggtcaaggactacttccactgtacagtctgagcgggctggcaaggcgcatagnnnnnnnnn

SEQ ID NO: 251343 - DNA, 217 bp, Homo sapiens
  misc_feature: GYAE6OF01EW4ZW.25.28.C06.1.454.CMB.1.raw
  modified_base (217)..(217): a, c, t, g, unknown or other
  misc_feature (217)..(217): n is a, c, g, or t
tcagactgtacagtcacgaccggtgctcgatttagagctcacgtattgggtttggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagn

SEQ ID NO: 251344 - DNA, 252 bp, Homo sapiens
  misc_feature: GYAE6OF01AV030.25.28.C06.1.454.CMB.1.raw
  modified_base (251)..(252): a, c, t, g, unknown or other
  misc_feature (251)..(252): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgcatctgaactgtacagtctgagcggctggcaaggcgcatagnn

SEQ ID NO: 251345 - DNA, 223 bp, Homo sapiens
  misc_feature: GYAE6OF01BCT5T.25.28.C06.1.454.CMB.1.raw
  modified_base (220)..(223): a, c, t, g, unknown or other
  misc_feature (220)..(223): n is a, c, g, or t
tcagactgtacagtcacgaccggtgctcgatttagagctcacgtattggggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnn

SEQ ID NO: 251346 - DNA, 222 bp, Homo sapiens
  misc_feature: GYAE6OF01BRQEG.25.28.C06.1.454.CMB.1.raw
  modified_base (219)..(222): a, c, t, g, unknown or other
  misc_feature (219)..(222): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnn

SEQ ID NO: 251347 - DNA, 254 bp, Homo sapiens
  misc_feature: GYAE6OF01AVLX1.25.28.C06.1.454.CMB.1.raw
  modified_base (252)..(254): a, c, t, g, unknown or other
  misc_feature (252)..(254): n is a, c, g, or t
tcagactgtacagtcacgaccggtgctcgatttagagctcacgtattgggtttgggacagaattcactctcaccatcagcagcctgcagcctgaagatgttgcaacttattactgtcaaaatttgacagtgacccgtggatgttcggcccagggaccaaggtggacatcaaacgaactgtggctgcaccatctgtcttcatcttcccgccatctgaactgtacagtctgagcgggctggcaaggcgcatagnnn

SEQ ID NO: 251348 - DNA, 251 bp, Homo sapiens
  misc_feature: GYAE6OF01DUDHT.25.28.C06.1.454.CMB.1.raw
  modified_base (249)..(251): a, c, t, g, unknown or other
  misc_feature (249)..(251): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggccagggaccaaggtggacatcaaacgactgtggctgcaccatctgtcttcatcttccgcatctgaactgtacagtctgagcgggctggcaaggcgcatagnnn

SEQ ID NO: 251349 - DNA, 253 bp, Homo sapiens
  misc_feature: GYAE6OF01C7670.25.28.C06.1.454.CMB.1.raw
  modified_base (251)..(253): a, c, t, g, unknown or other
  misc_feature (251)..(253): n is a, c, g, or t
tcagactgtacagtcacgaccggtgctcgatttagagctcacgtattgggtttgggacagaattcactctcaccatcagcagcctgcagcctgaagatgttgcaacttattactgtcaaaatttgacagtgacccgtggatgttcggcccagggaccaaggtggacatcaaacgaactgtggctgcaccatctgtcttcacttcccgccatctgaactgtacagtctgagcgggctggcaaggcgcatagnnn

SEQ ID NO: 251350 - DNA, 515 bp, Homo sapiens
  misc_feature: GYAE6OF01ACSKF.25.28.C06.1.454.CMB.1.raw
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
  modified_base (356)..(356): a, c, t, g, unknown or other
  misc_feature (356)..(356): n is a, c, g, or t
tcagactgtacagtcacgaccggtgctcgatttagagctcacgtattggggtttgggggacagaacgtctcgtctcacgtcaggacacagcatggacatgagggtccctgctcagctccttgggactcctgctgctctggctcccagcctatcagatgtggcatccagatgacccagtctccatcctccgtgtctgcatctgttgganacngagtcaccattcacttgccgggtcgagtcaggggcagttggaaattactttggcctggtatcagcagaaccgaggaatcctaagctcctgatctatgctgacctcctacgttacactcgacggggtcccagtctcggttcagcgnagtgaatcgtacgggacagtacgttcactctacactatcagctagcctgcagctagagtgtgtagactaacttattactgtactaaagtataatactacgtccctacttctacgtttcggcggtacggacctaagggtcgagatacgaaacgcgtacgg

SEQ ID NO: 251351 - DNA, 497 bp, Homo sapiens
  misc_feature: GYAE6OF01C4238.25.28.C06.1.454.CMB.1.raw
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (395)..(395): a, c, t, g, unknown or other
  misc_feature (395)..(395): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaattatttggcctggtatcagcagaaaccagggaaacgttcctaacctcctcatctatgctgcatccactttgctaatttggggccctntcgattcagcggnagtgggtctgggacagaattcactctcaccatcagcagcctgcagcctgagntgtagctaacttatactagtactaaatttgaactagtgacccgtggacgttggttcggcccgtagggaccaagggtcgacaatacgaaacgtactggtacgg

SEQ ID NO: 251352 - DNA, 257 bp, Homo sapiens
  misc_feature: GYAE6OF01C5TG6.25.28.C06.1.454.CMB.1.raw
  modified_base (254)..(257): a, c, t, g, unknown or other
  misc_feature (254)..(257): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggcccagggaccaaggtggacatcaaacgaactgtggctgcaccatctgtcttcatcttcccgccatctgaactgtacagtctgagcgggctggcaaggcgcatagnnnn

SEQ ID NO: 251353 - DNA, 252 bp, Homo sapiens
  misc_feature: GYAE6OF01CBYIT.25.28.C06.1.454.CMB.1.raw
  modified_base (251)..(252): a, c, t, g, unknown or other
  misc_feature (251)..(252): n is a, c, g, or t
tcagactgtacagtcacgaccggtgctcgatttagagctcacgtattgggtttgggacagaattcactctcaccatcagcagcctgcagcctgaagatgttgcaacttattactgtcaaaatttgacagtgacccgtggatgttcggcccagggaccaaggtggacatcaaacgaactgtggctgcaccatctgtcttcatcttcccgcatctgaactgtacagtctgagcgggctggcaaggcgcatagnn

SEQ ID NO: 251354 - DNA, 220 bp, Homo sapiens
  misc_feature: GYAE6OF01BTKC0.25.28.C06.1.454.CMB.1.raw
  modified_base (217)..(220): a, c, t, g, unknown or other
  misc_feature (217)..(220): n is a, c, g, or t
tcagactgtacagtcacgaccggtgctcgatttagagctcacgtattgggtttggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnnnn

SEQ ID NO: 251355 - DNA, 220 bp, Homo sapiens
  misc_feature: GYAE6OF01ET0QP.25.28.C06.1.454.CMB.1.raw
  modified_base (218)..(220): a, c, t, g, unknown or other
  misc_feature (218)..(220): n is a, c, g, or t
tcagactgtacagtcacgaccggtgctcgatttagagctcacgtattgggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnnn

SEQ ID NO: 251356 - DNA, 509 bp, Homo sapiens
  misc_feature: GYAE6OF01DOHPS.25.28.C06.1.454.CMB.1.raw
  modified_base (399)..(399): a, c, t, g, unknown or other
  misc_feature (399)..(399): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggcctggtatcagcaagaaaccagggaaacttcctaaacctcctcatctatgctgcatccactttgctaagtttcggggtccctctcgattcagcgcaggtggtctgggacagattcactctcacatcagcagcctgcagcctagaagntgttgactaacttattactagtaactaaaatttgaactagtacgacccgtggacgttcggttcggacccgagggacctaaggtcggtacataacaaacgacgtggtacgg

SEQ ID NO: 251357 - DNA, 255 bp, Homo sapiens
  misc_feature: GYAE6OF01EG2JU.25.28.C06.1.454.CMB.1.raw
  modified_base (253)..(255): a, c, t, g, unknown or other
  misc_feature (253)..(255): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggcccagggaccaaggtggacatcaaacgaactgtggctgcaccatctgtcttcatcttcccgcatctgaactgtacagtctgagcgggctggcaaggcgcatagnnn

SEQ ID NO: 251358 - DNA, 259 bp, Homo sapiens
  misc_feature: GYAE6OF01CLP6I.25.28.C06.1.454.CMB.1.raw
  modified_base (257)..(259): a, c, t, g, unknown or other
  misc_feature (257)..(259): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctgggggcacagcggccctgggctgcctggtcaaggactacttccactgtacagtctgagcgggctggcaaggcgcatagnnn

SEQ ID NO: 251359 - DNA, 222 bp, Homo sapiens
  misc_feature: GYAE6OF01DCIGM.25.28.C06.1.454.CMB.1.raw
  modified_base (219)..(222): a, c, t, g, unknown or other
  misc_feature (219)..(222): n is a, c, g, or t
tcagactgtacagtcacgaccggtgctcgatttagagctcacgtattggggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnnnn

SEQ ID NO: 251360 - DNA, 519 bp, Homo sapiens
  misc_feature: GYAE6OF01E4N3J.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccggcgagtcagggcattggaaattatttggcctggtatcagcagaaaccagggaaagttcctaacctcctcatctatgctgcatccactttgctaagtttcggggtccctctcgattcagcggcaggtgggtctgggacagaatcactctcacatcagcacgcctgcacgcctgaagatgtgactaacgttattactagttactaaaattgaacagtcgacccggtgtacgttcggttccgacccggacgggacccgaaagggtacggaacacgtaacaaacggtaacgtcggtacgg

SEQ ID NO: 251361 - DNA, 219 bp, Homo sapiens; identical to SEQ ID NO: 251324
  misc_feature: GYAE6OF01A2FY5.25.28.C06.1.454.CMB.1.raw
  modified_base (218)..(219): a, c, t, g, unknown or other
  misc_feature (218)..(219): n is a, c, g, or t

SEQ ID NO: 251362 - DNA, 251 bp, Homo sapiens
  misc_feature: GYAE6OF01DFNVK.25.28.C06.1.454.CMB.1.raw
  modified_base (251)..(251): a, c, t, g, unknown or other
  misc_feature (251)..(251): n is a, c, g, or t
tcagactgtacagtcacgaccggtgctcgatttagagctcacgtattgggtttgggacagaattcactctcaccatcagcagcctgcagcctgaagatgttgcaacttattactgtacaaaatttgacagtgacccgtggatgttcggccagggaccaaggtggacatcaaacgaactgtggctgcaccatctgtcttcatcttcccgcatctgaactgtacagtctgagcgggctggcaaggcgcatagn

SEQ ID NO: 251363 - DNA, 221 bp, Homo sapiens
  misc_feature: GYAE6OF01A6XMR.25.28.C06.1.454.CMB.1.raw
  modified_base (220)..(221): a, c, t, g, unknown or other
  misc_feature (220)..(221): n is a, c, g, or t
tcagactgtacagtcacgaccggtgctcgatttagagctcacgtattggggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnn

SEQ ID NO: 251364 - DNA, 255 bp, Homo sapiens
  misc_feature: GYAE6OF01BI7ZH.25.28.C06.1.454.CMB.1.raw
  modified_base (254)..(255): a, c, t, g, unknown or other
  misc_feature (254)..(255): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggcccagggaccaaggtggacatcaaacgaactgtggctgcaccatctgtcttcatcttcccgccatctgaactgtacagtctgagcgggctggcaaggcgcatagnn

SEQ ID NO: 251365 - DNA, 543 bp, Homo sapiens
  misc_feature: GYAE6OF01AGKG3.25.28.C06.1.454.CMB.1.raw
  modified_base (370)..(370): a, c, t, g, unknown or other
  misc_feature (370)..(370): n is a, c, g, or t
tcagactgtacagtcacgaccggtgctcgatttagagctcacgtattgggtttgggggaagaggaagactgacggtcctcccaggagttcaggtgctgggcaccttgggcacggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcgagtccgtgagggccattcaccatctccagggacaattccaagagaaccctntatctgcaaatgaacaacttgagagtcgagatacggccgtttattactgtgcgacctcaggagtgctaggaaaagtcgtagtctcattcccgtcgacctctgggccaggcacccgtgtccaccgtctcctcagccttccgacacgggcccatccggtccttccccgtggcccg

SEQ ID NO: 251366 - DNA, 254 bp, Homo sapiens
  misc_feature: GYAE6OF01C1GSI.25.28.C06.1.454.CMB.1.raw
  modified_base (253)..(254): a, c, t, g, unknown or other
  misc_feature (253)..(254): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggcccagggaccaaggtggacatcaaacgaactgtggctgcaccatctgtcttcatcttcccgcatctgaactgtacagtctgagcgggctggcaaggcgcatagnn

SEQ ID NO: 251367 - DNA, 252 bp, Homo sapiens
  misc_feature: GYAE6OF01DSDIN.25.28.C06.1.454.CMB.1.raw
  modified_base (250)..(252): a, c, t, g, unknown or other
  misc_feature (250)..(252): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttccgcatctgaactgtaaagtctgagcggctggcaaggcgcatagnnn

SEQ ID NO: 251368 - DNA, 259 bp, Homo sapiens
  misc_feature: GYAE6OF01CIZDD.25.28.C06.1.454.CMB.1.raw
  modified_base (256)..(259): a, c, t, g, unknown or other
  misc_feature (256)..(259): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctggggcacagcggccctgggctgcctggtcaaggactacttccactgtacagtctgagcgggctggcaaggcgcatagnnnn

SEQ ID NO: 251369 - DNA, 255 bp, Homo sapiens
  misc_feature: GYAE6OF01A1J8A.25.28.C06.1.454.CMB.1.raw
  modified_base (253)..(255): a, c, t, g, unknown or other
  misc_feature (253)..(255): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgccatctgaactgtacagtctgagcgggctggcaaggcgcatagnnn

SEQ ID NO: 251370 - DNA, 253 bp, Homo sapiens; identical to SEQ ID NO: 251341
  misc_feature: GYAE6OF01DPYQA.25.28.C06.1.454.CMB.1.raw
  modified_base (252)..(253): a, c, t, g, unknown or other
  misc_feature (252)..(253): n is a, c, g, or t

SEQ ID NO: 251371 - DNA, 263 bp, Homo sapiens
  misc_feature: GYAE6OF01CMFVN.25.28.C06.1.454.CMB.1.raw
  modified_base (258)..(263): a, c, t, g, unknown or other
  misc_feature (258)..(263): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttccccctggcgccctgctccaggagcacctctgggggcacagcggccctgggctgcctggtcaaggactacttccactgtacagtctgagcgggctggcaaggcgcatagnnnnnn

SEQ ID NO: 251372 - DNA, 580 bp, Homo sapiens
  misc_feature: GYAE6OF01CCBSK.25.28.C06.1.454.CMB.1.raw
  modified_base (378)..(378): a, c, t, g, unknown or other
  misc_feature (378)..(378): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaagggggctggagtggctgggagttacttggtctgacagacaaatgacatatcacgcggagtccgtgaggggccgattcaccatctccagggacaattccaaagacgaaccctntatctgacaaatgaaacaacttgagagtcgaggatacggtcgttattactgtgcgactcaggagtggctaggaaaagtcgtagtctctacttcccgtacgtacctcgtcgggccgagggccacccgtggtccacccgtcgtccctcacgccttcccgaacccgaacgggcccaacgtcccggtcccttccccgtcggtcccg

SEQ ID NO: 251373 - DNA, 252 bp, Homo sapiens
  misc_feature: GYAE6OF01BX37B.25.28.C06.1.454.CMB.1.raw
  modified_base (252)..(252): a, c, t, g, unknown or other
  misc_feature (252)..(252): n is a, c, g, or t
tcagactgtacagtcacgaccggtgctcgatttagagctcacgtattgggtttggtacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgcatctgaactgtacagtctgagcgggctggcaaggcgcatagn

SEQ ID NO: 251374 - DNA, 282 bp, Homo sapiens
  misc_feature: GYAE6OF01B1AWS.25.28.C06.1.454.CMB.1.raw
  modified_base (263)..(282): a, c, t, g, unknown or other
  misc_feature (263)..(282): n is a, c, g, or t
tcagactgtacagtcacgaccggtgctcgatttagagctcacgtattgggtttgggggaagaggaagactcgacggtcctcccaggagttcaggtgctgggcaccctggtcaccgtctcctcagcttccaccaagggcccatcggtcttccccctggcgccctgcttccaggagcaccttcgtggggcacagcggccctgggctgcctggtcaaggactacgttccactgtacagtctggagcgggctggcaaggcgcatagnnnnnnnnnnnnnnnnnnnn

SEQ ID NO: 251375 - DNA, 536 bp, Homo sapiens
  misc_feature: GYAE6OF01AYD29.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcaggcattggaaattatttggccttggtatcagcagaaaccaggtagagttcctaagctcctgatctatgctgcctccacgtacactcgacgggtcccagtctcggtcagtcggcagtgaatcgtgggacagtagttcacgtctacactatcagcacgcctgcacgcctagaagtctagttacgtactaacttagtttactagtaactaaaagtataactactacgtaccccttcttacctacggtttccgggacgggtaacgggaacccgtaaggtacgggtaagacgtaacgtaaacggtaacg

SEQ ID NO: 251376 - DNA, 219 bp, Homo sapiens
  misc_feature: GYAE6OF01E4QPK.25.28.C06.1.454.CMB.1.raw
  modified_base (219)..(219): a, c, t, g, unknown or other
  misc_feature (219)..(219): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagn

SEQ ID NO: 251377 - DNA, 222 bp, Homo sapiens
  misc_feature: GYAE6OF01DHI4V.25.28.C06.1.454.CMB.1.raw
  modified_base (194)..(194): a, c, t, g, unknown or other
  misc_feature (194)..(194): n is a, c, g, or t
  modified_base (217)..(222): a, c, t, g, unknown or other
  misc_feature (217)..(222): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtngacggcgtgcgacgaggcatagnnnnnn

SEQ ID NO: 251378 - DNA, 255 bp, Homo sapiens; identical to SEQ ID NO: 251357
  misc_feature: GYAE6OF01B6J06.25.28.C06.1.454.CMB.1.raw
  modified_base (253)..(255): a, c, t, g, unknown or other
  misc_feature (253)..(255): n is a, c, g, or t

SEQ ID NO: 251379 - DNA, 613 bp, Homo sapiens
  misc_feature: GYAE6OF01BOSA1.25.28.C06.1.454.CMB.1.raw
  modified_base (201)..(201): a, c, t, g, unknown or other
  misc_feature (201)..(201): n is a, c, g, or t
  modified_base (353)..(353): a, c, t, g, unknown or other
  misc_feature (353)..(353): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgganacagagtcaccatcacttcggccgggcgagtcgagggctagttaggaaatttagtttggccttggtatcgagcaagaaaaccgagggtaaacgttccctaacctcctactatctatgctgctactcctactttgactagtttcgggtccctntcgtattcgagcgcgtaggtcgggtgtacgggtacgtaacgtaacgtttcaaccttccgtacctaaccctacttcgaacgtccacgtccgttcggacctacgccgtagaacgtgttacgttacgaccttaaacgtttacgttaacgtagttaaacttaaaagttcaacgtaacgtacggtacccgtggtaacgttcgggtaccgacccggtacgggaaccgtaaggacgtaactaacgtacgaaacgtccgtggtaccgg

SEQ ID NO: 251380 - DNA, 587 bp, Homo sapiens
  misc_feature: GYAE6OF01DHKJF.25.28.C06.1.454.CMB.1.raw
  modified_base (226)..(226): a, c, t, g, unknown or other
  misc_feature (226)..(226): n is a, c, g, or t
  modified_base (291)..(291): a, c, t, g, unknown or other
  misc_feature (291)..(291): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctccctgtctgcatctgttgagacagagtcaccatcacttgccgggnagtcaggcattggaaatttgttggctggtatcagcaagaaaccagggtaacttcctaactcctanatctatgctgacatcctactttgctaagttttcgggcccttctcgtattcgagtcgcgtaggtggtctgggacagtaacttcgactctacaccatacagcacgccgtgccgtacgcctaggaagtagttcgttacgtaaccgtaacttttacgtttaacgttacgttaaactttaaaaatttcggaacgttaggtaccggtaacccggttaggtacgtttccggttaccgggacccggtaacgggaacccgtaaaggtccggtaactaacgtaaccgaaaccgtaggtcggtacgg

SEQ ID NO: 251381 - DNA, 257 bp, Homo sapiens
  misc_feature: GYAE6OF01CFJLK.25.28.C06.1.454.CMB.1.raw
  modified_base (256)..(257): a, c, t, g, unknown or other
  misc_feature (256)..(257): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctggggcacagcggccctgggctgcctggtcaaggactacttccactgtacagtctgagcgggctggcaaggcgcatagnn

SEQ ID NO: 251382 - DNA, 261 bp, Homo sapiens
  misc_feature: GYAE6OF01A552Y.25.28.C06.1.454.CMB.1.raw
  modified_base (256)..(261): a, c, t, g, unknown or other
  misc_feature (256)..(261): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctggggcacagcggccctgggctgcctggtcaaggactacttccactgtacagtctgagcgggctggcaaggcgcatagnnnnnn

SEQ ID NO: 251383 - DNA, 709 bp, Homo sapiens
  misc_feature: GYAE6OF01AQ9T9.25.28.C06.1.454.CMB.1.raw
  modified_base (203)..(203): a, c, t, g, unknown or other
  misc_feature (203)..(203): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcctccatccctcctgtctgcatctggttgganacagagtccaccatcgacttggccgggcgagtcagggcattggaaattatttggcctggtatcagcagaaacagggaaacgttcctaacctcctcatctatgctgcactccactttcgcttaagtttcggggtccctctcgtacttcgacgcgggctaggttgggtcgtacgggaacacggtaattccaacttccttaccacctacttccgaagcgaacgccttacggaccgacgtacccgtaggtaacgtaagtttcgggtttacgtaaccgttaaaccgtttttaactttaaaccgtttaacgttttaaacgttaaaaaacgtttttacggaaaccttaagggttaccgggttaaaccccggttacgggttaaacggttttccgggttttaaccccggggaccccggttaaacgggggaaaccccgttaaacgggggttaacggtaaaccgttaaacggttaaaccgtaaaaacccgggttaacgttacggggttaaacccggg

SEQ ID NO: 251384 - DNA, 254 bp, Homo sapiens; identical to SEQ ID NO: 251366
  misc_feature: GYAE6OF01BI9MP.25.28.C06.1.454.CMB.1.raw
  modified_base (253)..(254): a, c, t, g, unknown or other
  misc_feature (253)..(254): n is a, c, g, or t

SEQ ID NO: 251385 - DNA, 544 bp, Homo sapiens
  misc_feature: GYAE6OF01A32K1.25.28.C06.1.454.CMB.1.raw
  modified_base (332)..(332): a, c, t, g, unknown or other
  misc_feature (332)..(332): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattattggcctggtatcagcagaaaccgagggaaagttcctaaacctcctcatctatgctgcatccactttgctaatttcggggccctntcgtattcgagcggctaggtcgggtctgggacagtacttcgactctcaccatcagcagcctgctacgcctagaagagtgttcgaccttaactttagttactagttaactaaaagtttgaactaggttacgacccggttggtacttcggttcccggacccgtaagggacccgtaagggtcgtaacgtactaacgaaacgtacgtggtaacggg

SEQ ID NO: 251386 - DNA, 325 bp, Homo sapiens
  misc_feature: GYAE6OF01B4VWG.25.28.C06.1.454.CMB.1.raw
  modified_base (257)..(257): a, c, t, g, unknown or other
  misc_feature (257)..(257): n is a, c, g, or t
  modified_base (260)..(325): a, c, t, g, unknown or other
  misc_feature (260)..(325): n is a, c, g, or t
tcagactgtacagtcacgaccggtgctcgatttagagctcacgtattgggtttgggacagaattcactctcaccatcagcagcctcgcagccctgaagatgttgcaacttattactgtcaaaaatttgacagtgacccgtggatgtcggcccagggaccaaggtggacatcaaaacgaactgtggctgcaccatctgtcttcatccttcccgcatctgaactgtacagtctgagcgggctggcaaggccgcatacgntcnnnnnnnnnnnnnnnnnnnnnnnnnnnnnnnnnnnnnnnnnnnnnnnnnnnnnnnnnnnnnnnnnn

SEQ ID NO: 251387 - DNA, 548 bp, Homo sapiens
  misc_feature: GYAE6OF01B5P0W.25.28.C06.1.454.CMB.1.raw
  modified_base (227)..(227): a, c, t, g, unknown or other
  misc_feature (227)..(227): n is a, c, g, or t
  modified_base (419)..(419): a, c, t, g, unknown or other
  misc_feature (419)..(419): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttggccgggngagtcagggcattggaaatttattggcctggtatcagcaagaaaccagggtaacttcctaacctcctacatctatgctgctactcctactttgactaagtttcggggacccttgtcgtattcgagcggctaggttgggtctgggactaggtaattcactctcactatcagcacgcctgcacgcctagaagtnttgttcgactaactttacttactagttaactaaatttcgaacgtagttcgacccgttggacgttcggtaccggacccggtaagggaccgtaagggtcgaactaacgtaccgaaacggtacgtggtacgg

SEQ ID NO: 251388 - DNA, 502 bp, Homo sapiens
  misc_feature: GYAE6OF01E1ZKX.25.28.C06.1.454.CMB.1.raw
  modified_base (330)..(330): a, c, t, g, unknown or other
  misc_feature (330)..(330): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattattggcctggtatcagcagaaaccaggaaagttccaacctcctcatctatgctgcatccactttgctaatttcgggggtccctntcgattcgagtcggcagtgggtctgggacagaattcactctcaccatcagcagcctgcagcctgaagatgttgactaacttattactagtactaaaatttgaactagtcgacccgtggacttcggttacggcccgagggaccaagggtcgacatacaaacgtaacgtgtcgg

SEQ ID NO: 251389 - DNA, 265 bp, Homo sapiens
  misc_feature: GYAE6OF01DF3ZT.25.28.C06.1.454.CMB.1.raw
  modified_base (256)..(265): a, c, t, g, unknown or other
  misc_feature (256)..(265): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctggggcacagcggccctgggctgcctggtcaaggactacttccactgtacagtctgagcgggctggcaaggcgcatagnnnnnnnnnn

SEQ ID NO: 251390 - DNA, 511 bp, Homo sapiens
  misc_feature: GYAE6OF01B84PY.25.28.C06.1.454.CMB.1.raw
  modified_base (400)..(400): a, c, t, g, unknown or other
  misc_feature (400)..(400): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatcccgatgacccagtctccatcctccctgtctgcatctgttggagacagagtcaccatcacttggccgggcgagtcagggcattggaaattatttggcctggtatcagcagaaaccagggaaagttcctaacctcctcatctatgctgcatcctactttgctaagtttcggggtcccgtctcgattcagcggcagtggtctgggacagaatcactctcacatcagcagcctgcagcctgaagtntgttgactaattatactagtactaaaattgactagtcgtacccgtggacgttcggtacggcccgaaggggtaccaagggtcggaactacacgaaacgacttggtggtaccg

SEQ ID NO: 251391 - DNA, 272 bp, Homo sapiens
  misc_feature: GYAE6OF01EYAMN.25.28.C06.1.454.CMB.1.raw
  modified_base (223)..(272): a, c, t, g, unknown or other
  misc_feature (223)..(272): n is a, c, g, or t
tcagactgtacagtcacgaccggtgctcgatttagagctcacgtattgggggttttgggggggaagaggaagactgacggtcctcccaggagttcaggtgctgggcaccttgggcacggggaggtgtgtcacaagatttggctctgggcacagcggccctgggctgcctggtcaaggactacttccactgtacagtctgaggcgggctggcaaggcgcatagnnnnnnnnnnnnnnnnnnnnnnnnnnnnnnnnnnnnnnnnnnnnnnnnnn

SEQ ID NO: 251392 - DNA, 253 bp, Homo sapiens; identical to SEQ ID NO: 251338
  misc_feature: GYAE6OF01D4U9I.25.28.C06.1.454.CMB.1.raw
  modified_base (252)..(253): a, c, t, g, unknown or other
  misc_feature (252)..(253): n is a, c, g, or t

SEQ ID NO: 251393 - DNA, 626 bp, Homo sapiens
  misc_feature: GYAE6OF01A8HCU.25.28.C06.1.454.CMB.1.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (294)..(294): a, c, t, g, unknown or other
  misc_feature (294)..(294): n is a, c, g, or t
  modified_base (344)..(344): a, c, t, g, unknown or other
  misc_feature (344)..(344): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccggnagtcagggcattggaaattnttggcctggtatcagcaagaaaccgagggtaaacttcctaacctcctanattctatcgtctgacactcctactttgactaacggtttcgggtacccttntacgtattcgacgcggtactaggtcgggtctacggggtaacaggtaactttccacttccgtacacctatccgacgtaccacgtcccgtgaccgtacgacccgtaggtaacgtagttcggttacgtaccttaaacgtttacgtttaaccgtaagttaaacttaaaagttcgaacgtacggtaccgtacccggttaggtacgttccggttacccgggaccggtaaccgggaaccgtaagggtaccgtaaccgtaacgtaacccgaaacggtaacgtgggtaccg

SEQ ID NO: 251394 - DNA, 582 bp, Homo sapiens
  misc_feature: GYAE6OF01CZ1YG.25.28.C06.1.454.CMB.1.raw
  modified_base (340)..(340): a, c, t, g, unknown or other
  misc_feature (340)..(340): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaagggggctggagtggctggggagttacttggtctgacagacaaatgacatatcacgcggagtccgtgaggggccgattcaccatctccagggacaattccaagagaaccctntatctgcaaatgaaacaacttgagagtcgaggatacggccgtttatactgtgcgacctcaggagtggctaggaaaagtcgtaagtctcattcccgtcgaccctctggggccacgggccacccgtggtccaccgtctcctcacgccttccaccgaacgggccccacgttccggtcccttcccccgtgggcccgtccccctcggcccttccgacgggacgccgacccgtcggtcgggggacccg

SEQ ID NO: 251395 - DNA, 255 bp, Homo sapiens
  misc_feature: GYAE6OF01CQ9BO.25.28.C06.1.454.CMB.1.raw
  modified_base (254)..(255): a, c, t, g, unknown or other
  misc_feature (254)..(255): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgaccgtggatgttcggcccagggaccaaggtggacatcaaacgaactgtggctgcaccatctgtcttcatccttcccgccatctgaactgtacagtctgagcgggctggcaaggcgcatagnn

SEQ ID NO: 251396 - DNA, 529 bp, Homo sapiens
  misc_feature: GYAE6OF01DRMAK.25.28.C06.1.454.CMB.1.raw
  modified_base (226)..(226): a, c, t, g, unknown or other
  misc_feature (226)..(226): n is a, c, g, or t
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggngagtcagggcattggaaatttatttggcctggtatcagcagaaaccagggaaattccaacctcctcatctatgctgcatccactttgctaagttttggggtccctntcgattcagcgnaggtgggtctgggacagaattcactctcaccatcagcagcctgcagccctagaagattgttgactaactttattactagttactaaaatttgaactagtacgacccggtggtacgttcggttaccggacccgtacggggaaccgtaagggtacggaacaacgtacgaaacgtaacgtggtacggg

SEQ ID NO: 251397 - DNA, 268 bp, Homo sapiens
  misc_feature: GYAE6OF01D35JS.25.28.C06.1.454.CMB.1.raw
  modified_base (219)..(219): a, c, t, g, unknown or other
  misc_feature (219)..(219): n is a, c, g, or t
  modified_base (225)..(268): a, c, t, g, unknown or other
  misc_feature (225)..(268): n is a, c, g, or t
tcagactgtacagtcacgaccggtgctcgatttagagctcacgtattggggtttgggggggaagaggaagactgacggtcctcccaggagttcaggtgctcgggcaccttgggcacgggggaggtgtgtcacaagatttgggctctgggcacagcggccctgggctgcctggtcaaggactacttccactgtacagttctgagcgggctggcaaggccncatagnnnnnnnnnnnnnnnnnnnnnnnnnnnnnnnnnnnnnnnnnnnn

SEQ ID NO: 251398 - DNA, 510 bp, Homo sapiens
  misc_feature: GYAE6OF01DL3U6.25.28.C06.1.454.CMB.1.raw
  modified_base (225)..(225): a, c, t, g, unknown or other
  misc_feature (225)..(225): n is a, c, g, or t
  modified_base (331)..(331): a, c, t, g, unknown or other
  misc_feature (331)..(331): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccggnagtcagggcattggaaatttatttggcctggtatcagcaagaaaccagggtaacgttcctaacctcctcatctatgctgcatccatttgctaagtttcgggccctntcgattcagcggcagtggtctgggacagaattcactctcacatcagcagcctgcagcctagacgtatcgttagctaactttattacttatactaaaatttgaactagtcgacccgtggacgttcggttcggaccgtagggaaccgtaaggtacggacaactacgaaacgacgtgtacgg

SEQ ID NO: 251399 - DNA, 576 bp, Homo sapiens
  misc_feature: GYAE6OF01ECX4L.25.28.C06.1.454.CMB.1.raw
tcagactgtacagtcacgaccggtgctcgatttagagctcacgtattgggtttgggggcagaagtctctctcagtcagcacacagcatggacatgagggtccctgctcagctcctgggactcctgctgctctggctcccagctatcagatgtggcatccagatgacccagtctccatcctccctgtctgcatctgttggagacagagtcaccatcacttggccgggcgagtcgagggcattaggtaaattatttggtcctgggggggtatcgagacaagaaaccgaaggggtaaacgttaccgtaacctacctcatctatgctgcactcctactttgtacgtaacgtttcgggtcccgtctcgtacttcacgcggcgaggtgggtcgtgggacagtaattcactctacaccactcagcacgcctgcacgcctagaagtagtgttacgtactaactttattacttagttaactaaaatttagaacgtagtacgtaccgtaggtacgttacggttaccggcccggaacgggaaccgtaacgggtacggaacgtaagtaaccgtaaacgtaacgtacgg

SEQ ID NO: 251400 - DNA, 756 bp, Homo sapiens
  misc_feature: GYAE6OF01BPV12.25.28.C06.1.454.CMB.1.raw
  modified_base (472)..(472): a, c, t, g, unknown or other
  misc_feature (472)..(472): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagtctactcgagtatggtcggactacgtaccgaagtagtacccgaacccctagttccctccctacttccccttcccgttgtccgttcgacctacttcgttgggttagggaacgtacgtaacgtacgtacccaacctacgtccgtacgttccgggcccgggacgttaggtacggaggtactaagttaacggtaaaatttggttcggccgttaggtactcgagtacgaacggaaaccggtaagggttaacttccctaaccgttcctactacttactagtcgtctcgacctactacccttagtttcgacgtttaacgggtttcccggggtcccttntacggttacttacgacggtccggtactaggggttcggtcgtacgggaactagttacttccgactccactaaccgtataccgaacgtaccgacgtcccgtagaccgacgtccgtaagtaacgtgtttgtacgtaaccttaacgtttattaacgttacgtaaaacttaaagtccgaaacgtacggtaccggtaccggtaggtccgttccggggttacccggacccggaacgggtaaaccgtagggtaccgaacttaactaaacccggaaacgtcggtcggtaccgg

SEQ ID NO: 251401 - DNA, 254 bp, Homo sapiens; identical to SEQ ID NO: 251366
  misc_feature: GYAE6OF01CPM9D.25.28.C06.1.454.CMB.1.raw
  modified_base (253)..(254): a, c, t, g, unknown or other
  misc_feature (253)..(254): n is a, c, g, or t

SEQ ID NO: 251402 - DNA, 261 bp, Homo sapiens
  misc_feature: GYAE6OF01DSX9W.25.28.C06.1.454.CMB.1.raw
  modified_base (255)..(261): a, c, t, g, unknown or other
  misc_feature (255)..(261): n is a, c, g, or t
tcagactgtacagtcacgaccggtgctcgatttagagctcacgtattgggtttgggacagaattcactctcaccatcagcagcctgccagcctgaacgatgttgcaacttattactgtcaaaaatttgacagtgacccgtggatgttcggcccagggaccaaggtggacatcaaacgaactgtggctgcaccatctgtcttcatcttcccgcagtctgaactgtacagtctgagcgggctggcaaggcgcatagnnnnnnn

SEQ ID NO: 251403 - DNA, 252 bp, Homo sapiens
  misc_feature: GYAE6OF01ELWZ8.25.28.C06.1.454.CMB.1.raw
  modified_base (250)..(252): a, c, t, g, unknown or other
  misc_feature (250)..(252): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgactgtggctgcaccatctgtcttcatcttccgcatctgaactgtacagtctgagcgggctggcaaggcgcatagnnn

SEQ ID NO: 251404 - DNA, 263 bp, Homo sapiens
  misc_feature: GYAE6OF01CDNSL.25.28.C06.1.454.CMB.1.raw
  modified_base (258)..(263): a, c, t, g, unknown or other
  misc_feature (258)..(263): n is a, c, g, or t
tcagactgtacagtcacgaccggtgctcgatttagagctcacgtattgggtttggggggaagaggaagactgacggtcctcccaggagttcaggtgctgggcaccctggtcaccgtctcctcagcttccaccaagggcccatcggtcttcccctggcgccctgctccaggagcacctctgggggcacagcggccctgggctgcctggtcaaggactacttccactgtacagtctgagcgggctggcaaggcgcatagnnnnnn

SEQ ID NO: 251405 - DNA, 266 bp, Homo sapiens
  misc_feature: GYAE6OF01AWQFA.25.28.C06.1.454.CMB.1.raw
  modified_base (257)..(266): a, c, t, g, unknown or other
  misc_feature (257)..(266): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnnnnnnnnnn

SEQ ID NO: 251406 - DNA, 318 bp, Homo sapiens
  misc_feature: GYAE6OF01BOPZ2.25.28.C06.1.454.CMB.1.raw
  modified_base (243)..(243): a, c, t, g, unknown or other
  misc_feature (243)..(243): n is a, c, g, or t
  modified_base (260)..(261): a, c, t, g, unknown or other
  misc_feature (260)..(261): n is a, c, g, or t
  modified_base (263)..(318): a, c, t, g, unknown or other
  misc_feature (263)..(318): n is a, c, g, or t
tcagactgtacagtcacgaccggtgctcgattttagagctcacgtattgggtttgggacaggaattcactctcaccatcagcagcctgcagcctgaagatgttgctaacttattactgtccaaaaatttgacagtgacccgtggatgttcggcccagggaccaaggtggacatcaaacgactgtcggctgcaccatctgtcttcatccttcccgccatcctgaactgtacagtctgagcgggntggcaaggcgcatagcnnannnnnnnnnnnnnnnnnnnnnnnnnnnnnnnnnnnnnnnnnnnnnnnnnnnnnnnn

SEQ ID NO: 251407 - DNA, 519 bp, Homo sapiens
  misc_feature: GYAE6OF01A7EBZ.25.28.C06.1.454.CMB.1.raw
  modified_base (226)..(226): a, c, t, g, unknown or other
  misc_feature (226)..(226): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggnagtcaggcattggaaattattggcctggtatcagcaagaaaccagggaattcctaactctcatctatgctgcatccatttgctaagtttcggggtccctatcgacttcgagtcgctaggtcgggtctgggacagtaacttcgactcgtacacctactcaacgcacgcctcgcacgcctagaagtatgtgtactaacttattactacttataaactttgaactagtacgaccgtggtacgtcgttacggccgtacggaccgaaggtcgaacacgtaacgaacgtaacgtgtacg

SEQ ID NO: 251408 - DNA, 583 bp, Homo sapiens
  misc_feature: GYAE6OF01EFT1I.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcagttggaaaatttattggcctggtatcagcagaaaccagggaaacttcctaacctcctcatctatgctgctatcctactttgctaagtttcgggtcccgtctcgattcagtcggctaggtgggtctgggacagtaattcactctcaccatcagcacgcctgccacgtcctagaagtagttgttacgtactaactttaacttactacgtaacctaaactaacttaaattaaattaaactttaacttacccgtaacccgttaccgtttttacggacccggtaacggggtaacccgtaaagggttacgggtaaccaacgtaaccgtaaaacggtaaccgttaggtacggg

SEQ ID NO: 251409 - DNA, 689 bp, Homo sapiens
  misc_feature: GYAE6OF01BMUIW.25.28.C06.1.454.CMB.1.raw
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaagggggctggagtggctgggagttactggtctgacagacaaatgacatatcagcgagtccgtgagggccattcacatctccagggacaattccaaagacgaaaccctctatctagacaaaatcgaaactaactttgaacgtagtacgaaggtactaaccgggtaccgttttaattacgtgttagaccgtaccttaccgaaggtaggttacggacgttaagggaaaaacgttcggttaagttccttaccgtacgtttaccccgtaccgtaacccgttcgtacggggtacccgacgggtcccaacccgttcggtacctaacccggttccgtacccgttaccgaacggtccctttaccccgaacccgtaaccggggtacccccgtacgttaccccggtttcccgtttacccccccgtgggtcccccgg

SEQ ID NO: 251410 - DNA, 220 bp, Homo sapiens
  misc_feature: GYAE6OF01EOXPN.25.28.C06.1.454.CMB.1.raw
  modified_base (218)..(220): a, c, t, g, unknown or other
  misc_feature (218)..(220): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcacagcggccctggctgcctggtcaaggctacttccactgtacagtctgagcgggctggcaaggcgcatagnnn

SEQ ID NO: 251411 - DNA, 668 bp, Homo sapiens
  misc_feature: GYAE6OF01C5MKY.25.28.C06.1.454.CMB.1.raw
  modified_base (234)..(234): a, c, t, g, unknown or other
  misc_feature (234)..(234): n is a, c, g, or t
  modified_base (314)..(314): a, c, t, g, unknown or other
  misc_feature (314)..(314): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccactccctccctgtctgcatctgttggagacagacgtcaccatccacgttggccgggngagtcgagggcagttaggaaatttgtttggccttggtactcagacaagaaaccgagggtaaacttccctaaacctcctanaatcctaatcgctgcctaactcctaactttcgacttaacggtttcggggtccctcgtcgtaacttcgaaggtcggtcgtagggttgggttactagggggtaactaggtaacttctaaccgttcctacaccgtactacgacgacgaccgtccgtacgaccgtacgtcccgtaaggtaagtagttcgttacgaaccttaacgtttaacttaccgtaacgttaaacttaaaagtttcggaacgtacgttaccggtaacccggttaggtacggttaccggttaccgggaacccggtaacggggaacccgtaagggtacggtaacgtaacgttaaaccgaaacggttacgtggtaccgg

SEQ ID NO: 251412 - DNA, 237 bp, Homo sapiens
  misc_feature: GYAE6OF01CRZ1Q.25.28.C06.1.454.CMB.1.raw
  modified_base (220)..(237): a, c, t, g, unknown or other
  misc_feature (220)..(237): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggaacagcggccctgggctgcctggtcaaggactacttccactgtacagtctgagcgggctggcaagggcgcatagnnnnnnnnnnnnnnnnnn

SEQ ID NO: 251413 - DNA, 533 bp, Homo sapiens
  misc_feature: GYAE6OF01AUM32.25.28.C06.1.454.CMB.1.raw
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctccctgtctgcatctgttggagacagagtcaccatcacttgccgggngagtcagggcattggaaattattggcctggtatcagcaagaaaccaggaaacgttcctaaactcctanatctatgctgcatcctactttgctaagtttcggggtcccgtntcgattcgagcggcaggtgggtctgggacagtattcactctcacccatcagcacgtcctgcagcctagatnttgtnacttaacttattactagttaactaaaagtttcgactacggtcgacccgtggtaacgttcggtaccggacccggtaagggaccgtaagggtcgaactacgtaacgtaaacgactgggtacg

SEQ ID NO: 251414 - DNA, 608 bp, Homo sapiens
  misc_feature: GYAE6OF01C4EGR.25.28.C06.1.454.CMB.1.raw
  modified_base (363)..(363): a, c, t, g, unknown or other
  misc_feature (363)..(363): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccatcctccctgtctgcatctgttggagacagagtccaccatcacttgccgggcgagtcgagggcagttaggaaatttgttggcctggtatcagcaagaaaccgagggtaaacgttcctaacctcctactatctatgctgcatccactttgccgtaagtttcggggcccttgtcgtattcgaggtccgngtaggttcggggtcttaggggactaggtaattccgacttcctaccacctaatcaagccaacgtccgtcgacgacgacctagaacgtattcgttacgacttaacgttaactttaacgtaacgttaacttaaaaactttgtaactaaggttacgtaacccggttggtaacgttccggttacgggacccgtacggggaaccgtaagggtacgtaacgtaacgtaaccgaaacgtaacgttggtacggg

SEQ ID NO: 251415 - DNA, 257 bp, Homo sapiens
  misc_feature: GYAE6OF01AM1G2.25.28.C06.1.454.CMB.1.raw
  modified_base (253)..(257): a, c, t, g, unknown or other
  misc_feature (253)..(257): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgccatctgaactgtacagtctgagcgggctggcaaggcgcatagnnnnn

SEQ ID NO: 251416 - DNA, 258 bp, Homo sapiens
  misc_feature: GYAE6OF01BABZ3.25.28.C06.1.454.CMB.1.raw
  modified_base (256)..(258): a, c, t, g, unknown or other
  misc_feature (256)..(258): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctggggcacagcggccctgggctgcctggtcaaggactacttccactgtacagtctgagcgggctggcaaggcgcatagnnn

SEQ ID NO: 251417 - DNA, 221 bp, Homo sapiens; identical to SEQ ID NO: 251337
  misc_feature: GYAE6OF01A5U6L.25.28.C06.1.454.CMB.1.raw
  modified_base (219)..(221): a, c, t, g, unknown or other
  misc_feature (219)..(221): n is a, c, g, or t

SEQ ID NO: 251418 - DNA, 571 bp, Homo sapiens
  misc_feature: GYAE6OF01CW9FN.25.28.C06.1.454.CMB.1.raw
  modified_base (392)..(392): a, c, t, g, unknown or other
  misc_feature (392)..(392): n is a, c, g, or t
tcagactgtacagtcacgaccggtgctcgatttagagctcacgtattgggtttggggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccgattcaccatctccagggacaattccaagagaaccctctatctgacaaatgaacaacttgagagtcgaggatacggcctttattactgtgcgacctcaggngtggctaggaaaagtcgtagtctcattcccgtcgacctctgggccagggccacccgtggtccaccgtctcctcacgccttccaccgaacgggcccatccggtccttcccctcggccgccctcgccgtcccgaggcgccaccgtcgtcgggggccacgacggcccggcccgtggggtccg

SEQ ID NO: 251419 - DNA, 259 bp, Homo sapiens
  misc_feature: GYAE6OF01CQ1XY.25.28.C06.1.454.CMB.1.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (255)..(259): a, c, t, g, unknown or other
  misc_feature (255)..(259): n is a, c, g, or t
tcagactgtacagtcacgaccggtgctcgatttagagctcacgtattgggtttgggacagaattcactctcaccatcagcagcctgcagcctgaagatgttgctaacttattactgtactaaaaatttgacagtcgaccgtggatgtccggccagggaccaaggtgacatacaaaacgactgtggctgcacatctgtcttcatcctcccgcatcgtagaactgacagtcnggagcgggctggcaaggcncaatgnnnnn

SEQ ID NO: 251420 - DNA, 577 bp, Homo sapiens
  misc_feature: GYAE6OF01CFT22.25.28.C06.1.454.CMB.1.raw
  modified_base (250)..(250): a, c, t, g, unknown or other
  misc_feature (250)..(250): n is a, c, g, or t
  modified_base (341)..(341): a, c, t, g, unknown or other
  misc_feature (341)..(341): n is a, c, g, or t
  modified_base (513)..(513): a, c, t, g, unknown or other
  misc_feature (513)..(513): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccnccagtgtccaggcaagggggctggagtggctgggattactggtctgacagacaaatgacatatcacgcggagtccgtgagggccattcacntctcgaggacaatccaagacgaaccctctatctgacaaatgaacaactgagagtcgagatacggtacgttattactgtgcactcgaggagtgacgtaggtaaagtcgtagtctactacttcccgtcgtacctcgtcgggccacgggccacccgtggtccaccgtccgttccnccgtacgtccgttacccaaccgaacgggcccaacgtcccggttcccttcccccgtgggtccccg

SEQ ID NO: 251421 - DNA, 223 bp, Homo sapiens; identical to SEQ ID NO: 251345
  misc_feature: GYAE6OF01CBACY.25.28.C06.1.454.CMB.1.raw
  modified_base (220)..(223): a, c, t, g, unknown or other
  misc_feature (220)..(223): n is a, c, g, or t

SEQ ID NO: 251422 - DNA, 554 bp, Homo sapiens
  misc_feature: GYAE6OF01A6PDY.25.28.C06.1.454.CMB.1.raw
  modified_base (253)..(253): a, c, t, g, unknown or other
  misc_feature (253)..(253): n is a, c, g, or t
  modified_base (349)..(349): a, c, t, g, unknown or other
  misc_feature (349)..(349): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcctccatccctccctgtctgcatctgttggagacagagtcaccatccacgttggccgggcgagtcaggggcattggaaattnttggcctggtatcagcaagaaccagggaacttcctaactcctcatctatgctgcatcctactttgctaagtttcggggccctctcgtattcagcgntaggtggtctgggacagtattcactctcacatcagcacgcctgcacgccgtagaagtattgttacgacttaacgttattacttacgttaactaaactttgaactacggtcgtaaccggtggtaacttcgggttaccggacccggtaacggggaccgtaagggtacggtaacgaacttaaccggaaaacgttcgtacgggtaccgg

SEQ ID NO: 251423 - DNA, 500 bp, Homo sapiens
  misc_feature: GYAE6OF01C330M.25.28.C06.1.454.CMB.1.raw
  modified_base (328)..(328): a, c, t, g, unknown or other
  misc_feature (328)..(328): n is a, c, g, or t
  modified_base (380)..(381): a, c, t, g, unknown or other
  misc_feature (380)..(381): n is a, c, g, or t
  modified_base (491)..(491): a, c, t, g, unknown or other
  misc_feature (491)..(491): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcagtcagggcattggaaattattggctggtatcagcagaaaccagggaacttcctaacctctcatctatgctgcatccactttgctaagtttcggggtccctntcgtattcgagcggtcaggtgggtctgggacagtatcactctcacatcagcnnctgcagcctagatatgtgtactaacttattactagtaactaaattgaactagtcgaccgtggacgttcggtacggacccgagggaccgtaaggtcgaacagtacaaacgngtggtacgg

SEQ ID NO: 251424 - DNA, 262 bp, Homo sapiens
  misc_feature: GYAE6OF01DF0LT.25.28.C06.1.454.CMB.1.raw
  modified_base (259)..(262): a, c, t, g, unknown or other
  misc_feature (259)..(262): n is a, c, g, or t
tcagactgtacagtcacgaccggtgctcgatttagagctcacgtattgggtttggggggaagaggaagactgacggtcctcccaggagttcaggtgctgggcaccctggtcaccgtctcctcagcttccaccaagggcccatcggtcttcccctggcgccctgctccaggagcacctcgtgggggcacagcggccctgggctgcctggtcaaggactacttccactgtacagtctgagcgggctggcaaggcgcatagnnnn

SEQ ID NO: 251425 - DNA, 617 bp, Homo sapiens
  misc_feature: GYAE6OF01C5ZI2.25.28.C06.1.454.CMB.1.raw
  modified_base (375)..(375): a, c, t, g, unknown or other
  misc_feature (375)..(375): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtcgtgggggaggcgtggtccagcctgggaagtccctgagactctcctgtgtggcgcctagactcaccttcagtagttatggcttcgtctgggtccgccagtgtccaggcaaggggctggagtggctgggattacgtggtctgacagacaaatgacatatcacgcggagtccgtggagggccattcacatctccgaggacaattccaaagacgaaccctntatctagacaaatcgaaactacgttgaagtagtacgaggtactacggtacgtttattacgtgtcgacgtactcgaggtagtggtacgtaaggtaaaagtcgtaacgttctacgtaccgttcccggtacgtaccgtcggtcgggccgacgggccctacccgtggtaccctaccgtcctccgtacgacgtccttacccgaaccgtaccggtccctacgtcccgttccctccccgtcggtccccg

SEQ ID NO: 251426 - DNA, 254 bp, Homo sapiens
  misc_feature: GYAE6OF01D1IKQ.25.28.C06.1.454.CMB.1.raw
  modified_base (252)..(254): a, c, t, g, unknown or other
  misc_feature (252)..(254): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgactgtggctgcaccatctgtcttcatccttcccgcatctgaactgtacagtctgagcgggctggcaaggcgcatagnnn

SEQ ID NO: 251427 - DNA, 517 bp, Homo sapiens
  misc_feature: GYAE6OF01BNYD5.25.28.C06.1.454.CMB.1.raw
  modified_base (201)..(201): a, c, t, g, unknown or other
  misc_feature (201)..(201): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgganacagagtcaccatcacttgccgggcgagtcagggcattggaaatttattggcctggtatcagcagaaaccagggtaaacttcctaacctcctcatctatcgctgcatccatttcgactagtttcggggtccctctcgtattcgagtcggctaggtcgggtctgggactagtacttcgactctcaccatcagcacgtcctgcacgcctagaatatgtgactaactttattacttagtaactaaagtttgaactagtcgaccgtgtagtcggttcgaccgtagggaccagggtacgacacgtacaacgtagtggtacg

SEQ ID NO: 251428 - DNA, 255 bp, Homo sapiens; identical to SEQ ID NO: 251369
  misc_feature: GYAE6OF01AUUOX.25.28.C06.1.454.CMB.1.raw
  modified_base (253)..(255): a, c, t, g, unknown or other
  misc_feature (253)..(255): n is a, c, g, or t

SEQ ID NO: 251429 - DNA, 276 bp, Homo sapiens
  misc_feature: GYAE6OF01BO0Y2.25.28.C06.1.454.CMB.1.raw
  modified_base (248)..(276): a, c, t, g, unknown or other
  misc_feature (248)..(276): n is a, c, g, or t
tcagactgtacagtcacgaccggtgctcgatttagagctcacgtattggggtttgggacagaattcactctcaccatcagcagcctgctagcctgaagatgttgcaacttattactgtaacaaaaattgacagtgaccgtggatgtcgccaggaccaaggtggacatacaaacgactgtggctgcacatctgtctcatctcccgcatctgaactgtacagtctgagcgggctggcaaggcgcataggnnnnnnnnnnnnnnnnnnnnnnnnnnnnn

SEQ ID NO: 251430 - DNA, 543 bp, Homo sapiens
  misc_feature: GYAE6OF01CH2VU.25.28.C06.1.454.CMB.1.raw
  modified_base (226)..(226): a, c, t, g, unknown or other
  misc_feature (226)..(226): n is a, c, g, or t
  modified_base (329)..(329): a, c, t, g, unknown or other
  misc_feature (329)..(329): n is a, c, g, or t
  modified_base (398)..(398): a, c, t, g, unknown or other
  misc_feature (398)..(398): n is a, c, g, or t
tcagactgtacagtcacgaccggtgctcgatttagagctcacgtattgggtttgggggcagaagtctctctcagtcaggacacagcatggacatgagggtccctgctcagctactgggactcctgctgctctggctcccagctatcagatgtggcatccagatgacccagtctccatcctccctgtctgcatctgttggagacagagtcaccatcacttgccgggngagtcagggcattggaaattatttggcctggtatcagcagaaaccagggaaattcctaacctctcatctatgctgcatccatttgctaagtttcggggccctntcgattcgagcggcaggtgggtctgggacagaattcactctcaccatcagcagcctgcagcctgaagtntgttgactaactttattactagttaactaaaagtttgaactaggtacgacccggtaggtacgttcggtttaccgggacccgtaggggtaacccgtaaggggttacggaacctacgttaaccgaaaacggtaccgttgggtacggg

SEQ ID NO: 251431 - DNA, 508 bp, Homo sapiens
  misc_feature: GYAE6OF01E1YXP.25.28.C06.1.454.CMB.1.raw
  modified_base (328)..(328): a, c, t, g, unknown or other
  misc_feature (328)..(328): n is a, c, g, or t
  modified_base (395)..(395): a, c, t, g, unknown or other
  misc_feature (395)..(395): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattattggcctggtatcagcagaaaccaggaaattccaactcctcatctatgctgcatccactttgactaagtttggggtccctntcgattcagcggcaggtgggtctgggacagaattcactctcaccatcagcagcctgcagcctgaagntgttgacctaacttattactagtaactaaaatttcgactagtcgacccggtgacgttcgttccgggacccaggggaccaagggtcgaacactaacgaaacgtaagtggtacgg

SEQ ID NO: 251432 - DNA, 650 bp, Homo sapiens
  misc_feature: GYAE6OF01DR7GX.25.28.C06.1.454.CMB.1.raw
  modified_base (231)..(231): a, c, t, g, unknown or other
  misc_feature (231)..(231): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctccctgtctgcattctgttggagacagacgtcaccatcacgttggccgggngagtcagggcattggaaatttatttggcctggtatcagcaagaaaccagggtaaacgttcctaaacctcctacatctatgctgcactcctactttgactaagttttcggggtacccttcgtcgactttccgagaccggtcgaacggttgggtcgtaggggactagtaagttccacgttcctaccacctattcacgcacgtcctacgcacgtcccgtagaacgtattccgtacgacctaaaccgttatttacgttagtaacctaaacttaacgtttaaacggtacccttttacccttaccttacccgtttacccggtttaccgggaccggggtaaacggggttaacccgtaaacggggttacgggaaacggttaaccttaaccggtaaaaaccggttacgttaggtacgggttaacccgg

SEQ ID NO: 251433 - DNA, 227 bp, Homo sapiens
  misc_feature: GYAE6OF01CTYTS.25.28.C06.1.454.CMB.1.raw
  modified_base (223)..(227): a, c, t, g, unknown or other
  misc_feature (223)..(227): n is a, c, g, or t
tcagactgtacagtcacgaccggtgctcgatttagagctcacgtattggggtttgggggaagaggaagactgacggtcctcccaggagttcaggtgctgggcaccttgggcgacgggggaggtgtgtcacaagtatttgggctctgggcacagccggccctgggctgcctggtcaaggactacttccactgtacagtctgagcgggctggcaaggcgcatagnnnnn

SEQ ID NO: 251434 - DNA, 526 bp, Homo sapiens
  misc_feature: GYAE6OF01ALT75.25.28.C06.1.454.CMB.1.raw
  modified_base (226)..(226): a, c, t, g, unknown or other
  misc_feature (226)..(226): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggngagtcgagggcattggaaattatttggccttggtatcagcaaggaaaccagggaaacttcctaacctcctcatctatgctgcatcctactttgactaagtttcggggccctctcgtattcgagcggcaggttggtctgggacagtaacttcactctcaccatcagcacgcctgcacgcctagaagtagtgttcgactacttattacgtagtaactaaattgaactagtacgtacccgtggtacgttcggtaccggacccgacggaccgtaaggtcgacagtaacaaacgtagtggtacgg

SEQ ID NO: 251435 - DNA, 254 bp, Homo sapiens
  misc_feature: GYAE6OF01D4VMQ.25.28.C06.1.454.CMB.1.raw
  modified_base (251)..(254): a, c, t, g, unknown or other
  misc_feature (251)..(254): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggcccagggaccaaggtgacatcaaacgactgtggctgcaccatctgtcttcatccttcccgcatctgaactgtacagtctgagcggctggcaaggcgcatagnnnn

SEQ ID NO: 251436 - DNA, 603 bp, Homo sapiens
  misc_feature: GYAE6OF01DKB3Z.25.28.C06.1.454.CMB.1.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagactgtacagtcacgaccggtgctcgatttagagctcacgtattgggttgggggcagaagtctctctcagtcaggacacagcatggacatgaggtccctgctcagctcctgggactcctgctgctctggctcccagctatcagatgtgcatccagatgacccagtctccatccctccctgtcctgccatctgtggagacagagtcaccatcacttgccgggnagtcaggcagttaggaaattnttggcctaggtatcagcaagaaacccgagggtaaacttccaaacctcctacacttctatcgacttgcctaagtcctactttggacgtaacggttttcggggccccttagttccggtaattccgaaggtccgggtactacgggttcgggtcgtagggaaccaaggtaacttacgaacctctacgaacctactactacgtcctaacgtcctgaccacgtccgtacaagtattagttcgtacttaacttattacgtagtaacttaaaattcgaacgtagtacgaccgtagtacgtacggtaccgaccggacgggaacccgtaagggtacgtaactaacgtactaaaccgacgtgtaccgg

SEQ ID NO: 251437 - DNA, 833 bp, Homo sapiens
  misc_feature: GYAE6OF01CKM2C.25.28.C06.1.454.CMB.1.raw
tcagactgtacagtcacgaccggtgctcgatttagagctcacgtattgggtttgggggcagaagtctctctcagtcaggacacagcatggacatggacgggtccctgctcagctccgtgggactcctgctgctctggctcccagctatcagatgtggcatccagatcgaccagtctccactcctccctgtcctgactatcgttggtggacgacagactcaccattcacgttcggccggggagagtcgaggctaagttaggtaaatttagtttcggtccgttaggtactcgagacgaaacggaaaccgaaggggtaaacttaccctaacctcctactaacttctatcgcttcgactactccttacgtttacgacgttaacgggttttcccggggtcccttactacggtacttacggacggtcggaccggttaagggtcggggtacggtacgggaacgtaacggtaacttaccctaaccttacccgtaacctaacctaacgttaccgaacggtacccgtaaccgggtcccgttaacggacccgtaccggtaacccgttaagggtaaggttacgtttacgggttacggttaaaccgtttaaaccttttaaaccgtttaaacgttaacggttttaaaaaccttaaaacggttttacgtaaaccggtaacgggttaccgggtaaccccgggtttttagggtaaaccggtttccgggggtttaaccccgggaacccgggttaaaaccggggggtaaacccggttaaggggtaaccgggtaaaccgttaaaccgtaaaccggttaaaaccggttaaccggggttagggtttaaccccggg

SEQ ID NO: 251438 - DNA, 259 bp, Homo sapiens; identical to SEQ ID NO: 251368
  misc_feature: GYAE6OF01BD8GF.25.28.C06.1.454.CMB.1.raw
  modified_base (256)..(259): a, c, t, g, unknown or other
  misc_feature (256)..(259): n is a, c, g, or t

SEQ ID NO: 251439 - DNA, 639 bp, Homo sapiens
  misc_feature: GYAE6OF01DFOW7.25.28.C06.1.454.CMB.1.raw
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaaggggctggagtggctggggattacttggtctgacagacaaatgacatatcacgcggagtccgtgaggggccgattcaccatctccagggacaattccaagagaaccctntanctgcaaatgaacaacttgagagtcgaggatacggcgtttatactgtgcgacctcgaggagtggactaggaaaagtcgtaagtactcacttcccgtcgtaccgtcgtggggaccagggcctaacccgtcggttaccgaaccccggttcctccctccgacgtaccctttcccgaacccgtaaacgggggtacccctaaccgttccggggtcccctttacccccccgtgggtccccgtcccccgttcggtccccgttcccgaacgggtacgcccgtaacccgtccggtcggggggaacccg

SEQ ID NO: 251440 - DNA, 252 bp, Homo sapiens
  misc_feature: GYAE6OF01BTLZF.25.28.C06.1.454.CMB.1.raw
  modified_base (251)..(252): a, c, t, g, unknown or other
  misc_feature (251)..(252): n is a, c, g, or t
tcagactgtacagtcacgaccggtgctcgatttagagctcacgtattgggtttgggacagaattcactctcaccatcagcagcctgcagcctgaagatgttgcaacttattactgtcaaaagtataatactgcccctctcactttcggcggaggaccaaggtggagatcaaacgaactgtggctgcaccatctgtcttcatcttccgccatctgaactgtacagtctgagcgggctggcaaggcgcatagnn

SEQ ID NO: 251441 - DNA, 852 bp, Homo sapiens
  misc_feature: GYAE6OF01BMPAM.25.28.C06.1.454.CMB.1.raw
tcagactgtacagtcacgaccggtgctcgatttagagctcacgtattggggtttggggggcagaagtctctctcagtcaggacacagcatggacagtcgaggtccctgctcaggctcctgggactcctgctgctcgtggcctccagtctatcagacgtgtcggctactcccacgactcgaccctagtcctccattccgtccctgtctagtccaacttcttggttacggagaccgtagaacgttccaaccgtattcctaaccgtttcggaccgggttaacgtaggttacgaacggggtactaagttaaacggtaaaagtttaacgtttaccgggtaccgttacggtacttaccgtaacgtacctaacggtaaaaccgtaacggggtaaaaccgtttccccgtaaacccgttcccttaccgtacttaccgttacgtcggtaccgttacgacctactacccgtacgttttacgacgttaacgtttcgggggtcccgtacgttcggtaacgtttacgacggtaccggtcgtaacggttcgggtacgtacgggtaacctaacgtaactttaccgaccgttaccgtacccgtaacccgtacgttaaccgtacggtaaccctaaccgttcccttacggtaccgtaaccgttaaccgtttaaacggtaaaccgttacttttacccgggttaacgtaacccttttaacggtttaaccgttaacgggttaaccgttaaacgttaaaacggttcggaaaccgttaacggttaacccggtaccgttagggtcgttaccgggttaccgaaccccggtaaggtaccgtaaggtcgtaacctacgtaaccgtaacgtcgtggtacgg

SEQ ID NO: 251442 - DNA, 623 bp, Homo sapiens
  misc_feature: GYAE6OF01BO8JB.25.28.C06.1.454.CMB.1.raw
  modified_base (304)..(304): a, c, t, g, unknown or other
  misc_feature (304)..(304): n is a, c, g, or t
  modified_base (372)..(372): a, c, t, g, unknown or other
  misc_feature (372)..(372): n is a, c, g, or t
tcagactgtacagtcacgaccggtgctcgatttagagctcacgtattgggtttggggggaagaggaagactgacggtcctcccaggagttcaggtgctgggcaccttgagcactgaacgcagcggactcaccatggagtttgggctgaactgggttttcctcgttgctcttttaagaggtgtccagtgtcaggcgcatctggtggagtctgggggaggcgtgggtccagcctggggaatccctgagactctcctgtgtggcgcctagactcaccttcagtagttatggcttcgtctggggtccnccagtcgtccaggcaaggggctgggagtggctgggattacgttggtctggacagacaaatgaacatancaacgcggagtccggtggacggggcctaattccaaccacgtctaccgagggaactaacttaccaaacgtaacgaaccctacgtactcgtacgacaaagtacgaactaactagaagagtacggaacggtacgtaccggtaccgtttaagttacgtgtacgaccgtaccgtcgaaggtacggtggtagttaacgggaaaacgttcggtaagtcctacgtacgttacccggtaccgtaccgttcggtaccgggg

SEQ ID NO: 251443 - DNA, 545 bp, Homo sapiens
  misc_feature: GYAE6OF01EIV80.25.28.C06.1.454.CMB.1.raw
  modified_base (414)..(414): a, c, t, g, unknown or other
  misc_feature (414)..(414): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagaatcagcatcacttggccgggcgagtcgagggcattagctaattattagcctggtatcaacagaaaccgagggagagttacctaagctcctgatctatgctcgcctccacgttacacgtcgacgggtcccatcgtcgttcagcgcagtgaatcgtagggacagtacgttcactctacactactcacgcacgcctgcacgcctagaagtnttagtcgtactaactttacttactagtaactaaaagttattaaactacctaccgtcccttcgtaaccgttcgtttaccgggaccgggtaacggtaccggtaagggtaggaacgtacgtaacggtaaaacgg

SEQ ID NO: 251444 - DNA, 638 bp, Homo sapiens
  misc_feature: GYAE6OF01EBOSL.25.28.C06.1.454.CMB.1.raw
  modified_base (389)..(389): a, c, t, g, unknown or other
  misc_feature (389)..(389): n is a, c, g, or t
tcagactgtacagtcacgaccggtgctcgatttagagctcacgtattgggtttggggggaagaggaagactgacggtcctcccaggagttcaggtgctgggcaccttgggcgacgggggaggtgtgtcacaagatttgggctctgggcaccgtggagtcgtgggggaggcgtggtccagcctgggaagtccctgagactctcctgtgtggcgcctagactcaccttcagtagttatggcttcgtcgtgggtccgccagtcgtccaggcgaagggggctggagtggcgtgggtagttacttggtctgacagaacaaatgacatatcgacgcggagtccgtggacggggccattcaccatcgtccgaggacaatccaaagacgtaaccctntatctagactaaatgaaactaacgttgaagtacgtacgaaggtacgtacggtcgtttattacgtgtacgacgtacctagaggtagtggacgtaaggtaaaagtcgtagtctactacgttcccgtacgtaccgtcggtcgggaccgtacgggcctacccgtcgtcccgtaccgttccgtccgtcgtacgtcccttacccgaacggtaaccggtccctacgttcccggttcccttccccgtcggtaccccg

SEQ ID NO: 251445 - DNA, 763 bp, Homo sapiens
  misc_feature: GYAE6OF01CXDKU.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacgttggccgggcgagtcgagggctaagttaggaaaatttagtttgggccttaggtactcgaagaccgaaacggtaaaaccaaggggtaaacttccctaaacccttctactatctatgctgactactcctaactttcgacgttaacggttttcggggcccgttctacgtactttcgacgggtccggtacgtaggggttcgggttacgtacggggtaacgtaacggtaaactttccgtaaccgttaccccgttacctaaaccccgtaaacttaccgtaaccggaccgtaaccgggtcccgttacggacccgtaacgggttaccccgttaaggtaaacggtacgttttaacggtttacggtaacctttaaaccgttttaactttaaaccgttaacggtttaaacttaaaaacgtttcggtaaacgttacgggttaaccgtacccgggttaggtacggtttaccgggttacccgggaacccggtaacgggtaacccgtaaagggttacggaactaaccggtaaaccgtaaaccggtacgttacgggtacgg

SEQ ID NO: 251446 - DNA, 631 bp, Homo sapiens
  misc_feature: GYAE6OF01BHCU1.25.28.C06.1.454.CMB.1.raw
  modified_base (230)..(230): a, c, t, g, unknown or other
  misc_feature (230)..(230): n is a, c, g, or t
  modified_base (357)..(357): a, c, t, g, unknown or other
  misc_feature (357)..(357): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccatccctccctgtctgcatctgttggagacagagtccaccatcacgttgccgggngagtcgagggcagttggaaatttagttggcctggtatcagcaaggaaaccgagggtaaacgttcctaacctcctacattctatgctgacctatcctatttcgacgttaaggtttcggggtacccctntacgtattccgaggtccggctaggtcggggtctagggactagtaacttccacttcctacacccatcgacgtccgacgtccgtacgacgtaccgtacgtacggtaagtagttcggtacgtaaccttaacgttttaacgttacgttaacgttaaacttaaaagtttcgaacgtacggtaccggtaaccggttaggttacggttccgggtacccggacccggtaacgggtaaccgaagggtacgtaacgactaaaccgaacggtacggtggtaccgg

SEQ ID NO: 251447 - DNA, 614 bp, Homo sapiens
  misc_feature: GYAE6OF01DD5DW.25.28.C06.1.454.CMB.1.raw
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaagggggctggagtggctgggagttacttggtctgacagacaaatgacatatcacgcggagtccgtgagggccgattcaccatctccgagggacaaattccaaagacgaaccctctaatctgacaaatcgaaactaacttgagagtacgaaggatacggtacgtttattactgtagcgtacctacgaggagtggctaaggaaaaacgtcgtaagtctacacgttcccgtacgtacctcgtcgggtaccgacgggcctaacccgtggtccaaccgtccgtccctacacgtccttacccgaacccgaacgggtaccccaagtacccggttcccttcccccgtcgggtccccg

SEQ ID NO: 251448 - DNA, 645 bp, Homo sapiens
  misc_feature: GYAE6OF01AR8LU.25.28.C06.1.454.CMB.1.raw
  modified_base (201)..(201): a, c, t, g, unknown or other
  misc_feature (201)..(201): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttgganacagagtcaccatcacttgccgggcgagtcagggcagttaggaaattagtttggcctggtatcgagacaagaaaccgagggtaaacgttccctaaacctcctacattctaatgctgactactcctactttgacgtaagtttcggggtccctctcgtattcgaacggtcggcgtaggttcgggtcgtagggaactagtaacttcgacttcgtacctacctaatcagtcacgtccttgaccgtacgtaccgtagaacgtagttcggttacgaacttaaaccgtttaacgttaaccttacgttaaacttaaaaagttttcgaacgtaaggtaccggtaacccggttagggtaacgttcgggttacccggaacccggtaacgggaaccggtaaacgggtcggtaaacctaacgtaaaccggtaaaaccgtaaacggttcggtaaccgg

SEQ ID NO: 251449 - DNA, 298 bp, Homo sapiens
  misc_feature: GYAE6OF01EM6OH.25.28.C06.1.454.CMB.1.raw
  modified_base (274)..(298): a, c, t, g, unknown or other
  misc_feature (274)..(298): n is a, c, g, or t
tcagactgtacagtcacgaccggtgctcgatttagagctcacgtattgggtttggggggaaggaggaagactgacggtcctcccaggagttcaggtgctgggctaccctggtcaccgtctcctcagccttccaccgaagggcccagtcggtcttccccctggcgccctgctccaggagccacctcgtgggggcacagcggcccgtggggctggcctggtcaaggactacttccaactgtacagtctgagtcgggctgggcaaaggcacaatagnnnnnnnnnnnnnnnnnnnnnnnnn

SEQ ID NO: 251450 - DNA, 633 bp, Homo sapiens
  misc_feature: GYAE6OF01D6T1M.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttggccgggcgagtcgagggtcaagttaggtaaatttagtttggccttgggttactcaagacgtagaaaccgaagggtaaaacgtttccctaaaccttccctacgtattctatcgtctcgctacttcctaactttgacttaagtttcggggtaccctgtacgtacttcgacgtcggacgtaggttcgggtctaggggtaactaggtaacttccgtaacctctaccaccctatcgacgccacgcctacgccgacgtccgaagtaacgtgttacgtacgtaaccttaacgtttacttaacgttaagttaaacttaaacgttacgaacgtcggtaccgtaccggtagtaccgttcgggtacccgaaccgggtacggtaaccgtaagggtacgaacgtaacaaacgtaacgtgtggtacg

SEQ ID NO: 251451 - DNA, 581 bp, Homo sapiens
  misc_feature: GYAE6OF01DY6BN.25.28.C06.1.454.CMB.1.raw
  modified_base (376)..(376): a, c, t, g, unknown or other
  misc_feature (376)..(376): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggattacttggtctgacagacaaatgacatatcacgcggagtccgtggaggggccattcaccatctccagggacaattccaaagagaacccctntaatctgacaaatgaaacaacttgaagagtcgaggatacggctttattactgtgcgacctcaggagtggctaggaaaagtcgtagtctcattcccgtacgtacctcgtcggggccagggccacccgtggtccacccgtctccctcacggtccttacccgaccgaaccgggccctaagtcccgggtcccttcccccgtggtccccg

SEQ ID NO: 251452 - DNA, 253 bp, Homo sapiens; identical to SEQ ID NO: 251332
  misc_feature: GYAE6OF01A29YY.25.28.C06.1.454.CMB.1.raw
  modified_base (253)..(253): a, c, t, g, unknown or other
  misc_feature (253)..(253): n is a, c, g, or t

SEQ ID NO: 251453 - DNA, 587 bp, Homo sapiens
  misc_feature: GYAE6OF01D1C05.25.28.C06.1.454.CMB.1.raw
tcagactgtacagtcacgaccggtgctcgatttagagctcacgtattgggtttgggctgaactgggttttcctcgttgctcttttaagaggtgtccagtgtcaggcgcatctgggtggagtctggggggaggcgtggtccagcctgggaagtccctgagactctcctgtgtgacgcctagactcaccttcagtagttatggcttcgtctggggtccgccagtgtccaggcaagggggctgggagtggctggggagttacttggtctgacagacaaatgacatatcacgcggagtccgtgaggggccgattcaccatctccagggacaattccaagagaaccctctatctgcaaatgaacaacttgagagtcgaggatacggcctttatactgtgacgacctcgaggagtggcgtaggaaaaagtcgtaagtctcacgttcccgtacgacctcgtcggggccagggccacccgtggtccacccgtctcctcacgtccttccaaccgaacgggcccacgtccgggtcccgttccccctggcccgtcccctcgccctcccgacggacgccgacccgtcgtcgggggaccg

SEQ ID NO: 251454 - DNA, 602 bp, Homo sapiens
  misc_feature: GYAE6OF01B1BG1.25.28.C06.1.454.CMB.1.raw
  modified_base (225)..(225): a, c, t, g, unknown or other
  misc_feature (225)..(225): n is a, c, g, or t
  modified_base (581)..(581): a, c, t, g, unknown or other
  misc_feature (581)..(581): n is a, c, g, or t
tcagactgtacagtcacgaccggtgctcgatttagagctcacgtattgggtttgggctaggaacctagggttttcctccgttgcgtcttttaaagacggtgtccagtgtcaggcgcatctggtggagtctgggggaggcgtggttccagcctgggaagtccctgagactcgtcctcgtgtggcgcctagactcaccttcagtagttatggcttcgtctgggtccnccagtgtccgaggcaaggggctggagtggctgggagttacttggtctgacagacaaatgacatatcacgtcggagtccgtgaggggcccagttcgaccatctccagggacaattccaagacgaaccctctaatctagcaaatgaacaacttgagagtcgaggatacggccgtttaattactgtcgcgtacctcaggagtggactagggaaaagtcgtagtctactattcccgtcgacctcgtcgggcacggccacccgtggtaccaccgtcctcccgtcacgtccttaccaccgacggcccgtagtccggttccgtcccccgtaggcccgtcccgtcgcccgtcccgtacgggacnccgtccctcggtggggacccg

SEQ ID NO: 251455 - DNA, 589 bp, Homo sapiens
  misc_feature: GYAE6OF01A0NZX.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctccctgtctgcatctgttggagacagagtccaccatccacgttgccgggcgagtcgagggcattggaaattattggcctggtatcagcaagaaaccgagggaaacgttccctaacctcctcatctatgctgcatcctactttgctaagtttcggggtccctctcgtattcgagtcggctaggtcgggtcgtacggggacagtaactttccaccttcgtaccaaccctattccgaacgcctacgccctgaccgacgtcctagaagtgttgttcgaccttaactttattaccgttagttaactaaaagtttcgaacgtagttccggtaccgtaggtaacgtccggttaccggacccgtaggggtaaccctaagggtcggtaactagtaaccgaaacggtacgtggtaccgg

SEQ ID NO: 251456 - DNA, 254 bp, Homo sapiens
  misc_feature: GYAE6OF01DJ0D0.25.28.C06.1.454.CMB.1.raw
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (253)..(254): a, c, t, g, unknown or other
  misc_feature (253)..(254): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttccggccagggaccaaggtggacatcaaacgaactgtggctgcacatctgtctcatccttcccgcatctagaactgtacagtctgagcggntggcaacggcncaatgcnn

SEQ ID NO: 251457 - DNA, 765 bp, Homo sapiens
  misc_feature: GYAE6OF01A7P0O.25.28.C06.1.454.CMB.1.raw
  modified_base (247)..(247): a, c, t, g, unknown or other
  misc_feature (247)..(247): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattnttggcctggtatcagcaagaaaccagggtaaacgttcctaacctcctacattctatgctgctatcctattttgactaacgttttcgggggtccccttacgtccggtaactttccgaacggtccgggtacctaaggggttcgggggttacccttaggggggaaccctaagggtaaacttttccgaaccgttccttacccgaaccccgtacgttaccgacggtacccaacgggtccccttaggacccgtaacggtcccgtttaagggaaacggttacgtttacggttttacggaaccctttaaaacccgtttttaaagttttaacccgttaacgttaaaaccgtttaaaaacgttttcggaaaccgttaacgggttaacccggtaacccgggttagggttaccggtttcgggttaccccggggaacccgggtaaacgggggtaaacccgttaaaggggtacccggtaaacgttaaccgttaaaacccggtaaaaccggtaaccggttggggtaacccggg

SEQ ID NO: 251458 - DNA, 674 bp, Homo sapiens
  misc_feature: GYAE6OF01C8B3M.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctgctcccagctatcagatgtgcatccagatcgacccagtcctccactccctccctgtctgctattcgtgttggagacagacgtccaccatccacgttcggccgggcgagtcgagggctaagttaggtaaatttagttcggccgttaggtactacgagtacgaaacggaaaccgtaagggtaaaccgtttaccctaacccttcctactacgttacttagtcgtctcgtactacttccctacgtttacgtaccgttaacgggttttccggggtccccgttagttacgtacttcgacggtcggtacggtagggttcgggtacgtacgggaactacgtaacttcctacgtcctaccactagtcgagaccacgtcctagccgtacgtaccgtagtaacgtgttacgttacgtaacttaacgtttattaacgttagttaaacttaaagttcgaacgtaggtccgtaccggtaggttaccgtcggttacccggaccggtaacgggtaactaagggtaccgtacttaacgaaccgaacgtcgtgggtaccg

SEQ ID NO: 251459 - DNA, 610 bp, Homo sapiens
  misc_feature: GYAE6OF01B15B4.25.28.C06.1.454.CMB.1.raw
  modified_base (251)..(251): a, c, t, g, unknown or other
  misc_feature (251)..(251): n is a, c, g, or t
  modified_base (383)..(383): a, c, t, g, unknown or other
  misc_feature (383)..(383): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggagacgtggtccagcctgggaagtccctgagactctcctgtgtggcgcctagactcaccttcagtagttatggcttcgtctgggtccnccagtgtccaggcaggggctggagtggctgggattacgttggtctgacagacaaatgacatatcacgcggagtccgtggagggccgattcacctatctaccgagggacaacttccaagacaaccctctatcngacaaatgaaacacttgagagtacgaggatacggtacgtttattactgtgacgtacctcgtaggtagtggctaaggtaaaagtcgtagtctctacgttcccgtacgtaccgttcgtcgggccacgggcctacccgtcggtaccctaccgttcccgtcctccacggtcccttacccgaacccgaaccgggtccctacgtcccggttcccttcccccgtcgggtccccg

SEQ ID NO: 251460 - DNA, 221 bp, Homo sapiens; identical to SEQ ID NO: 251326
  misc_feature: GYAE6OF01CTQP1.25.28.C06.1.454.CMB.1.raw
  modified_base (218)..(221): a, c, t, g, unknown or other
  misc_feature (218)..(221): n is a, c, g, or t

SEQ ID NO: 251461 - DNA, 561 bp, Homo sapiens
  misc_feature: GYAE6OF01BYUX5.25.28.C06.1.454.CMB.1.raw
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaagggggctggagtggctgggagttacttggtctgacagacaaatgacatatcacgcggagtccgtgaggggccgattcaccatctccagggacaattccaagagaaccctctatctgcaaatgaacaacttgagagtcgaggatacggtccgtttattactgtgcgacctcgaggagtggctaggaaaagtcgtagtctcacttcccgtcgtacctcgtgggccagggccaccgtgtccaccgtctccgtcacgcttccaacgacgggcccatccggtccttccccgtggtccccg

SEQ ID NO: 251462 - DNA, 647 bp, Homo sapiens
  misc_feature: GYAE6OF01DSLOE.25.28.C06.1.454.CMB.1.raw
  modified_base (251)..(251): a, c, t, g, unknown or other
  misc_feature (251)..(251): n is a, c, g, or t
  modified_base (371)..(371): a, c, t, g, unknown or other
  misc_feature (371)..(371): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccnccagtgtccaggcaaggggctggagtggctgggattacttggtctgacagacaaatgacatatcacgcggagtccgtgagggccattcacatctccaggacaattccaagacgaaccctntatctgacaaatcgaaactaacgttgaagtacgtacggaaggaacgtaccgggtaccgttttaattacgttggtacgaccgtaccctacgaggtaggtggtacgtaagggaaaaagttcgtaagtctactacgttccccggtacgtacccttcggtcggggtacccgacgggcctaccccgtggtacccaccggttcctcccgtacgacgtccttaccccgaacccgtaaccgggtccccaacgttcccggttacccttcccccgtcggtccccgg

SEQ ID NO: 251463 - DNA, 254 bp, Homo sapiens
  misc_feature: GYAE6OF01CRSBX.25.28.C06.1.454.CMB.1.raw
  modified_base (250)..(254): a, c, t, g, unknown or other
  misc_feature (250)..(254): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggcccagggaccaaggtgacatcaaacgactgtggctgcaccatctgtcttcatctccgcatctgaactgtacagtctgagcgggctggcaaggcgcaatagnnnnn

SEQ ID NO: 251464 - DNA, 223 bp, Homo sapiens; identical to SEQ ID NO: 251345
  misc_feature: GYAE6OF01CO4O4.25.28.C06.1.454.CMB.1.raw
  modified_base (220)..(223): a, c, t, g, unknown or other
  misc_feature (220)..(223): n is a, c, g, or t

SEQ ID NO: 251465 - DNA, 551 bp, Homo sapiens
  misc_feature: GYAE6OF01C59TH.25.28.C06.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgganacagatcaccatcacttggccggcgagtcagggcattaggaaattnttggcctggtatnagcaagaaaccagggaacttcctaacctcctcatctatgctgactactcctactttgacttaagtttcggggcccttntcgtattcgacggcggtcaggttgggtcngggacagtactcactctacactatcagcacgtccacgcgacgcctagaagtagttgttagacttaacgtttattacttaagttaactaaaagtttcgaactaggtacgaccggtgtacgttcggtaccggacccggacgggtaaccgtaaggtacgaacgtaactaccgaaacgcgtggtacgg

SEQ ID NO: 251466 - DNA, 581 bp, Homo sapiens
  misc_feature: GYAE6OF01AX4WS.25.28.C06.1.454.CMB.1.raw
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccgattcaccatctccagggacaattccaagacgaaccctctatctgacaaatgaaacaacttgagagtcgaggatacggtcgtttattactgtgcgacctcgaggagtggcgtaggaaaagtcgtagtctctacttcccgtcgacccgtcgtcggggccgacgggccacccgtggtccgacccgtctccctcacgtccttacccgacccacgggccctactcccggtcccttccccgtcggtcccg

SEQ ID NO: 251467 - DNA, 223 bp, Homo sapiens
  misc_feature: GYAE6OF01CZIKU.25.28.C06.1.454.CMB.1.raw
  modified_base (219)..(223): a, c, t, g, unknown or other
  misc_feature (219)..(223): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcacagcggccctgggatgcctggtcaaggactacttccactgtacagtctgagcgggctggcaaggcgcatagnnnnn

SEQ ID NO: 251468 - DNA, 264 bp, Homo sapiens
  misc_feature: GYAE6OF01EC2DN.25.28.C06.1.454.CMB.1.raw
  modified_base (259)..(264): a, c, t, g, unknown or other
  misc_feature (259)..(264): n is a, c, g, or t
tcagactgtacagtcacgaccggtgctcgatttagagctcacgtattgggtttggggggaagaggaagactgacggtcctcccaggagttcaggtgctgggcaccctggtcaccgtctcctcagcttccaccaagggcccatcggtcttccccctggcgccctgctccaggagcacctctgggggcacagcggccctgggctgcctggtcaaggactacttccactgtacagtctgagcgggctggcaaggcgcatagnnnnnn

SEQ ID NO: 251469 - DNA, 516 bp, Homo sapiens
  misc_feature: GYAE6OF01D2SAO.25.28.C06.1.454.CMB.1.raw
  modified_base (461)..(461): a, c, t, g, unknown or other
  misc_feature (461)..(461): n is a, c, g, or t
  modified_base (498)..(498): a, c, t, g, unknown or other
  misc_feature (498)..(498): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacgttcgccgggcgagtcagggctattggaaatttattggccttggtatcagacagaaaaccgagggtaaacgttccctaacctcctcatctatgctgcctcacgttacactcgacgggtcccatctcggttcagcgcagtgaatcgtagggacagtacgttcactctacactatacagccagtcctgcacgcctagaacgtattgttgtactaactttattactagtaactaaagtataactacncgtccctctcgtcgttcggcggaggaccgtaggaganatacaacgtagtggtacg

SEQ ID NO: 251470 - DNA, 769 bp, Homo sapiens
  misc_feature: GYAE6OF01CUKGD.25.28.C06.1.454.CMB.1.raw
  modified_base (332)..(332): a, c, t, g, unknown or other
  misc_feature (332)..(332): n is a, c, g, or t
tcagactgtacagtcacgaccggtgctcgatttagagctcacgtattgggtttggagggaagaggaagactgacggtcctcccaggagttcaggtgcgtgggcaccttgagcactgaacgcagcggactcacatggagttggctgacttgggttttcctgttgtcttacttttaagaggtgtcagtgtcaggcgcatcgtgggtggagtcggtgggggaggcggtggtccaggccgtaggggaacgtccctggacgtaccttctccgtggtcggtggccgtcctagacctccaccttcgaagttagttatcggtcttcgtcgtcgggtaccnccgtaggtcgtaccgagggaccgaaggggtctagggaggtcgggtcgtaggggttacgtttacgtttggggtacctaggaaccgtaaggaacctaaaagtcgaaactagtactacggacggtcgggacgttccgggtggacggggcctaattccaccgtactaccgtaccgaacggtaactaacttaaccgaaacgtaaccgtaaccctacttaactcgtacgaactaaacgtaacgtaaactaacgttaggaacgtaaggtacggtaacgggtaacgtaaccgggttacgtttaacgttacgtacggtcggtacccgtaaccggttaggaacggggtacggtacgggtaacggttaaaacgggtaaaacggttcggttaaacggttccgttaccgtaacccggtttcccggttacccggtaccggttacccggggg

SEQ ID NO: 251471 - DNA, 564 bp, Homo sapiens
  misc_feature: GYAE6OF01A2DEB.25.28.C06.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (225)..(225): a, c, t, g, unknown or other
  misc_feature (225)..(225): n is a, c, g, or t
  modified_base (348)..(348): a, c, t, g, unknown or other
  misc_feature (348)..(348): n is a, c, g, or t
  modified_base (474)..(474): a, c, t, g, unknown or other
  misc_feature (474)..(474): n is a, c, g, or t
tcagactgtacagtcacgaccggtgctcgatttagagctcacgtattgggtttgggggcagaagcctctctcagtcaggacacagcatggacatgagggtccctgctcagctcctgggactcctgctgctctggctcccagctatcagatgtggcatccagatgacccagtctccatcctcctgtctgcatctgttgganacagngtcaccatcacttgccgggngagtcgaggctagttggaaatttattggcctggtatcagcaaggaaaccagggtaaacttcctaacctcctacatctatgctgctatcctacgtttgacttagtttcggggtcccttgtcgtnttcgacggcggtcgtaggtcgggtcgtagggtactacgtacttacctactctacgacctatcgagcgacgcctcgcacgcctagagtagtgttcgtactaacttactacgtagttaactaaagttnacgtaggtacgtaccgtaggtacgtcggtccggaccggtacggaccgtaaggtacgtaacgtacgtaaccgtaaacgtacgtcggtacgg

SEQ ID NO: 251472 - DNA, 570 bp, Homo sapiens
  misc_feature: GYAE6OF01ADE6I.25.28.C06.1.454.CMB.1.raw
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccgattcaccatctccagggacaattccaagagaaccctctatctgacaaatgaacaacttgagagtcgaggatacggcctttatactgtgcgacctcaggagtggctagggaaaagtcgtagtctacacttcccgtcgacctcgtcgggccacgggcacccgtggtccaccgtcctcctcacgtccttccaccgacgggcccagtccggtcccgttcccccgtggcccgtccctcgcccttccgaggacgccgaccctcggtcggggaccc

SEQ ID NO: 251473 - DNA, 698 bp, Homo sapiens
  misc_feature: GYAE6OF01AXXVL.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtggcatccagatcgacccagtcctccactccctccctgtctgcatctggttggagacagacgtccaccatctacgttcggccgggcgaggtcgagggtctaagttggtaaaatttagtttcggccgttaggtactcgaagacgaacgaaaaccgtaaggggtaaacgttaccctaaaccctcctacattctatcgctgctactcctacttcgacttaacgtttcggggtaccctcgtacgtattcgaggcggtacgtaggttcgggtccgtagggaacgtaagttaacgttccgtaaccttccgttacaaccctactacgacgaccgtacgccgtacgaccgacgtccgtaagtaacgtagtttacgttacgtaacttaaacgttttaactttaccgttaagttaaacgttaaaattaccggtaacgttaacggttaccggtaccgggttaggttaaccggttaccggtttacccgggacccggtaaacgggaacccgttaagggtaccgtaacgtacgtaaccgaaaccggtacgtggtaccggg

SEQ ID NO: 251474 - DNA, 625 bp, Homo sapiens
  misc_feature: GYAE6OF01D3J8G.25.28.C06.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccatccctccctgtctgcatctgttgganacagagtcaccatcacgttcggccgggngagtcgaggggctagttaggtaaatttagtttggccttggtatcagacaagaaaccgaagggtaaacgttcctaacctcctacatctatcgctgactactcctacgtttgacgttaacgtttcgggggtccccttcgttacgtaacttcgacggccggtacgtagggttcgggtcgttagggaactaaggtaactttccaacgttctacaccctatcagcacgcctcgcacgccgtagtaagtattcgttacgacttaactttagttacttagttaacttaaaagtttcgaacgtacgtacggtacccggtaggtacgttcggttacccggaccggtaacgggaaccgtaagggtacgtaacgtaacgtaaccgtaaacggtacgtggtacgg

SEQ ID NO: 251475 - DNA, 257 bp, Homo sapiens
  misc_feature: GYAE6OF01EA8BW.25.28.C06.1.454.CMB.1.raw
  modified_base (254)..(257): a, c, t, g, unknown or other
  misc_feature (254)..(257): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggccagggaccaaggtggacatcaaacgactgtggctgcaccatctgtcttacattcttcccgcatctgaactgtacagtctgagcgggctggcaaggcgtcatagnnnn

SEQ ID NO: 251476 - DNA, 735 bp, Homo sapiens
  misc_feature: GYAE6OF01BYJ0B.25.28.C06.1.454.CMB.1.raw
  modified_base (201)..(201): a, c, t, g, unknown or other
  misc_feature (201)..(201): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttgganacagacgtcaccatcacgttggccgggcgagtcgaggggctaagtttagggaaaatttgttcgggccttaggtataccgagccaaggaaaaccgaagggtaaccttaccgtaacctcctacatctaatcggctgactactcctatttcgacgttaacgtttcggggtccccttactcgtactttcgacggtcgggtacgtaggttcgggtcgtagggactaaggtaactttccgactttccgactaaccatccgaacgtccgacgtccgtacgacctacggtacccgtaggtaacgtagtttcggttacgtacctttaaacgtttacgtttaaccgtaacgtttaaaacgttaaaacgttttcggtaaaccgttaccgggttaaccgggttaccccggttaagggttaaccggtttaccgggttacccggggtaacccccgggtaaacgggtaacccgggtaaacgggttacccgggtaaaccgtaaacggttaaaccccgttaaaaaccgggtaccgttagggttaacccggg

SEQ ID NO: 251477 - DNA, 254 bp, Homo sapiens
  misc_feature: GYAE6OF01BWDPO.25.28.C06.1.454.CMB.1.raw
  modified_base (253)..(254): a, c, t, g, unknown or other
  misc_feature (253)..(254): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgccatctgaactgtacagtctgagcgggctggcaaggcgcatagnn

SEQ ID NO: 251478 - DNA, 741 bp, Homo sapiens
  misc_feature: GYAE6OF01CRU8W.25.28.C06.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtgcatccagatgacccagtcctccatccctcctgtctgcatctgtganacagntcacatcacgttggccggngagtcgaggctagttaggtaaatttgttacggccttaggtactcgagtacaaacggaaaccgtaaggggtaaactttacccgtaaaccctcctacacgttctatcgactcgctactcctactttcgacgttaacggttttccgggtaccccgttcgttacggtacttcggaacggtccgggtacgtagggttcgggttacggtaaggggtacctaaggttaaccttcctaaccgttccctaccgtaaccctactacgacgtacccgacggtccctacggaccgaccgtacccgtaaggtaacgttaacgtttcggttaacgtaaccgtttaaacgttttaaacgtttaccgttaacggtttaaaacgttaaaacgtttacggtaacgttaaccggtaccggttaacccggttagggtaacgtttaccgggttcccgggaaacccggtaacggggtaacccgtaaagggttacggtaacctaaacgtaccggtaaaaccggtacggttcgggtaaccgg

SEQ ID NO: 251479 - DNA, 615 bp, Homo sapiens
  misc_feature: GYAE6OF01EKP61.25.28.C06.1.454.CMB.1.raw
  modified_base (347)..(347): a, c, t, g, unknown or other
  misc_feature (347)..(347): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctggggggaggcgtggtccagcctgggaagtccctgagactctcctgtgtggcgcctagactcaccttcagtagttatggcttcgtctgggtccgccagtgtccaggcaaggggctgggagtggctgggagttacgttggtctgacagacaaaatgacatatcacggcggagtccggtggaggggccattccaccatctccgagggacaattccaagacgaaccctntatctgacaaatcgaaactaacttgaagagtcggaaggtacgtacggtaccgtttattacgtgtcgaccgtacgtacgaggtagtcggacgtaagggtaaaagtcgtaacgtctactacgttcccgtcgtacctcggtcgggccgacggccaccgtcgtaccaccgtctcctacgacgtccttaccaccgacggccctacgtccggtcccttccccgtggcccgtccctcgccctaccgacggaccgcctacccgtcggcggggaccg

SEQ ID NO: 251480 - DNA, 510 bp, Homo sapiens
  misc_feature: GYAE6OF01AWTPB.25.28.C06.1.454.CMB.1.raw
  modified_base (494)..(494): a, c, t, g, unknown or other
  misc_feature (494)..(494): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattattggcctggtatcagcaagaaaccagggtaaacgttcctaaacctcctcatctatgactgcatccctactttgctaagtttcggggtacccttctcgtattcgagcggcgaggtgggtctgggacagaattcactctcaccatcagcagcctgcacgcctagaagtgtgttacactaacttattactagttaactaaaattgaactagtcgaccgtgagttcgtacggccgaggacaaggtcgacanacaaacgagtgtacgg

SEQ ID NO: 251481 - DNA, 721 bp, Homo sapiens
  misc_feature: GYAE6OF01EPRRR.25.28.C06.1.454.CMB.1.raw
  modified_base (322)..(322): a, c, t, g, unknown or other
  misc_feature (322)..(322): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccatccctccctgtctgcatctgttggagacagagtccaccatcacgttcggccgggcgacgtcgagggactagttaggtaaaatttgtttcggccttggtatcgagtacgaacgaaaccgagggtaaacgtttccctaacctcctnatctatgctgctatacctacgttttcgacgttaacggttttcgggtcccccttagtacgtaacgtttccgacggtaccgggtaccgtaggttcggggttaccgtaggggaacccgtaaggtaacctttccaaccttaccctaccctaaaccgtaccttacgaacgccgtaccgtcccgtaggacccgacggtacccgttaggaaacgttagtttcgttaaccgtaactttaaacgttttaacttaaccgttaaccgttaaaagttaaacttcggtaacgtacgttaccggtacccggttaggttacgtacccgggttacccggacccggtaaacggggaacccgttaaagggacggtaaacctaacgtaaaccggtaaaacggtccgttggggtaaccg

SEQ ID NO: 251482 - DNA, 626 bp, Homo sapiens
  misc_feature: GYAE6OF01AMEH4.25.28.C06.1.454.CMB.1.raw
tcagactgtacagtcacgaccggtgctcgatttagagctcacgtattgggtttgggggaagaggaagactgacggtcctcccaggagttcaggtgctgggcaccttgggcgacgggggaggtgtgtcacaagatttgggctctgggcaccgtggagtctgggggaggcgtggtccagcctgggaagtccctgagactctcctgtgtggcgcctagactcaccttcagttagttatggcttcgtctgggtccgccagtgtccaggcaagggggctgggagtggcgtgggagtttacttggtctgacagacaaatgacatatcacgcggagtccgtgacggggccattcaccatctccagggacaattccgaaagacgaaccctctatctgacaaatgaaacattgagagtacgagatacggtacgtttattacgtgtgccgacgtcgaggagtcggacgtaggaaaacgtcgtagtctacgtacttcccgtcgtacccgtcgtcgggccgacgggcctacccgtcggtacctacccgtccgttccgtccgtacggtcccttacccgaacccgtaaccgggtccccctacgttcccggttccccgttccccccggtcgggtacccccg

SEQ ID NO: 251483 - DNA, 623 bp, Homo sapiens
  misc_feature: GYAE6OF01CQPGH.25.28.C06.1.454.CMB.1.raw
  modified_base (341)..(341): a, c, t, g, unknown or other
  misc_feature (341)..(341): n is a, c, g, or t
  modified_base (516)..(516): a, c, t, g, unknown or other
  misc_feature (516)..(516): n is a, c, g, or t
  modified_base (614)..(614): a, c, t, g, unknown or other
  misc_feature (614)..(614): n is a, c, g, or t
tcagactgtacagtcacgaccggtgctcgatttagagctcacgtattgggtttgggggcagaagtctctctcagtcaggacacagcatggacatggagggtccctgctcagcctcctgggactcctgctgctctggcctcccagctatcagatgtggacatccagatcgacccagtcctccactccctccctgtcctgctatcgtggttggaagacaggtactcaccatccgtcgtggcccgggagacgtcgagggtctagtaggtaaatttgttcggccttaggtactcgaaggacaaacggaaacgtagggtaaacttccctaacctcctatactctancgtctcgactactcgtctttcgacgttacgtttcgggtccctacgtcgtacttcgacggtcgtcgtagggtcggttacgaggtactaaggtacttccgacttcacctactacgacgaacgctactaccggtctacgagtaccgtaagtagtacgttagtccgtattaaccgtttnttaacgtagtaacttaaagtcaacgtacggtctacccgggtagtacgtcggtaccggacccggtaaggacctaagggtcgactaacggaactaaccgngtacgtcgg

SEQ ID NO: 251484 - DNA, 673 bp, Homo sapiens
  misc_feature: GYAE6OF01EFNAX.25.28.C06.1.454.CMB.1.raw
  modified_base (343)..(343): a, c, t, g, unknown or other
  misc_feature (343)..(343): n is a, c, g, or t
tcagactgtacagtcacgaccggtgctcgatttagagctcacgtattgggtttggggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtcgtgggtcccgccagtcgtccagggcgaagggggctgggagtggctggggtagttacgttggtctgacagaacaatgacatatcgacgcggagtccgtggacggggccgattcacatctccgagggacaattccaagacgaaccctntactctgacaaatgaactactgagagtcgaggatacggtctttatcgtgtcgacgacctacgaggtgtggacgtagggtaaaagtcgtagttctctacgttccccgtcgtacctcggtcgggaccgacgggcctacccggtggtacccgtaccgtcctcccgtacgacgttccttacccgaccggtaaccggtcccgtacgttcccggttacccgtcccccggttcggccccgtcccgtacgtcccgtcccggtaggtaccgtcccgtacccgttcccgggtacggggtacccaccggacggtaccccgggtcccggtcggggtacccgg

SEQ ID NO: 251485 - DNA, 687 bp, Homo sapiens
  misc_feature: GYAE6OF01EDV59.25.28.C06.1.454.CMB.1.raw
  modified_base (333)..(333): a, c, t, g, unknown or other
  misc_feature (333)..(333): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtgcatccagatgacccagtctccatccctccctgtctgctatctggttaggagacagacgtccaacctatccacgttcggccgggcgagtcgagggctaagttaggtaaactttgttcggcctaggtatcgagacaaggaaacgagggtaaacttcctaacctcctactatactagtcgtntcgactatccctacgtttcgacgtttaacggtttccggggtacccttctcgtaacttcgacggtcggacgtagggttcgggtcgtacgggacgtaagtaacttccgtactcgtaccacctatcgtacgcgtacgccgtgacctacgtaccgtaggaagtagttacgtagtaaccttaaacgtttacgttaacctaacgtaaccctaaactaaatttaaacttaaaatttaaacgtttacctttaaccgtaacccgtttaacggttttaccgggaacccgggtaaacgggtaaccggtaaagggttacggaaacggttaactaaaccggtaaacggttaaagttccgggtaacgg

SEQ ID NO: 251486 - DNA, 264 bp, Homo sapiens
  misc_feature: GYAE6OF01D8KOG.25.28.C06.1.454.CMB.1.raw
  modified_base (258)..(264): a, c, t, g, unknown or other
  misc_feature (258)..(264): n is a, c, g, or t
tcagactgtacagtcacgaccggtgctcgatttagagctcacgtattgggtttggggggaagaggaagactgacggtcctcccaggagttcaggtgctgggcaccctggtcaccgtctcctcagcttccaccaagggcccatcggtcttcccctggcgccctgctccaggagcacctcgtggggcacagcggccctgggctgcctggtcaaggactacttccactgtacagtctgagcgggctggcaaggcgcatagnnnnnnn

SEQ ID NO: 251487 - DNA, 255 bp, Homo sapiens
  misc_feature: GYAE6OF01ADUFW.25.28.C06.1.454.CMB.1.raw
  modified_base (251)..(255): a, c, t, g, unknown or other
  misc_feature (251)..(255): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggccagggaccaaggtgacatacaaacgactgtggctgcaccatctgtcttcatcttcccgcatctgaactgtacagtctgagcgggctggcaaggcgcatagnnnnn

SEQ ID NO: 251488 - DNA, 594 bp, Homo sapiens
  misc_feature: GYAE6OF01D8ZZP.25.28.C06.1.454.CMB.1.raw
  modified_base (352)..(352): a, c, t, g, unknown or other
  misc_feature (352)..(352): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattattggcttggtatcagcaaggaaaaccgaggggtaaacgtttcctaaaccgtcctctactctaactgctgcctatccctactttgcttaagtttcggggtcccgtntcgtaattcagcggcaggtgggtctagggacagtaagttccactctacacctatacagcacgcctgcgacgtcctagaacgtattgttcacgttaactttattaacttagttaataaagtttcgaacgtacgttaccgaccggttggtacgttcgggttacccggacccggtaaacggggtacccgtaaagggtacgggtaacctaacggtaacgtaaaaccggtaacggttcggtaccggg

SEQ ID NO: 251489 - DNA, 251 bp, Homo sapiens
  misc_feature: GYAE6OF01BYTFQ.25.28.C06.1.454.CMB.1.raw
  modified_base (249)..(251): a, c, t, g, unknown or other
  misc_feature (249)..(251): n is a, c, g, or t
tcagactgtacagtcacgaccggtgctcgatttagagctcacgtattgggtttgggacagaattcactctcaccatcagcagcctgcagcctgaagatgttgctaacttattactgtacaaaaatttgacagtgaccgtggatgtcggccagggaccaaggtgacatacaaacgactgtggctgcaccatctgtcttcatcttcccgcatctgaactgtacagtctgagcggctggcaaggcgcatagnnn

SEQ ID NO: 251490 - DNA, 220 bp, Homo sapiens
  misc_feature: GYAE6OF01DT9BL.25.28.C06.1.454.CMB.1.raw
  modified_base (219)..(220): a, c, t, g, unknown or other
  misc_feature (219)..(220): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnn

SEQ ID NO: 251491 - DNA, 330 bp, Homo sapiens
  misc_feature: GYAE6OF01AXR0W.25.28.C06.1.454.CMB.1.raw
  modified_base (266)..(267): a, c, t, g, unknown or other
  misc_feature (266)..(267): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (275)..(330): a, c, t, g, unknown or other
  misc_feature (275)..(330): n is a, c, g, or t
tcagactgtacagtcacgaccggtgctcgatttagagctcacgtattggggtttgggacgagaattcactctcaccatcagcagcctgcagcctgaagatgttgcaacttattacctgtacaaaaatttgacagtgacccgtggatgtcggcccagggtaccaaggtggacagtcaaaacgactgtggctgcaccatctgtcttcatccttccgcatctagaactgtacagtctgagcggctggcgaaggcgtacaagtaagctannacngancnnnnnnnnnnnnnnnnnnnnnnnnnnnnnnnnnnnnnnnnnnnnnnnnnnnnnnnn

SEQ ID NO: 251492 - DNA, 521 bp, Homo sapiens
  misc_feature: GYAE6OF01BBRPR.25.28.C06.1.454.CMB.1.raw
  modified_base (407)..(407): a, c, t, g, unknown or other
  misc_feature (407)..(407): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggcctggtatcagcagaaccagggaaattcctaactctcatctatgctgcatccactttgctaagtttcgggggtcccttctcgtacttcaggcggcaggttgggtctgggacagaattcgactctcaccatcagcagcctgcagcctgagatgttnacctaattacttactagttactaaaatttcgaactagtacgtacccggtggaacgttcggttacggacccgagggacccgaaggtcggaacactacgaaacgtcgtggtacggg

SEQ ID NO: 251493 - DNA, 660 bp, Homo sapiens
  misc_feature: GYAE6OF01A4WA4.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctccctgtctgcatctgttggagacagagtccaccatcacgttggccgggcgagtcgagggctaattaggaaatttagtttggaccttggtatcgagcgaacggaaaccgaagggtaaacgttaccgtaacgtcctaccgtgtaactctatcgctcgtccctacctacgttaaccaccgttacgtaccggggtaccctcgttaccgttccggttacgacggtacggactaggtacgtaacgtcgtacggggacgtaaggttacgttacgtacttcctactaacttactacacgccgtacgtccgtacgccacggtctaggaagttgttcgtaacgtacgttaactttacgttaccttaagtaaactaaagttaactaacttaccgtacccgtacccttccgttaccgttacgtttaccggggaccggtaaccgggacgtaacgggtacggaacgtaacgtaacgtaaaggtacgttacggg

SEQ ID NO: 251494 - DNA, 605 bp, Homo sapiens
  misc_feature: GYAE6OF01BM15X.25.28.C06.1.454.CMB.1.raw
  modified_base (477)..(477): a, c, t, g, unknown or other
  misc_feature (477)..(477): n is a, c, g, or t
  modified_base (486)..(486): a, c, t, g, unknown or other
  misc_feature (486)..(486): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccactcctcctgtctgctattctgttggagacagagtcaccatcacgttggccgggcgagtcgagggctagttggtaaatttattggctaggtatcagacaagaaaccgagggtaaacttccctaaccttcctacatctatggctgcctactcctactttcgacgttaacggttttccggggtcccttcgtcgtacttcgtacggcggtcgtaggttcgggtcgtaggggtaacctaaggtaacttcctacctcgtaccacctatcgaacgctacgcctgcgacgtccagtaagtctgtacnctaaacttnttactgtaactaaattcgaactacgtacggtaccgtaggtacgttcggtaccggtacccggaacgggtaaccgtaggggtacgtaaccgtaacgttaaccaaacggttagtcggtacgg

SEQ ID NO: 251495 - DNA, 580 bp, Homo sapiens
  misc_feature: GYAE6OF01EDW1R.25.28.C06.1.454.CMB.1.raw
  modified_base (253)..(253): a, c, t, g, unknown or other
  misc_feature (253)..(253): n is a, c, g, or t
  modified_base (377)..(377): a, c, t, g, unknown or other
  misc_feature (377)..(377): n is a, c, g, or t
  modified_base (533)..(533): a, c, t, g, unknown or other
  misc_feature (533)..(533): n is a, c, g, or t
tcagactgtacagtcacgaccggtgctcgatttagagctcacgtattggggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagttagttatggcttcgtctgggtccnccagtgtccaggcaagggggctggagtggctgggattacttggtctgacagacaaatgacatatcacggcggagtccgtggaggggccattcacatctccgaggacaattccaagacgaccctntatctagacaaatcgaaacacttgagtagtacgaggatacggtaccgtttattactgtgcgacctcgaggagtggcgtaggaaacgtcgtagtctcacgttcccgtcgtaccgtcgtcgggccaggggtccaccgtggtccaccggtcctccgtcncgtcctccaccgacgggccctacgtccgtccttcccccgtggccccg

SEQ ID NO: 251496 - DNA, 603 bp, Homo sapiens
  misc_feature: GYAE6OF01B4CA4.25.28.C06.1.454.CMB.1.raw
  modified_base (205)..(205): a, c, t, g, unknown or other
  misc_feature (205)..(205): n is a, c, g, or t
  modified_base (335)..(335): a, c, t, g, unknown or other
  misc_feature (335)..(335): n is a, c, g, or t
tcagactgtacagtcacgaccggtgctcgatttagagctcacgtattgggtttggggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccnccagtgtccaggcgaaggggctgggagtggctgggagttacgttggtctgacagacaaatgacatatcacgcggagtcgtggaggggccattcaccatctccagggaccaagttccaagacgaacccctntaactctacgacaaatgaaacaacttgagagtcgaaggatacggtccgtttaatactgtcgactacctacgaggtagtcggacgtaaggaaagtcgtagtctacgtacttcccgtacgtacctcgtcgggccgacggcctaccgtcggtccgaccgtctcctcgacgtcctaccaccgtacggccacgtccgtcctccccgtcggtccgcccgtcgccgtccgtacggacgccgaccgtcgcggggcacgacgccggtccgtggtccg

SEQ ID NO: 251497 - DNA, 223 bp, Homo sapiens
  misc_feature: GYAE6OF01CTM37.25.28.C06.1.454.CMB.1.raw
  modified_base (214)..(214): a, c, t, g, unknown or other
  misc_feature (214)..(214): n is a, c, g, or t
  modified_base (219)..(223): a, c, t, g, unknown or other
  misc_feature (219)..(223): n is a, c, g, or t
tcagactgtacagtcacgaccggtgctcgatttagagctcacgtattggggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgnatagnnnnn

SEQ ID NO: 251498 - DNA, 257 bp, Homo sapiens
  misc_feature: GYAE6OF01BDTX1.25.28.C06.1.454.CMB.1.raw
  modified_base (253)..(257): a, c, t, g, unknown or other
  misc_feature (253)..(257): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaaacgaactgtggctgcaccatctgtcttcatccttcccgcatctgaactgtacagtctgagcggctggcaaggcgcatagnnnnn

SEQ ID NO: 251499 - DNA, 500 bp, Homo sapiens
  misc_feature: GYAE6OF01A4ZCA.25.28.C06.1.454.CMB.1.raw
  modified_base (201)..(201): a, c, t, g, unknown or other
  misc_feature (201)..(201): n is a, c, g, or t
  modified_base (342)..(342): a, c, t, g, unknown or other
  misc_feature (342)..(342): n is a, c, g, or t
  modified_base (391)..(391): a, c, t, g, unknown or other
  misc_feature (391)..(391): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgganacagagtcaccatcacttgccgggcgagtcagggcattggaaattattggcctggtatcagcagaaaccagggaacgtcctaacctctcatctatgctgcatccactttgctaatttggggtccctctcgattcgagcggntaggtgggtctgggacagtaattcgactctacaccatcagcagcctgcngcctgagtatgtgctaattattactgttactaaaatttgaactagtcgtaccgtggtagtcgttacggccgtagggaccgaaggtcggacagtacaacgtagtgtacgg

SEQ ID NO: 251500 - DNA, 678 bp, Homo sapiens
  misc_feature: GYAE6OF01DED3H.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctccagctatcagatgtggcatccagatgacccagtctccatcctcctgtctgcatcgtgttggagacagatccaccatccacgttcggccgggagagtcgagggctagttaggaaaacttttagtttcgggccttagggtactacgaacggtacaacggaaaaccgtaaggggtaaaaccgtttcccttaacctacccttactagttctaagtcggacttcgacctagttcctaactttgacgtaacggtttcggggtccctcgttcgtaacttcgacggcggacgtaggtgggtcgtaacgggtactaagtaactttccaacttctactaacccatacgacgacctacgcctaggccgaacgtccgtagtaaccgtagttacggttacgtaaccttaaacgttttacttaacgttagttaaaccttaaaagtttcggaactaacggtagtacccgttggtacgttaccggttaccggacccggtaacggggaaaccgtagggtaacggtaactaacgtaacgaaacggttaagtggtaacgg

SEQ ID NO: 251501 - DNA, 681 bp, Homo sapiens
  misc_feature: GYAE6OF01DLFHR.25.28.C06.1.454.CMB.1.raw
  modified_base (152)..(152): a, c, t, g, unknown or other
  misc_feature (152)..(152): n is a, c, g, or t
  modified_base (196)..(196): a, c, t, g, unknown or other
  misc_feature (196)..(196): n is a, c, g, or t
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
  modified_base (490)..(490): a, c, t, g, unknown or other
  misc_feature (490)..(490): n is a, c, g, or t
tcagactgtacagtcacgaccggtgctcgatttagagctcacgtattgggtttgggggcagaagtctctctcagtcaggacacagcatggacatggacgggtccctgctcagctcctgggacctcctgctgctctggctcccagctatcagntgtgctatccagactcgacccagtcctccacttccctcctgtcngctatcgttggtgacanagactccacctatcgcgtcggccgggngtacgtcgaggtctaagtttaaggtaaatttcggttcggccgttaggtactacgacgacgaaacgaaaccgtagggtaaccttccctaacctctactatactagtcgctacgctactaccgttacgtttcgtaacgttacggtttcccgggtaccttcgtacgttacgtcgtcggtcggtaggtacggtcggtacggtaacggtacgtaagtacctctaccgtacctaccgaactacgtaccgacgaccncgccgtcgaaccgcgtacgtaagtagttatacgtacgtaaccttaacgtttacttacgtaaacttaacttaaacgttacgtaacgtacggttaccggtaccggtacggtaccggttaccgggaccggtaaccggaccgggtaaccgtacgggaacgtaacgaccgtaaggtaaaccgtggtccggtaaccg

SEQ ID NO: 251502 - DNA, 783 bp, Homo sapiens
  misc_feature: GYAE6OF01DEHA4.25.28.C06.1.454.CMB.1.raw
  modified_base (254)..(254): a, c, t, g, unknown or other
  misc_feature (254)..(254): n is a, c, g, or t
  modified_base (427)..(427): a, c, t, g, unknown or other
  misc_feature (427)..(427): n is a, c, g, or t
tcagactgtacagtcacgaccggtgctcgatttagagctcacgtattgggtttgggggaagaggaagactgacggtcctcccaggagttcaggtgctgggcaccgttgggcacgggggaggtgtgtcacaagatttgggctcgtgggcaccgtggagtctgggggagcgtggtccagcctgggaatccctgagactctcctgtgtggcgcctagactcaccttcagtagttatggtcttcgtcgtcgggtcccncctagtcgtccgaggcgaagggggctggagtggcgtgggtagttacgttggtctgaacagaacaaatgacatactcgacggcggtacggttccggtacggacggggtcctattaccgacctactccgtacgaacgggtacctaaacgttaccgaaacgaccgtaaaccccttnttaacgtccgtagaactaaaactacgtaaacctaacgttagacggtaaggtacggtaaggtacgttaaccgggttaccgtttttaattacgtacggtacgcgtaaccccgtggaacgggtacggtacgggaacgttaagggtaaaacgttccggtaacgttccgtaaccgttaccggtttaccccgttccggtaacccggttccgggtaccggggacccgtaaccggggtccctaacccggttccgggttaccctacccggttcccttacctccggtaaccgtcccgttaacccgacccgtaaccgggtccccgttacgtttccccggttccccttcccccgggtcggtacccccg

SEQ ID NO: 251503 - DNA, 745 bp, Homo sapiens
  misc_feature: GYAE6OF01B3PC3.25.28.C06.1.454.CMB.1.raw
  modified_base (150)..(150): a, c, t, g, unknown or other
  misc_feature (150)..(150): n is a, c, g, or t
  modified_base (740)..(740): a, c, t, g, unknown or other
  misc_feature (740)..(740): n is a, c, g, or t
tcagactgtacagtcacgaccggtgctcgatttagagctcacgtattggggtttgggggcagaagtctctctcagtcaggacacagcatggacatgagggtccctgctcagctccgtgggctcctgctgctctggctcccagctatcagntgtgcatccagatcgacccagtctccactcctccctgtctgcctagtctggttggacgtacgagtacgtcacatcgtacgttcggccgggacgtagtacgacgggtactaagttacggtaaatttgttcggtccgtaggtactaccgaaggaccgtaacggtaaaccgtaacggggttaaacttaccctaacccgttacctactaacgttcctaacgttcgaccgttacgtacctaaccttacttaccgtttacgtaaccggttaacgggttttacccgggggtcccctttaacgtccggtaaactttccgggacggtaccgggtacgttacggggttacgggtaccgtaacggggtaactaaccgggttaatttcccgacgtttacctacccgtaacccgtattacccgcgaccgttacgacccgttgaccacgtacgtaagggaactacgttcgtacgtaacttaacgtttaattacgtacgtaaacttaacgttcgaactacggtaccggtacctaggtacgttaccgggttacggaccgtaacggtaccgggtaaggtacgtaactacgtaacgtaaacgtcgggntacgg

SEQ ID NO: 251504 - DNA, 553 bp, Homo sapiens
  misc_feature: GYAE6OF01BUGAR.25.28.C06.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (400)..(400): a, c, t, g, unknown or other
  misc_feature (400)..(400): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcctccatccctcctgtctgcatctgttgganacagagtcaccatcacttgccgggngagtcagggcattggaaattattggcctggtatcagcaagaaaccgagggaattcctaacctcctacatctatgctgctatcccatttcgactaagtttcggggtccctctcgatttacaggcgctaggtgggtcctgggaacctagtaacttacactctaccactatcgaancgacgccctgacacgccgtagaagtgtgtacgtacttaaacttagttaccttagtaaccttaaaattcgaactacggtacgaccgtaggtacgttcggttccggacccgagggaccgaagggtacgactaacgtaacgaacgtaggtgtacgg

SEQ ID NO: 251505 - DNA, 266 bp, Homo sapiens
  misc_feature: GYAE6OF01BCQAC.25.28.C06.1.454.CMB.1.raw
  modified_base (259)..(266): a, c, t, g, unknown or other
  misc_feature (259)..(266): n is a, c, g, or t
tcagactgtacagtcacgaccggtgctcgatttagagctcacgtattgggtttggggggaagaggaagactgacggtcctcccaggagttcaggtgctgggcaccctggtcaccgtctcctcagcttccaccaagggcccatcggtcttccccctggcgccctgctccaggagcacctctgggggcacagcggccctgggctgcctggtcaaggactacttccactgtacagtctgagcgggctggcaaggcgcatagnnnnnnnn

SEQ ID NO: 251506 - DNA, 719 bp, Homo sapiens
  misc_feature: GYAE6OF01CJRTO.25.28.C06.1.454.CMB.1.raw
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
  modified_base (277)..(277): a, c, t, g, unknown or other
  misc_feature (277)..(277): n is a, c, g, or t
  modified_base (329)..(329): a, c, t, g, unknown or other
  misc_feature (329)..(329): n is a, c, g, or t
  modified_base (541)..(541): a, c, t, g, unknown or other
  misc_feature (541)..(541): n is a, c, g, or t
tcagactgtacagtcacgaccggtgctcgatttagagctcacgtattgggtttggggggaagaggaagactgacggtcctcccaggagttcaggtgctgggcaccttgagcactgaacgcagcggactcaccatgggagtttgggctgaacttgggttttcctcgttgcttcgttttaaggnggtntccagtgtcaggcgcatcgtgggtggaggtcgtggggggagcggtggtccagccgtggggaactccctgagacctctccgtgtggtggccncctagacctctaaccttgagttaagttgtcggtctttcgtcgtcggggtccnctaggtcgtccagggtcgaagggggtctagggagtcggcggttaggggtaacgtttacgttgggtactcggaacgtaacgtaactaaaagttcgaaactagttactaccggaaacgggcgggtacgtccgtaggggacgggtccctaattcccgacctaacgtccgtaccgaacgggaactaacgttaccgaaacgtaacgtaaacccgttntaactcgtacgaacctaaagtacgaaactacgttacgagtacgtacggaggtaacgttacggttcttaacgttacgtgtacgacgtacgtaccggaggtacggtcggacgtaaagggtaaacggttcgtaacggttctaccgttaccgtcccgtacggtacccgttcgggtaccgggg

SEQ ID NO: 251507 - DNA, 590 bp, Homo sapiens
  misc_feature: GYAE6OF01BD63U.25.28.C06.1.454.CMB.1.raw
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaagggggctggagtggctgggagttacttggtctgacagacaaatgacatatcacgcggagtccgtgaggggccattcaccatctccagggacaattccaagagaaccctctatctgacaaatgaacaacttgagagtacgaggatacggtccgtttattactgtgcgacctcgaggagtggcgtaggaaaagtcgtagtctctacttcccgtacgtaccgttcgtcggggaccgacgggccacccgtcggtccacccgtccgtccctcacgtccttacccgaccgaacggccctacgtccggttcccttcccccgtcggtccccg

SEQ ID NO: 251508 - DNA, 708 bp, Homo sapiens
  misc_feature: GYAE6OF01AU9DU.25.28.C06.1.454.CMB.1.raw
  modified_base (295)..(295): a, c, t, g, unknown or other
  misc_feature (295)..(295): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacgttgccgggcagtccagggcagttggaaatttatttggcctggtatcagcaagaaaccgagggaaattcctaactcctnaatctatgctgctatcctacttttgcttaacgtttcggggtccccttcttacgtactttcgaacggtcggtctagggttcgggtcttacgggggaacctaggtaactttaccgaaccgttcccgttaccgtaacccctaaacttccgtaaacggacccgtaacgggtccccctttacggtaccccgaaacggtccccgttaagggaaaccgttagttacggtttacgtaaccttaaaccgtttaactttaaccgtttaacgttaaccgttaaaaaagttttcgaaaccgttaacggtacggtaccccggttagggtaacgtttcgggttcccgggacccggtaacgggtaacccggttaaagggtcggtaaaccgtaagtaaccgtaaaccggtaaacgttgggttaaccggg

SEQ ID NO: 251509 - DNA, 573 bp, Homo sapiens
  misc_feature: GYAE6OF01CHISA.25.28.C06.1.454.CMB.1.raw
  modified_base (251)..(251): a, c, t, g, unknown or other
  misc_feature (251)..(251): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccnccagtgtccaggcaaggggctggagtggctggggattactggtctgacagacaaatgacatatcacgcggagtccgtggagggcattcacatctcaggacaattccaagacgaaccctntatcngacaatgaacattgagagtcgaaggatacggtcgttatactgtgcgactcgaggagtgactaggaaacgtcgtaagtctactacttacccggtcgacctcgtcgggaccgagggcctacccgtcggtaccaccgttctcccgtcacgtccttacccaccgaacgggtcccacgtccggttccctccccgtggtccccg

SEQ ID NO: 251510 - DNA, 618 bp, Homo sapiens
  misc_feature: GYAE6OF01B7N92.25.28.C06.1.454.CMB.1.raw
  modified_base (212)..(212): a, c, t, g, unknown or other
  misc_feature (212)..(212): n is a, c, g, or t
  modified_base (256)..(256): a, c, t, g, unknown or other
  misc_feature (256)..(256): n is a, c, g, or t
  modified_base (359)..(359): a, c, t, g, unknown or other
  misc_feature (359)..(359): n is a, c, g, or t
  modified_base (489)..(489): a, c, t, g, unknown or other
  misc_feature (489)..(489): n is a, c, g, or t
tcagactgtacagtcacgaccggtgctcgatttagagctcacgtattgggtttggggggaagaggaagactgacggtcctcccaggagttcaggtgctgggcaccgttgggcacggggggaggtgtgtcacaagatttgggctctgggcaccgtggagtcgtggggggagcgtggtccagcctgggaatccctgagactctcctgtgtggcnctagactcaccttcagttagttatggtcttcgtcgtgggtcccnccaggttcgtccgaggcgaaggggctggagtggctgggattctggtctgacagacaatgacatactcgacgcggagtccggtggacggggccattccgacctntacctccgaggtaactaagttaccaaagaaccgtaaccctactagtcctacgaactaaactacgaaactaacgttgaagtaggtacgaaggtacgtacgtacgtttatcgtatcgacgacctgaggtcgngtactaaggtaaacgtcgtagtcttcgacgttaccgcgtacccgtcggcggcgtacggccctacggtcgcctcgtcctcgtcaccgtctacccgacgacgtcccacgttccgtcccttccggcgtcccg

SEQ ID NO: 251511 - DNA, 659 bp, Homo sapiens
  misc_feature: GYAE6OF01BUQYJ.25.28.C06.1.454.CMB.1.raw
  modified_base (201)..(201): a, c, t, g, unknown or other
  misc_feature (201)..(201): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttgganacagagtcaccatcacgttggccggcgagtcgagggctagttaggtaaatttagttggccttggtactcgagacaagaaaccgaagggtaaacgttcctaaacctcctactactctatgtctgactactcctaatttcgacgttaacgtttcggggtacccttcgtacgtaattcgacggtccggtacgtaggttcgggtcgtacgggacctaggtaactttccgaacttccgtaccactactcgaagtcacgtcctgaccgtacgaccgtagtaatgttagtcgtaaccttaactttaagtacgttaagtaaacttaaacgtttcgaactacgggttaccgtaaccggttggtaccgtttaccgggttacccggacccggtaaacggggtaacccgtaaagggttaccggtaaaccgtacgttaaacccgaaaacgggttaacgttcgggtaccggg

SEQ ID NO: 251512 - DNA, 262 bp, Homo sapiens
  misc_feature: GYAE6OF01BQRN6.25.28.C06.1.454.CMB.1.raw
  modified_base (257)..(262): a, c, t, g, unknown or other
  misc_feature (257)..(262): n is a, c, g, or t
tcagactgtacagtcacgaccggtgctcgatttagagctcacgtattgggtttggggggaagaggaagactgacggtcctcccaggagttcaggtgctgggcaccctggtcaccgtctcctcagcttccatcaagggcccatcggtcttccccctggcgccctgctccaggagcacctctgggggcacagcggccctgggctgcctggtcaaggctacttccactgtacagtctgagcggctggcaaggcgcatagnnnnnn

SEQ ID NO: 251513 - DNA, 559 bp, Homo sapiens
  misc_feature: GYAE6OF01BG98S.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattattggcctggtatcagcagaaaccagggaaacgttcctaacctcctcatctatgctgcatccactttgctaagttttcggggtccctctcgtattcagcggcaggtgggtcgtgggacagaattcactctacaccatcagcacgcctgccagccgtagaagtagttgttacgacgtaactttagtttaaccgttacgttaacttaaaagtttcgtactaggtcgtacccggttggtacgttcggttaccgggacccggtacggggaccgtaagggtacgtaaccaagttaaccgaaacgtacgtggtaccggg

SEQ ID NO: 251514 - DNA, 627 bp, Homo sapiens
  misc_feature: GYAE6OF01B1L7Q.25.28.C06.1.454.CMB.1.raw
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctggggtccgccagtgtccaggcgaaggggctgggagtggctggggagtttacgttggtctgacagaacaaatgacatatcacgcggagtccggtggacggggccattcaccatctccgagggactaattccaagacgaaccctctatctagacaaatgaactaactgagagtcggaagacgtacggtacctttatactgtcgacgtacctcgaggagtggacgtaaggaaaagtcgtagtctacacttcccgtcgaccgtcgtcgggccacgggccaccgtcggtaccacccgtctccctcgacgtccttacccgaaccgaacgggccctacggtcccgttacccgttcccccgtagggcccgtccccgttcggccctacccgacggaccgtacccgtacccgtcgggtccggggtacccg

SEQ ID NO: 251515 - DNA, 719 bp, Homo sapiens
  misc_feature: GYAE6OF01D9XXR.25.28.C06.1.454.CMB.1.raw
  modified_base (150)..(150): a, c, t, g, unknown or other
  misc_feature (150)..(150): n is a, c, g, or t
  modified_base (710)..(710): a, c, t, g, unknown or other
  misc_feature (710)..(710): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagntgtggcatccagatcgacccagtcctccactccctcccgtgtcctgctatctggttaggagacagacgtaccaccatcctacgttcggccgggacgaagtcgagggtactagttaggtaaatttagttcggccttaggtatacgagacgaaacgaacgaagggtaaacttccctaacctcctactactactagtctactcgctacttaccctagtttcgtacgttaacgggtttccggggtcccttacgttacgtacgttaccgacgggtcggtacggtacgggttcggggtacggtaacgggaacctaaggttaaacctttccgtaacccttacctaaccctaaccgtacgtacgacgaccgtacgtcccgcgtaaccgtacgtaccgtaagaacgttgttacggtactaacttaaactttacggttaacttaacttaaacttaaagttacggaacgttaccggtacggtaaccggttaggttaccgttaccggtacccgggaacccggtaaagggtaccgtaaagggtactaacgtaaacgaacccgaaacgttcggngggtaaccg

SEQ ID NO: 251516 - DNA, 674 bp, Homo sapiens
  misc_feature: GYAE6OF01D0ZAL.25.28.C06.1.454.CMB.1.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtgcatccagatgacccagtctccattcctccctgtctgcatctgttggagacagagtcaccatcacttggccggngagtcaggcattggaaattnttggctgtatcagcaagaaccagggtaaacttcctaacctctcatctatgctgcatcctactttcgactaaacggttttcggggcccttctcggtaactttccgaaggtccggcgtaacggttcggggtacttacgggggaactaaggtaactttaccgtaacttccttacctaaccctaattaccgaacgtaccgacgtaccttcggaccgaacggtcccgttaaggaaacgtagttacggtttaggtaacctaaaccttttaacgtttaacgttacggttaaacttaaaaaagttttcggaaactacggtacgtacccggttaggtacgttacgggttacccgggacccggtaaacggggtaacccgtaaacggggttcggaaaccgttaacgtaaaccgaaaaaccgtaaacggttaggtacggg

SEQ ID NO: 251517 - DNA, 261 bp, Homo sapiens
  misc_feature: GYAE6OF01B6DAA.25.28.C06.1.454.CMB.1.raw
  modified_base (258)..(261): a, c, t, g, unknown or other
  misc_feature (258)..(261): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgaccgtggatgttcggcccagggaccaaggtggacatacaaacgactgtggctgcaccatctgtcttcatccttccgccatctgaactgtacagtcgtgacgcgggctggacgaaggcgacatagnnnn

SEQ ID NO: 251518 - DNA, 722 bp, Homo sapiens
  misc_feature: GYAE6OF01B27XV.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtggcatccagatgacccagtctccatccctcctgtctgcattctggttggagacagagtccaccatcacgttcggccgggtcgagtcgaggggtctagttaggaaatttacgtttcggccttaggtatcgagacaaggaaaccgagggtaaacttccctaacctcctcatctatcgctgctactcctacgtttgaccgttaacggttttcggggtcccttcgtacgtattccgagggtccgggtacgtagggttcggggttaccgtaggggactaagtacgtttacccaccttcgtaacccaaccgtacttaccgaacgaccgacgtcccgtcggaccgtaccgtccgtaggaaacgtgttacgttacgtaacccttaaagttttaacgttaaccgtttaagttaaaaccgttaaaacgttttcggaaccgttaacgggttaaccggttacccgggttagggtacccgtttaccggggttaccccgggtaacccggtaaacggggaacccgtaaggggttaccgtaaccgtaaacggttaaacccgaaacggtttacggcgggtaccggg

SEQ ID NO: 251519 - DNA, 670 bp, Homo sapiens
  misc_feature: GYAE6OF01E4W5U.25.28.C06.1.454.CMB.1.raw
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
tcagactgtacagtcacgaccggtgctcgatttagagctcacgtattgggtttgggggaagaggaagactgacggtcctcccaggagttcaggtgctgggcaccttgagcactgaacgcagcggactcaccatggagtttgggctgaacttgggttttcctcgttgcttcttttaagaggtgtccagtgtcaggcgcatctggtggagtcgtgggggagcgtggtccaggccgtgggaactccctgacgactctcctgtgtcggcgcctagactcaccttnagtagttatggctttcgtcgtcgggtccnccagttcgtccgaggcgaacgggggctgggagtggcgttgggtacgtttacgttggtctgacagaacaaagtcgaacatatcgacggcggagtccggtaggacggggcctaatccgactatcctacgacgggtactaacgttacccaaaggtaacgaacccttacgttaatacgtacgaacctaaagttacggaaactaaacgttaggaacgtacggtacggtaaggtacgttaaccggttaccgtttaagttaccgtcggtacgaccgtaccgtacgaagggtaggtcggtacgtaacgggtaaaacgttcgtaacgttcgtacttacgttaccccggtcgtacccgtcggtaccgggg

SEQ ID NO: 251520 - DNA, 629 bp, Homo sapiens
  misc_feature: GYAE6OF01EYS5F.25.28.C06.1.454.CMB.1.raw
  modified_base (187)..(187): a, c, t, g, unknown or other
  misc_feature (187)..(187): n is a, c, g, or t
  modified_base (201)..(201): a, c, t, g, unknown or other
  misc_feature (201)..(201): n is a, c, g, or t
tcagactgtacagtcacgaccggtgctcgatttagagctcacgtattgggtttgggggtcagaagtcttctctcagtcaggacacagcatggacatgagggtccctgctcagctcctgggactcctgctgctctggctccagctatcagatgtgcatccagatgacccagtctccatcctcctgtcngcattctgttgganacagcgtccaccatccacttcggccgggtcgagtcagggactagttaggtaaatttagttggccttaggtactcgacgacgaacggaaacggaagggtaaacgttccgtaacccttcctactattacttaatcgactgactactcctactttacgacgtaacgtttcggggtaccctagtcgtattaccacgtaccgcgtacggtcggtacgtagggaacaacgtaacttacgtacctacctacaacctagtacgacgaccgacgtcccgtacgaccgacgtacccgtaggaacgttagttcgttacgttaactaacgtttattaccgtagttaaactaaagttcgaactggtaccgtaccgtaggtacgtttcggtaccggacccgaggtaacctaaggtcgaacgataaccgaacgtgtaggtacg

SEQ ID NO: 251521 - DNA, 276 bp, Homo sapiens
  misc_feature: GYAE6OF01D6RAJ.25.28.C06.1.454.CMB.1.raw
  modified_base (181)..(181): a, c, t, g, unknown or other
  misc_feature (181)..(181): n is a, c, g, or t
  modified_base (266)..(276): a, c, t, g, unknown or other
  misc_feature (266)..(276): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgaccgtggatgttccggcccagggaccaaggtgacatacaaacgactgnggctgcaccatctgtcttcatccttcccgcatctagaactgtactagtctaggacggcgggtcgtggacgaaggccgcaataggnnnnnnnnnnn

SEQ ID NO: 251522 - DNA, 781 bp, Homo sapiens
  misc_feature: GYAE6OF01DY158.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctggactcctgctgctctggctccagctatcagatgtgcatccagatcgaccctagtcctccattccctcctgtctgctattcgttggttggagacagtacgtccacctatcctacggttcggcccggggtcgacgtcgacgggtactaagtttagggtaaattttagtttcggtccttaggtactacaacggactaaacggaaaaccgtaaggggttaaacctttacccgtaaaccctccgtactacttcctaagtcgactcgtactacgttcctactttcgtacgttaacggtttcgggtcccttacgtcgtacgttcgaacggtcgggtacgtagggtcggtacgtacgggtactaaggttacttaccgaccgttcttaccgaacctagtaccacgacccgtacgtccgtacgacccgtacggtcccgttaaggaagttaccttacgggttaacctaaccgtttaaacgttttaaccgtttaacgtttaaccggttaaaacttaaacgttttacggaaccgtttaacggtaaccggttaacccggttagggtaacccgtttaccggggtaaccccggacccggtaaaaccggggttaccgggtaaacggtacggtaaacccgtaaacgtttaaaccggaaaaccgttaccgggtgggtaacccgg

SEQ ID NO: 251523 - DNA, 705 bp, Homo sapiens
  misc_feature: GYAE6OF01C6W1I.25.28.C06.1.454.CMB.1.raw
  modified_base (229)..(229): a, c, t, g, unknown or other
  misc_feature (229)..(229): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtgcatccagatgacccagtcctccatcctccctgtctgcatcgtgttggagacagatccaccatcacgttggccgggngagtcgagggctagttaggtaaatttagttcggaccgttggttactcgacgtacaaacggtaaaacccgtaaggggtaaacctttaccctaaaccctcctactacttctaatcggactcgcctaacttcctactttcgacgttaacggtttcggggtccctcgtacgtacttcgaggccggtactagggttcgggtcgtacgggtactaaggtaacttccgaaccttactacctaaccctacgtacgaacgtaccgtacgtcccgtcggacctacggtaccgttaggaacgttaacgttacggttacgttaaccgttaaacgttttaactttacgtaacggtttaaacttaaaagtttcgtaaccgtacggttaccgtaccggttaggtacgttccgggtaccggtaacccggtaacgggaaccgtaacgggtaacgtaaccgtaacgttaaccggaaacgtacggtcggtaccgg

SEQ ID NO: 251524 - DNA, 906 bp, Homo sapiens
  misc_feature: GYAE6OF01EQZJL.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttggagacagatccaccatcacgttcggccggggcgagtcgaggggactagttagggtaaaatttagtttcggccgttagggttaatccgaagaccgaaacggaaaacccggtaagggggttaaaacgtttacccccttaaacccttccccttaacctaacttaccttaagttcggtaccttacggacccttaacttaccccttaacgtttttacggtaaccgtttaaacgggtttttccggggggttacccccgtttcgtttaccggtaaaccgttttccgaacgggtccgggtacgtacggggttcggggtttaccggtacgggggaaactaacggtaaaccgttttccctaacccttccgttaacccaacccgtaacttacccggaaacggtaccgtaaccgggtcccttacgggacccgtaaccggtaaccccggttaagggtaaacggtttaggttacggtttaaccggtaaaccctttaaaccgtttttaacgtttaaaccgtttaaaccggtttaaaactttaaaaaacggttttaccggaaccggttaaacgggttaacccgggtaccccgggtttaggttaaccggtttccggggttaaccccgggaccccgggtaaacggggtaaaccccggtaagggttaaccgggtaaacccttaacggttaaacccggtaaaacccggttagttcgggggttacccgg

SEQ ID NO: 251525 - DNA, 628 bp, Homo sapiens
  misc_feature: GYAE6OF01D7X2K.25.28.C06.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttnagtagttatggcttcgtctggggtccnccagtgtccaggcgaaggggctgggagtggctggggagttacttggtctgacagacaaatgacatatcacgcggagtccgtggaggggccgattcaccatctccgagggacaattccaagacgaaccctntatctnacaaatgaacaacttgagagtcgaaggtactacgggtccgtttagttactgtcgacgtacctacgacggaggtcggacgtaagggtaaaaacgtcgtagtctactacgttcccgtacgacccgtcgtcggggccgacgggcctaccgtcgtccgtacccgtcctcccgtcacgtccgttaccaccggaaccggccctacgtcccggttcccgttcccccgtggccccgtcccgtcgccctacccggacggacgcctacccgttcggcggggtacccg

SEQ ID NO: 251526 - DNA, 660 bp, Homo sapiens
  misc_feature: GYAE6OF01APYZS.25.28.C06.1.454.CMB.1.raw
  modified_base (309)..(309): a, c, t, g, unknown or other
  misc_feature (309)..(309): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaatttattggcctggtatcagacaggaaaccagggtaaacgttcctaaacctcctacatctatgctnactatcctacgttttcacgttaacgttttcggggtcccctcgtacgtatttccgaggccggtcgtaggttgggtccgtacggggaacaggtaacttccgtacttcctacctacctactaccgagtccaacgtccctggtaccacggtccctaaggtaacgtaagttcggtttaacgtaccgtaaacttttaacgtttaaccgttaaggttaaacccttaaaaagttttccgaaacctacgggttacgtaacccggtaggtacgttcgggtttacccgggacccggtaaaccggggtaccgaaagggttaccggaacctaacgtaacccgaaacgtaaccgtggttaacggg

SEQ ID NO: 251527 - DNA, 575 bp, Homo sapiens
  misc_feature: GYAE6OF01EWPZQ.25.28.C06.1.454.CMB.1.raw
  modified_base (376)..(376): a, c, t, g, unknown or other
  misc_feature (376)..(376): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtggacggggcattcaccatctcgaggacaattccaaagacgaaccctntactctgacaaatgaaacaacttgagagtcgagatacgcgtttatactgtgcgacctcgaggagtggctaaggaaaagtcgtagtctctactcccgtcgtacctcgtcgggcgacgggcctaccgtggtccaccgttccgtcctcacgtccttaccgacccgaacggccctacgtccgttcccgttccccgtgtacccg

SEQ ID NO: 251528 - DNA, 587 bp, Homo sapiens
  misc_feature: GYAE6OF01EUO03.25.28.C06.1.454.CMB.1.raw
  modified_base (251)..(251): a, c, t, g, unknown or other
  misc_feature (251)..(251): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggagcgtggtccagcctgggaagtccctgagactctcctgtgtggcgcctagactcaccttcagtagttatggcttcgtctgggtcccncagtgtccaggcaaggggctggagtggcgtgggagttacttggtctgacagacaaatgacatatcacgcggagtccgtgacgggccattcacatcncaggacaatccaagacgtaaccctntatcgtgacaaaatcgaaactaacttgagagtacgaggtatacggtactttagtactgtcgcgtaccgtcgaggagtggactaggaaagttcgtagtctacgtacttcccgtcgtaccgtcgtcgggaccgacggcctaccgtgtccgaccgttccgtccgtcacgtccttaccgaccgaacggcccacgtccggtcccttccccgtggtccccg

SEQ ID NO: 251529 - DNA, 279 bp, Homo sapiens
  misc_feature: GYAE6OF01B9X29.25.28.C06.1.454.CMB.1.raw
  modified_base (256)..(256): a, c, t, g, unknown or other
  misc_feature (256)..(256): n is a, c, g, or t
  modified_base (261)..(279): a, c, t, g, unknown or other
  misc_feature (261)..(279): n is a, c, g, or t
tcagactgtacagtcacgaccggtgctcgatttagagctcacgtattgggtttggggggaagaggaagactgacggtcctcccaggagttcaggtgctgggcaccctggtcaccgtctcctcagcttccaccaagggcccatcggtcttcccctggcgccctgctccaggagcacctcgtgggggcacagcggccctgggctgcctggtcaaaggactacttcgactgtacagtctgagcgggctggcaaggcganatagnnnnnnnnnnnnnnnnnnn

SEQ ID NO: 251530 - DNA, 794 bp, Homo sapiens
  misc_feature: GYAE6OF01CR0X4.25.28.C06.1.454.CMB.1.raw
  modified_base (152)..(152): a, c, t, g, unknown or other
  misc_feature (152)..(152): n is a, c, g, or t
  modified_base (596)..(596): a, c, t, g, unknown or other
  misc_feature (596)..(596): n is a, c, g, or t
tcagactgtacagtcacgaccggtgctcgatttagagctcacgtattgggtttgggggcagaagtctctctcagtcaggacacagcatggacatggacgggtccctgctcagctccgtgggactcctgctgctctcgctcccagctatcagntgtggcatccagatcgacccagtctccactccctcctgtctgctatcgttggttaggacgacagtacgtaccaacctatccgtacgttcggggacccggggtacgtacggtaccggaaggggtctaaggttttaagggtaaaagtttttaggtttccggggtaccgttagggtaattaccgaaggtaccgtaaaacggaaaaccggtaaagggttaaacccgtttacccttaaacccgttcccttactaacttacgttaacgttcgactcgtacctaaccgttaccgttacgtttagtaccggttaacgggttttcccggggttacccgttcgtaaccggttacgttcggaaccggttcgggtacggttaaggggtttcggggtaccggtaggggtaaccctaaggttaacctttaccgtaaccgttccttaccaaacccgttntacccgacgtacgaccgtccgtacgacgtaccgacgttaagaacggttacgtagttacgtaaccgtttaaactttactaacgtttaacgtaaacttaaagttccgaagttacggttacggaccgtaggtacgttaccggtacggacccgggaagtaccggtaacgggtacacgtaactaacggaacgtcgtacggtcg

SEQ ID NO: 251531 - DNA, 845 bp, Homo sapiens
  misc_feature: GYAE6OF01EHDX0.25.28.C06.1.454.CMB.1.raw
tcagactgtacagtcacgaccggtgctcgatttagagctcacgtattgggtttgggggcagaagtctctctcagtcaggacacagcatggacatggacgggtccccgctcagctccgtggggcctcctgctgctctggctcccaggtcgcccaatgtgacactccgaggtcgacccagtcctcccttcccaccctgtctgcatcgtagtaggggacagacgtcacctatccacgttcggccgggaccaggtcggtagttcggttgggtcggtcgttttcggccgttggtactcgacgtaccaacaaaacccggaacgggaaaaccgcccccctaaaacttccccgttaccttaccgtagtcggacggtccgtttaccttaaccctttaccgaccgtaccgttacgggtacccgttaccccctacggtaacggtttaccgacggtaccgggtacctaggggtaccgttagtaccggtacggggaacctaaggtaaccttccaccttccgtaccacccgtagtacgaccggtccggtaccctcggtacccgtaccgttgtaagttacggttacttttaccggaacctttaaacttacttacgtaccgtacccgtaataacccgttaagtttaaccttttaacggtttttacctacccggtttacgggtttacccccgtttttaccgggtttaccgggtaacccgggtaaccgggggggttaacgtacgggggttaacgggaccgtaacgggtacccggtaaacggtacccgggttacgtacgggttaccgggtccctaacgggtacccaaccgggttactttaccggttccgttaccgtttaccccg

SEQ ID NO: 251532 - DNA, 648 bp, Homo sapiens
  misc_feature: GYAE6OF01AM0MU.25.28.C06.1.454.CMB.1.raw
  modified_base (338)..(338): a, c, t, g, unknown or other
  misc_feature (338)..(338): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaaggggctggagtggctgggagttactggtctgacagacaaatgacatatcgacgcggagtccgtgaggggccattcacatctccgagggacaattccaagacgaaccctntatctgacaaatgaaactaacgttgaagtagtacgaaggtacgtaaccggtccgttttaagttacgtggtacgtccgaaccgtaccgagggtacggtgggacgtaaggtaaaaacgtcgtacgtctacgtacgttcccggtacgtacccgtacggtcggggaccgacgggacctacccgtcggtaccacccggttcgttcccgtccgagtcccgtacccgaaccgacggccctacggtccgttcccgtccccgtgggccctcccgtcgcccgtaccgacggaccgtaccgcccgtcggtcggggtacccg

SEQ ID NO: 251533 - DNA, 631 bp, Homo sapiens
  misc_feature: GYAE6OF01ELJKC.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttggagacagacgtcaccatcacgttcgccgggcgagtcgagggctaagttggaaaatttagtttcggccttaggtatcgagacaaggaaaaccgagggtaaacttcctaaccgtcctacactctatgctgctatcctactttgacttagtttcgggtcccgtgtcgtacttcgacggtccgggcgtaggttcgggttcgtaggggaactaacgtaacttcaaccttcgtaccaaccataccacgaccgacgccctgaccacgtacctaggaacgttacttggttacgaccttaaacttttacgttaacgttagttaaacttaaaagttcgaacgtaaggtaccgtacccggttaggtacgtttcgggttacccgggaccggtaagggaacccgtaagggtaccgaactaagtaaccgaaaacgtcgttggtacgg

SEQ ID NO: 251534 - DNA, 677 bp, Homo sapiens
  misc_feature: GYAE6OF01B3LQI.25.28.C06.1.454.CMB.1.raw
  modified_base (208)..(208): a, c, t, g, unknown or other
  misc_feature (208)..(208): n is a, c, g, or t
  modified_base (329)..(329): a, c, t, g, unknown or other
  misc_feature (329)..(329): n is a, c, g, or t
  modified_base (478)..(478): a, c, t, g, unknown or other
  misc_feature (478)..(478): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtgcatccagatcgacccagtcctccacttccctcctgtctgacctatctgttggaanctaggactccacctatccgacgttcggcccggggagtagtcgagggactagttaggtaaaatttcgtttgaccgttggtattcagaccgaaagaaaccgaacggtaacttacccgtaaccnccttcatctagtcgctcgactactcctaacgtttgcgttaaagtttcccggggcccttctaccgtattcgacggcggtcgtaaggttcggtgtacgggaactaggtaactttccaactcccttaccgaactacttacccagacgttacncctgacccacgccgtagaagtccgttagtcaaccttaacttacgtttaactacgttaaaacttaaattacgtaccgtagttacccgggacgttacgggtaacttccgggtacccgggaaccccgtaaacgggggtaaaccgtaacgggttaagaaacccggtacttaaaacgaaacgggttaaaccgtggtttaccggg

SEQ ID NO: 251535 - DNA, 671 bp, Homo sapiens
  misc_feature: GYAE6OF01B17SB.25.28.C06.1.454.CMB.1.raw
  modified_base (148)..(148): a, c, t, g, unknown or other
  misc_feature (148)..(148): n is a, c, g, or t
  modified_base (230)..(230): a, c, t, g, unknown or other
  misc_feature (230)..(230): n is a, c, g, or t
  modified_base (494)..(494): a, c, t, g, unknown or other
  misc_feature (494)..(494): n is a, c, g, or t
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagntgtggcatccgagactcgacccagtctccatccctcctgtcctgcatctgttagatacagactcaccatcacgttggccggngacgtcgagggctagttacggaaatttgttcgggcctggtatcaggcaagaacgtagggtaacttcctaaacctctactatctagtcgctagctactcctacgttgactaagtttcgggccctgtacgacttcgacggtaccggtcgtaaggtcggttaccggtagggactaacggttaacttcgtaaccgttacctcgtaaacccgtacgttacgtaaacgcgtaaccgttccgtacgacccgtagcccgtaagaaaccggtnttacggtaccgtaacttaaccgtttaactttacggtaactaaaccttaaagttcgaaccgtaacggtaccggtaccggttaagggacgttttaaccgggttcccgaaacccggtaaacggggtaccctaaaggggttccgaaaccgtaagaacccggtaaaagtccgtagggtacgg

SEQ ID NO: 251536 - DNA, 868 bp, Homo sapiens
  misc_feature: GYAE6OF01CL7IN.25.28.C06.1.454.CMB.1.raw
  modified_base (163)..(163): a, c, t, g, unknown or other
  misc_feature (163)..(163): n is a, c, g, or t
  modified_base (265)..(265): a, c, t, g, unknown or other
  misc_feature (265)..(265): n is a, c, g, or t
tcagactgtacagtcacgaccggtgctcgatttagagctcacgtattggggtttgggggcagaagtctctctcagtcaggacacagcatggacatggacgggtccctgctcagtcctccgtgggacctcctgctgtctctcggcctcccagtcctatcaagtntggtggcactccgagtacgtaccgaaccctcgtcctaccctacctccctccctgtctcgacctattcgtacggttagggaacgacgacgtacgtccaacctntccgtacgtccggaccggggtgtacggtcggaggtactaggttaacggttaatttacggttccggtaccgtagggttacctcgaaccggaaccgtaaaaccgggtaaaccggaaacgggttaaacctttaccccctaaccccttcccgtaacttaactccttaagtcgtcctacgacctaccgttacccttagtttccgtaaccggtttacgggtttcccggggtcccgttaccgtcggttactacggtagggtcggtacggtaacggggttcgggtacggtacgggtaactaacggttacttccgtacctaccctcaaccgtactacgacggacctacgtccgtcgacgtcggtacttacgaagttggttacttaacgtaaccttacgttttaactaacggttaaaccgttaaacgtttaaacggtacggtaaccggtaaccgggtttcccggtaaaccggggtttacggggtaaccggtttacccggggtaccccgggaaaccggggtaccgggttaaaacccggtaacggggtttaaacccgaaccgttaaaacccggtttaaacccggaaaccgtttaaaggggttcgggttaacccgg

SEQ ID NO: 251537 - DNA, 693 bp, Homo sapiens
  misc_feature: GYAE6OF01CW4FR.25.28.C06.1.454.CMB.1.raw
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (679)..(679): a, c, t, g, unknown or other
  misc_feature (679)..(679): n is a, c, g, or t
tcagactgtacagtcacgaccggtgctcgatttagagctcacgtattgggtttgggggcagaagtctctctcagtcaggacacagcatggacatgacgggtccctgctcagctccgtgggactcctgctgctctggcctccagctatcagtatgtggcatccagatcgacccagtctccacttcctccctgtctgactattcgtggtgggacactagacgtacactatcacggtggccggagagtcgaggctagttaggtaaattgttgactgactcaggacaagtaaaccgtaaggtaccttacctaactcctatatctagtnacgtnactacgtctaacgttcgtaacgtcggtttacccggggtccttatcgttaaccttcggaacggcgggtactaaggggttcgggtacgaacgggactaacggtaacgtacctactaccgtacaacctacgtacgaacgtaccacgtcctacggtaccacgaccgtagaacgttagttacggttaactaaccgtttaaactttaacgttaaccgttaaacgtaaacgtttaaacgttacggtaaacgttacggttaccggtaccggttagggttaccgttacccggggttacggaccggtaaacggggtaacgtaagggtaaccgtaaccggaaacgttaccgtaaaaccggnggttaagtaccggg

SEQ ID NO: 251538 - DNA, 664 bp, Homo sapiens
  misc_feature: GYAE6OF01DAFRM.25.28.C06.1.454.CMB.1.raw
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (417)..(417): a, c, t, g, unknown or other
  misc_feature (417)..(417): n is a, c, g, or t
tcagactgtacagtcacgaccggtgctcgatttagagctcacgtattgggtttgggctgaactgggttttcctcgttgcttcttttaagaggtctccagtgtcaggcgcatctgggtggagtcgtggggggagcgtggtccagcctgggaagtccctgagactctcctgtgtggcgcctagactcaccttcagttagttatggtcttcgtctggggtccgcctagtcgtccaggcgaagggggctgggagtggcgtggggatttacgttggtctgacagacaatgacatatcacgcggagtccgtggaggggcctattccaccatcgtccgaggacaattcaagacaccctntatctaganaaatgaacaacttgagagtacgaggactacggtctttatactgtcgcgactgaggnggtagacgtaagtaaacgtcgtagtctcgtacgttccgtacgtaccgtcgtccgggacgacggtaccgacccgttcggtcccgtacccgttcctccgtacctcgtacccgtaccgaacccgaacccgggtcccctaccggttcccgttacccccgttccccggtccgggtaccccgtccccgtccggtccccgtaaccgtaacgggacccgacccggttaacccgttccgggtacgggggtacccgg

SEQ ID NO: 251539 - DNA, 714 bp, Homo sapiens
  misc_feature: GYAE6OF01DYAQV.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtggcatccagatcgacccagtcctccactcctcctgtctgcatcgtgttggagacagacgtacacctatccacgttcggccgggagtagtcgagggctaagttaggtaaaatttgttggccttggtatcgagacaaggaaaccgaagggtaacgttccctaaccgtcctactagtactagtcgctgctactacctactttcgtacgttaacggtttccggggtcccttcgttacgtacgttacgacggtcggacgtagggttcgggtcgtaggggaacctagttaaacttcctaccgttcctacctaaccctatcgaacgtcccgtaacgtccctcggaccacgtaccgtaaggtaacgtagtttcggttaactaaccttaaacgttttaacttaacgtttaacgttaaactttaaaaagtttcggtaaaccgttaacgggttaccgtaccggtagggttacgttacccggggttaccggaaccccgggtaaggggtaaacccggtaagggtaaccggtaaactaaaccgtaaaccgtaaaacggttcgttcgggtaaccgg

SEQ ID NO: 251540 - DNA, 220 bp, Homo sapiens; identical to SEQ ID NO: 251490
  misc_feature: GYAE6OF01BTVWH.25.28.C06.1.454.CMB.1.raw
  modified_base (219)..(220): a, c, t, g, unknown or other
  misc_feature (219)..(220): n is a, c, g, or t

SEQ ID NO: 251541 - DNA, 519 bp, Homo sapiens
  misc_feature: GYAE6OF01B71I9.25.28.C06.1.454.CMB.1.raw
  modified_base (226)..(226): a, c, t, g, unknown or other
  misc_feature (226)..(226): n is a, c, g, or t
  modified_base (402)..(402): a, c, t, g, unknown or other
  misc_feature (402)..(402): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggngagtcgagggcattggaaatttatttggcctggtatcagcaagaaaccagggtaaacttcctaaaccgtcctcatctatgctgcatccactttgactaagtttcggggcctctcgacttcgagcgctaggtgggtctagggacagtacttcgactctcacctatcagcagcctgcncgcctgattgtatttgactaacttattactcgacaataataataattaattactacgtacttacgtttagaccgtaagggacgtaaggagtaacgataacgaaacgtagtggtacgg

SEQ ID NO: 251542 - DNA, 246 bp, Homo sapiens
  misc_feature: GYAE6OF01C77IY.25.28.C06.1.454.CMB.1.raw
  modified_base (220)..(220): a, c, t, g, unknown or other
  misc_feature (220)..(220): n is a, c, g, or t
  modified_base (226)..(246): a, c, t, g, unknown or other
  misc_feature (226)..(246): n is a, c, g, or t
tcagactgtacagtcacgaccggtgctcgatttagagctcacgtattgggggtttggggggaagaggaagactgacggtcctcccaggagttcaggtgctgggcaccgttgggcacgggggaggtgtgtcacaagtatttgggctctgggcacaggcggccctgggctgcctggtcaaggactacttccactgacagtctgagcgggctggcaaggcganagtagnnnnnnnnnnnnnnnnnnnnn

SEQ ID NO: 251543 - DNA, 801 bp, Homo sapiens
  misc_feature: GYAE6OF01EIJII.25.28.C06.1.454.CMB.1.raw
  modified_base (213)..(213): a, c, t, g, unknown or other
  misc_feature (213)..(213): n is a, c, g, or t
  modified_base (287)..(287): a, c, t, g, unknown or other
  misc_feature (287)..(287): n is a, c, g, or t
  modified_base (331)..(331): a, c, t, g, unknown or other
  misc_feature (331)..(331): n is a, c, g, or t
tcagactgtacagtcacgaccggtgctcgatttagagctcacgtattgggtttgggggcagaagtctctctcagtcaggacacagcatggacatgacgggtccctgctcagctccgtgggactcctgctgctcgtgctccagctatcagatgtgcatccgagactcgaccctagtcctcctactccctcctgtctcgctattcgtggtacganacgagtactccactatcgtacgttcggccggagtacgtcgaggtactagttaggtaatttggtcgcgttagtancgagacgaacggaacgtaggtaaccttacccgtaacctctactntacctatcgtacctagcctacttcctacttgacgttacggttccggtccctgtcgtacgtcgacgggtcgtaacggttcggtgggtacgtacgggtaactacgttacttccgtacgttacctaaccaacgttacctacgacggtacctaaccgtccgtacggtaccgtacgttacccgaaggttaccgttaacgttacggttaacccttaaccgttttaaacgtttacggtttaaacgttaaaccggtttaaaacgtttaaccggtttaccggaaaccggtttacgggttaacccgggttacccgggttaaacgggttttacccgggtttaaccccggggttaccccgggtaaaccccggggtaacggggttaaaacccggggtaaacgggttaaacggttaaaccccgttaaacggggtaaaaacccccgggttaaggtttaaaccccggggtcgttaaacccccgggg

SEQ ID NO: 251544 - DNA, 602 bp, Homo sapiens
  misc_feature: GYAE6OF01EMV8F.25.28.C06.1.454.CMB.1.raw
  modified_base (487)..(487): a, c, t, g, unknown or other
  misc_feature (487)..(487): n is a, c, g, or t
tcagactgtacagtcacgaccggtgctcgatttagagctcacgtattggggtttgggggcagaagtctctctcagtcaggacacagcatggacatgagggtccctgctcagctcctggactcctgctgctctggctcccagctatcagatgtggcatccagatcgacccagtcctccatccctccctgtctcgctatctagttgagacagagtcaccatcacgttcggccgggcgagtcagggcaagttaggaaatttgttggccttgggtatcgagacaaacggaaaccgtaggggtaaaactttcccaaaccttccctacaattcctaagtcgctgccaattccctaagttttcgacttaacggtttcggggtccctgtacgacttcgacggtcggcgtaggtcggtacgtcgggaacaggtaactttccacctccgtaccaaccctagtacaagccaagtcccgtgaccacgcctaagaacgtntagttcgactaacgtttataactagtaactaaattcgaactgtacgccgtaggtacgttcgtacggacccgagggaacccgtaggacgtaccagtaaccgaaacgtctggtacgg

SEQ ID NO: 251545 - DNA, 778 bp, Homo sapiens
  misc_feature: GYAE6OF01C9KJH.25.28.C06.1.454.CMB.1.raw
  modified_base (254)..(254): a, c, t, g, unknown or other
  misc_feature (254)..(254): n is a, c, g, or t
tcagactgtacagtcacgaccggtgctcgatttagagctcacgtattgggtttggggggaagaggaagactgacggtcctcccaggagttcaggtgctgggcaccgttgggcgacgggggaggtgtgtcacaagatttgggctctgggcaccgtggagtcgtgggggaggcgtggtccagcctgggaagtccctgagactctcctgtgtggcgcctagactcacttcagtattatggcttcgtcgtcgggtccnccaggtcgtaccgaggccgaagggggctgggagtggcgtgggagtttcgttggtctgacagacaaatgaacatatcgacggcggtacgtccggagggacggggacctattaccacctatccgtaccgaagggaacctaaacgttaccgaaaaggtaacccgtaaacccttacttagtaccgttacgaaacgtaaaacgtcgtaaaaacgttaacgttagggaaccggtaaggtaaccggtaaagggtaacggttaaccgggttaccggttttaacgtttaaccggtaggttacggacccgtaaccgttaccggaaggggtacggtacggtaacggttaaagggtaaaacgggtttcgtaacgttacgttaccgtacgtttccccgaaccgttaccgtcgggtcgggaccgacgggtacccgtacccgttcggtacccgtacccgtaccgtccgtacgacgtccccgttaccgaaccggttaccggccctaacgtccccggttcccgtccccgtccggtaccccc

SEQ ID NO: 251546 - DNA, 849 bp, Homo sapiens
  misc_feature: GYAE6OF01C8NAS.25.28.C06.1.454.CMB.1.raw
  modified_base (238)..(238): a, c, t, g, unknown or other
  misc_feature (238)..(238): n is a, c, g, or t
  modified_base (431)..(431): a, c, t, g, unknown or other
  misc_feature (431)..(431): n is a, c, g, or t
tcagactgtacagtcacgaccggtgctcgatttagagctcacgtattgggtttggggggaagaggaagactgacggtcctcccaggagttcaggtgctgggcaccttgggcgacgggggaggtgtgtcacaagatttgggctctgggcaccggtggagtcgtgggggaggcgtggtccagccgtgggaagtccctgagactctcctgtgtggcgcctagactcaccttcagtagttanggtctttcgtctgggtccgaccagtcgtccgagggcgaagggggtctgggagtggcgtgggagttacttggtctgacaagtacaaatgaacatactcgacggcggacgtccggtgggacggggaccgtattccgacctacttaccgtacccgaggggaacctaactttaccgaaaaggtaaccgaaccccttntaacttccgtaggaacctaaaataggaaaaccctaagtttggaaaggtacggtacggaagggtaacgtttaaccgggttaccgttttaattacgttaggttacgtaccggtaaccctacggtaagggtacggttacggtacgtaaacgggtaaaaacggttccgttaaaggttccttaaccgttaaccgtttaccccggttaccgtaacccggttccgggttacgggggtccccgtacgggggtacccctaccccgggtttaccgggtaaccccgtaccccggttcccgttaccccgtacggtaacccgttacccgtttaacccccgaaaccccgggttaaccccggggtacccccgttaacccgggtttccccgggttttacccccccgttcccccgggtcccgggtcccccccggg

SEQ ID NO: 251547 - DNA, 784 bp, Homo sapiens
  misc_feature: GYAE6OF01CID0R.25.28.C06.1.454.CMB.1.raw
  modified_base (143)..(143): a, c, t, g, unknown or other
  misc_feature (143)..(143): n is a, c, g, or t
tcagactgtacagtcacgaccggtgctcgatttagagctcacgtattgggttgggggcaagaagtctctctcagtcaggacacagcatggacatgaggtccctgctcagctcctggactcctgctgctctggctccagtctancagatgtgcatccagatcgaccctagtctccacgtccctcccgtgtcctgacctagttcgtggttggaactacgagtacgtccacctagttccacgttggccgggagtacgtcggaagggtcctaagttaggtaaagtttcgttcggacccgttggtaactccgaagaccgtaaaaggtaaacccggtagggtaaactttccccctaaacctccgtaccgtaattcccgtaatcgggtaccctaggacctaccttccgtaacgtttcggacctttaacggggtttcccggggtaccctgttcgtaaacgttccaacggggtccgttacgtaggtcccgggttactaggggtactaaggtaccttcgtaacccttcgtacctaaccggtatccggtaagccgtaaccgtcgtacggtaccgtacggtaccgtaacggaacgttacgtttcggtacggaacctttaacgtttaggttacccgttaagtaaaccctttaaacggttgaaacccgttgggttaacccgacccggtgttaacccggttccgggacccgggtacccggtaaacgggtaacccggtaagggttacccgtaacccgttaaagtaaccccgtaaaaccgggttccggtggttaaccccgg

SEQ ID NO: 251548 - DNA, 593 bp, Homo sapiens
  misc_feature: GYAE6OF01C0KO4.25.28.C06.1.454.CMB.1.raw
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaaggggctggagtggctggggattacttggtctgacagacaaatgacatatcacgcggagtccgtggaggggccgattcaccatcctccgagggacaacttccgaaagacgaaccctctactactgacaaatgaaacaacttgagagtcgaggatacggtcgttttatactgtgcgtacctagaggtagtggactaggaaaagttcgtaagtcttcattcccgtcgacctcgtcgggccacggccacccgtcggtccaccgtctccgtcacgtccttccaccgtaacggccctacgtccggtcccgttcccccgtgcccgtccctcgtaccgtcccgtaacggcgccgaccgtcgtcggggtaccg

SEQ ID NO: 251549 - DNA, 919 bp, Homo sapiens
  misc_feature: GYAE6OF01DBKRJ.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtggcatccagatcgacccagtcctccacttccctcccgtgtctcgactattccgttggttaggacaaccgtaggacgtaccctaaccaacttccgtaacggtttcgggaccccgggggagtaacggttccggaacggggtacgtaaaggttttaacgggttaaaaatttttcggtttaccggggtacccgtttagggttaacttaccgaagggtaaccgaaaaccggtaaaaaccccggtaagggggttaaaaacccgtttcccccttaaacccgttcccttacgtaacttccgttaacgttcgtaccgttacgtaacctacctttacccgttaccgttttacggtaaccgtttaaccggggtttttccgggggttacccccgtttccgtttaacggttaaccgttttaccggaacggggtccggggttaaccggttaacggggttttccgggggttaacccggttacggggggtaaaaccgttaacggtttaaaaccctttcccgttaaaccccgtttacccgtaaccccttaaccccggtaactttaacccgtaacggacccggttaaccgtcccgtacggtacccgtacgtacccgttaaggaacgttacgtagttacgtaacttaacgtttaacttacgtaacttaacgttaaattcgaacgtacgttacgacccgggttagaccggttacggttacccggacggtaacggtaccggtaaggtacgtaaccgtaacgtaaccgtaaaccggtgttggtaccgg

SEQ ID NO: 251550 - DNA, 796 bp, Homo sapiens
  misc_feature: GYAE6OF01AIJUX.25.28.C06.1.454.CMB.1.raw
  modified_base (203)..(203): a, c, t, g, unknown or other
  misc_feature (203)..(203): n is a, c, g, or t
tcagactgtacagtcacgaccggtgctcgatttagagctcacgtattgggtttgggggaagaggaagactgacggtcctcccaggagttcaggtgctgggcaccttgagcgactgaacgtcagcggactcaccatggagtttgggctgaacttgggttttcctcgttgcttcttttaagaggtctcctagtgtcaggcgtacnttccgtgggtggagtcggttgggggatcggtcggtacctagtcccgtaggggtactccccgtaggactccttccgtcctggtacggtcggtccgtccttaggaccttccaacccgtttacgagttaacgttacgtcggtctttccggtcgtcgggtaccccgtcgtacgttcggtccgaacggcggtaaggggtctacgggagtccggtagtcggggtaacgttacggttcggtcttacggaacgacgtaaacgtaagttcgaacttacgagtacccgtacgggtcggtacggtcccggtagggaccggggtcgtaccttccggaccgtacgtccgtaccgtacgggactacttaaccggaacgtaccgtaacccttacgtactaccggtcgtaaacgttaacgacctaaacgtttaactaggaaccggtagtaccgggtaaggtccgggttaacggttaccgtttaattaacggtcgttacggtccgtacggtaccgtacgggtattcgggtaccttaaagggtaaccgttaccgtagttaccgttaacgtacccttacccgggaaccgttacccgcgggttaaacccgggg

SEQ ID NO: 251551 - DNA, 622 bp, Homo sapiens
  misc_feature: GYAE6OF01ERMGW.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgtgagacagagtcacatcacttggccgggcgagtcagggctagttggtaaatttagttggccttggtatcgagcaagaaaccgagggtaaacttccctaacctcctacacttctatcgctgcctacttccctacgttttcgacgttaacggttttcgggggtaccccttcgtacgtaacttcgacggtccgggacgtaggttcgggtacgtaggggtactaagtaacttccacttcctaccactacgtcacgcacgtcctgacacgctaggaagtacttggttacgacttaactttattaccgtagttaaacctaaagtttcgaacgtaggttaccgtaccgttggtacgtttcggttacccggacccggtaacggggaccgtaagggtacggtaacctacggtaaaccaaacggtacgttgggtacgg

SEQ ID NO: 251552 - DNA, 899 bp, Homo sapiens
  misc_feature: GYAE6OF01DK27Y.25.28.C06.1.454.CMB.1.raw
  modified_base (168)..(168): a, c, t, g, unknown or other
  misc_feature (168)..(168): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctccagctatcagatgtgcatccagatcgacccngtctccactccctcctgtctgcatctggttaggagacagtacgtcaccatccacgttcggccgggagacgtcgagggtctagtttaggtaaaagtttgtttcggccgttggtatacacggacgaaacggtaaaccggtaaggggtaacctttacccctaaacctccttacgtacttaccttagtcggtctacggtacctaccttcccgttaacgttttacggtaaccgtttaaacggggttttttccccggggggtaccccgttttaccgttaccggtaacgtttaccggtaacggggtcccgggtacggttaacgggggtttcggggttacccgggttacggggtaaaccgtaacgtttaacccgttaccgtaaccgtttacccgaccgtaaaccctacgttaaccgacgtaccgaaccggtccgtaacgtaccggtacggttaccgttaaggtaagtaccgttttaacggttaccgtaaacccgtttttaacgtttaaccgttttaacgttaaaaccggttttaaaacgtttaaaaccggtttacggtaaacggtttacccggggtaaccggtttaaacccgggttaggggttaacccggtttaccggggttacccccgggtaaaccccgggtaacgggggttaaacccggtaaagggttaaaccggggtaacccttaaaaccggttaaaccggtaaacccggttacgggttccggggttaaacccggg

SEQ ID NO: 251553 - DNA, 775 bp, Homo sapiens
  misc_feature: GYAE6OF01BDEMK.25.28.C06.1.454.CMB.1.raw
  modified_base (202)..(202): a, c, t, g, unknown or other
  misc_feature (202)..(202): n is a, c, g, or t
  modified_base (611)..(611): a, c, t, g, unknown or other
  misc_feature (611)..(611): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtgcatccagatcgacccagtcctccactcctcctgtctgcatctgttgganacagacgtccaccatcctacgttcggccgggcaggtccgagggtctagttaggtaaattttagttcgggccttaggttactcgaagactaaacggaaaaccgtaaggggttaaacgttaccccttaaaccctcccgttactaactttaccgttattcggtaccgttacgacctaacctttaccccgtaacgttttacgaacccgtttaaacgggtttttcccggggggttacccccgttagttccccggttaaagtttccgaacgggtccgggtacgtacgggttcggggttaccgtaagggggaacctaaggttaaccgttttaccctaaccgtacccttaccgaccccttaagtacccgaacgcccgtacgtacccttacggacctacgggtacctaggtaaacgtnttcggttacgaacctttaacgtttaacgtttaaccttaacgttaaacttaaacgtttcggaaacgtacggttaccggacccggttaggtaaccgttcgggttacccggacccggtacgggtaaccaagggttagaaccctagtaaccgaaacgtagtcggtacg

SEQ ID NO: 251554 - DNA, 274 bp, Homo sapiens
  misc_feature: GYAE6OF01EKGY3.25.28.C06.1.454.CMB.1.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (249)..(274): a, c, t, g, unknown or other
  misc_feature (249)..(274): n is a, c, g, or t
tcagactgtacagtcacgaccggtgctcgatttagagctcacgtattgggtttgggacagaattcactctcaccatcagcagcctgccagcctgaagatgttgctaacttattactgtacaaaaatttgacagtgacccgtggatgttcggcccagggtaccaaggtggacatacaaacgatgtggctgcacatctgtctcgatcctccgcatctgactgacngtctgngcggctggcaggcgcatagnnnnnnnnnnnnnnnnnnnnnnnnnn

SEQ ID NO: 251555 - DNA, 960 bp, Homo sapiens
  misc_feature: GYAE6OF01BH2AL.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctccagctatcagatgtgcatccagatcgacccagtcctccatcctcctgtctgcatctgttggagacagtacgtccacctatctacgttcggccgggacgaacggtcgaacggggtacctaagtttacgggtaaaaattttacgttttcggggtacccgtttagggttaacgttaccgaaacggtaccgaaaacgggtaaaaaacccggtaaacgggggttaaaaaaccgttttaaccccccgttaaaacccctttacccgttacctaactttaaccgtttaacgtacgggtaccttcggaacccgttaacccttttaccccgtaaaccgtttttacgggtaaccccgttttaaaacggggttttttcccggggggggttaccccccgtttaccgttaacccgggttaaacgtttttaccgggaaaccggggtccggggttaaccgggtaaacgggggttttccggggggttacccggtttaacggggggtaacccgtaaacgggttaaacccgttttaacccgtacccgttaaccccgtaacccgttaaaccccgaaacgtttacccggaaccgtacccgtaacggtccccgttacggaaccgtaccgtaacccgtaaggtaacggtaacggtttgttaccgtaaccgttaaacttttaacgtttaaccttaacgtttaaaacgttaaacgttacgtaaaccggtacgttaaccggttaacccgggtaggttaggtttacccggttaccggtacccgggtaacgggaaaccggtagggttaaacggaactaacggtaaccgaaaaccggtgttcgggtaaccgg

SEQ ID NO: 251556 - DNA, 810 bp, Homo sapiens
  misc_feature: GYAE6OF01DHSYT.25.28.C06.1.454.CMB.1.raw
  modified_base (224)..(224): a, c, t, g, unknown or other
  misc_feature (224)..(224): n is a, c, g, or t
  modified_base (256)..(256): a, c, t, g, unknown or other
  misc_feature (256)..(256): n is a, c, g, or t
tcagactgtacagtcacgaccggtgctcgatttagagctcacgtattgggtttggggggaagaggaagactgatggtcctcccaggagttcaggtgctgggcaccttgggcacggggggaggtgtgtcacaagatttgggctcgtgggcaccggtggagtcgtgggggagcgtggtccagccgtgggatcctgagctctctgtgtggcgcctagactcaccttnagttagttatggtctttcgtcgtcggggtccnctagtcgtccgaggcgaaggggctgggagtggcgtggggactttacgttgggtctagacagaacaaatgaactataatcgaacggcggtagtccggtggacggggtccctattccaccgattccctaccgaaaggggtactaacgttaccgaaaaggaccgtaaacccttgttaaactcgtagaccaaaattacggaaactacgttaggagtacgtacggaaggtacgttaacggttacgtttaactttacgtgttaccgccgtacgtacgtaacgggtagtacgggtacgtaaagggtaaaacgtttccgggttaagttacccttacggttaacccgtttccccgggttaccgtaacccggtttcccgggtaccgggggtaccccggaacggggttaccccctaacccgggttaccgggtacccgtaacccggtttccccgttacccggttacccggtaccggttacccccgtttaccccgaaacccgggttaaacccgggtaccccttaaccggtttccccgggttaccccctttcccccccgggtcccggg

SEQ ID NO: 251557 - DNA, 651 bp, Homo sapiens
  misc_feature: GYAE6OF01BXENC.25.28.C06.1.454.CMB.1.raw
  modified_base (232)..(232): a, c, t, g, unknown or other
  misc_feature (232)..(232): n is a, c, g, or t
  modified_base (556)..(556): a, c, t, g, unknown or other
  misc_feature (556)..(556): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctccagctatcagatgtggcatccagatgacccagtcctccatccctcctgtctgctatctgttggagacagactccacctatcacgttcggccgggngtacgtcgagggtctagttaggtaaatttgttggcctggtactcgagacaacgaaaccgtagggtaaacgttaccctaacctccgtactacttactagtgctagactaccttcctacgtttcgacgttaacggtttcggggtcccttacgtacgtacttaccgacggtccggacgtacgggttcgggtacgtacgggtaacaacggttacttcctaccgttacctacctaaccacgttacacggtacctacggcctacggacacgtaccgtaagtaacgtgttacgttcaacttaacttattaacgttattaaacttaagttanaccgtagttaccgtacggtaggtcttccgggtaccgacccggtagggaaccgtaagggtacgtaaccgtaacgaacgtaaacgtcggtggtaccg

SEQ ID NO: 251558 - DNA, 713 bp, Homo sapiens
  misc_feature: GYAE6OF01DPF2C.25.28.C06.1.454.CMB.1.raw
  modified_base (188)..(188): a, c, t, g, unknown or other
  misc_feature (188)..(188): n is a, c, g, or t
  modified_base (383)..(383): a, c, t, g, unknown or other
  misc_feature (383)..(383): n is a, c, g, or t
  modified_base (689)..(689): a, c, t, g, unknown or other
  misc_feature (689)..(689): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtcgtgggggaggcgtggtccagcctgggaagtccctgagactctcctgtgtggcgcctagctcaccttnagtagttatggtcttcgtcgtcgggtccgccagtcgtccaggcgaaggggtctagggagtcggcgtggggtattacgttggtctagacagaacaaatgacagtactcgacgcggacgtccgtggacgggccgtattccgaccatccgtaccgaagggactaacttaccgaagaaccgtaacccttcgtataccgngtaacaaatacgaaactaacgttaggaagtacgtacggaaggtacgttaacgggtccttttaagttacgtgtacgaccgtaccgtacgaaggtacgtagggtagttaaacgggtaaaacgttcggtaacgttacgtccgttaaccgttcccggttaccgtacccgttcgggtaccgggccgtacgggtcctacccggtcgtcctacccgttcctaccgtcgtacgtcccttaccgaaccgtaaccggccctacgtcccgtccccgttaccccggtgtccccgtcccgactcccgaccgtacggacncccgtaaccgtcggtcgggacccg

SEQ ID NO: 251559 - DNA, 879 bp, Homo sapiens
  misc_feature: GYAE6OF01E50KL.25.28.C06.1.454.CMB.1.raw
  modified_base (831)..(831): a, c, t, g, unknown or other
  misc_feature (831)..(831): n is a, c, g, or t
tcagactgtacagtcacgaccggtgctcgatttagagctcacgtattgggtttgggggcagaagtctctctcagtcaggacacagcatggacatggacgggtccctgctcagtcctccgtgggcctcctgctgctctcggcctccagtctagtcgagtacgtggtacgactacgtaccagactaccgtacctctccctacctccttccctcgtcgtcgtacgtactacgtacggttaggtaacggacgtaaccgtacgtacctaccctaaccgttaccggtccggtaccgggtcggggaaccggtaggtaaccggtacggttaacggttaaacgtttaaggtttaaacggtttaaacgtttcggttaccggtaccggttaacgtaacctaacggaaacccgtaaaacggtaaaaccccggttaaaccggttaaacccttacccttaaccccttcctaccttacgttacgtttactacgtaccgttaccgttaccgttaccttaccggtttaacgtttaccgggttaacccggtttacccgggtttacgggttccccgttaaccggtacgtaccggttacgggtccgggaccggggttacggggttacggttacggggtaacgtacccgggttaactacccgttaaccgtaccctacctacccgtaaccggtaccctaacggtaccgtaccgggtacctaccggtcccgtacgtaccgtacgtaacgttaaggtacttacgttacgtaacttacgtttaaacgtaccttaacgttaacttacgtaaacgttcgtaccggtacgtcggtacgtcggaccgtcggtaccggaanacgggactacgggtaacacgtaccggtacaacggtcgtcgtcgtaccg

SEQ ID NO: 251560 - DNA, 684 bp, Homo sapiens
  misc_feature: GYAE6OF01EUNR4.25.28.C06.1.454.CMB.1.raw
  modified_base (154)..(154): a, c, t, g, unknown or other
  misc_feature (154)..(154): n is a, c, g, or t
  modified_base (370)..(370): a, c, t, g, unknown or other
  misc_feature (370)..(370): n is a, c, g, or t
tcagactgtacagtcacgaccggtgctcgatttagagctcacgtattgggtttgggggcagaagtctctctcagtcaggacacagcatggacatgacgggtccctgctcagctccgtgggactcctgctgctcgtcggcctcccagctatcagngtgtgctatccagatcgaccagtcctcctactccctcctgtctacactctgtgacgatacgagtccaccactacgtcgtacggtccggggacggtacgtacggtacggtacgtagttagttaaaggtttaagtttcggtccggtacgttagtacgacgaacgaacgaaacggtaaaccggtacggttaacccttaccctaccgtctactagttacngtcgtacgatacctcttacgttgtacgtacgttcgggtccgtactgtactgacggcggtgtacgggtggtcgtaggtacgtaagtactaccgtcctaccgtcctaacccgtagtaccgtagaccggaccgtccggtcgaacgaaccgtccgtaacggtagttaacggttcgttactaaccgttaactttaactttactaacggttaaagtttaaacctggtaccgagttcccggtagtccgtacgttcgggtaccggtaccggacggtaacggacgttacgacgtaacgtacgaacgttaccggtggtcgtacc

SEQ ID NO: 251561 - DNA, 723 bp, Homo sapiens
  misc_feature: GYAE6OF01C3P4N.25.28.C06.1.454.CMB.1.raw
  modified_base (219)..(219): a, c, t, g, unknown or other
  misc_feature (219)..(219): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
tcagactgtacagtcacgaccggtgctcgatttagagctcacgtattgggtttggggggaagaggaagactgacggtcctcccaggagttcaggtgctgggcaccttgagcactgaacgcagcgactcaccatggagttgggctgaacttgggttttcctcgttgtcttacttttaaggaggtcgtccagtgtcgaggcgcatcgtggtggagttcggngggggagcggtggtccagccgtgggaactccgngacgctctcgtgtgtcggcnctagacctctaccttcaagttagttagtcggtcttcggtcgtcgggtccgccgtagtcgtaccgaggacggaggggtctgggagtcggcggtagggttacgttacgttggtactacgaacgtaacggtaaactaaagtacgaaactaagtacgtaccgaacggtcgggtaacggtccgggtaggggaccggggtcctaacgttaccaccgtaacgttcccgaacggaacgggtaaccttaaacgttaccgaaaagtacccgtaacccttacgttactaccgttaacgaaactaagtaaccgtaaacttaacgttaggaagtacggtacggtaacggtacgttaccgttagttacgttaacgtcgaccggtacgtacgaggtaagtagggtcgtaaggtaaaggtaaacgttgtaacgtctacgttaccgtccgtacgtccgtggtaccggg

SEQ ID NO: 251562 - DNA, 618 bp, Homo sapiens
  misc_feature: GYAE6OF01ARD2M.25.28.C06.1.454.CMB.1.raw
  modified_base (347)..(347): a, c, t, g, unknown or other
  misc_feature (347)..(347): n is a, c, g, or t
  modified_base (381)..(381): a, c, t, g, unknown or other
  misc_feature (381)..(381): n is a, c, g, or t
tcagactgtacagtcacgaccggtgctcgatttagagctcacgtattgggtttgggggggaagaggaagactgacggtcctcccaggagttcaggtgctgggcaccttgggcacgggggaggtgtgtcacaagatttgggctctgggcaccgtggagtctggggggagcgtggtccagcctgggaagtccctgagactctcctgtgtggcgcctagactcaccttcagtagttatggctttcgtctgggtccgccagtgtccaggcaagggggctgggagtggctgggagttattggtctgacagacaaatgacatatcacggcgagtccgtggaggggccattccncatcctcgagggacaactccaaagacgaaccctntaatctagacaaatgaaactagttgaagagtcgaggtagtacgtacgtttattactgtcgcgtacctcgacggtaggtggtacgtaggtaaaaggtcgtagtacctcgtacgttcccgtacgtacctcggtacgggccgtacgggcctaccgtcggtacctaccgtcgtcccgtcacggtccttaacccgaacgaccgggtacccacgttccggttcccttcccccgtgggtccccg

SEQ ID NO: 251563 - DNA, 657 bp, Homo sapiens
  misc_feature: GYAE6OF01EDSFD.25.28.C06.1.454.CMB.1.raw
  modified_base (398)..(398): a, c, t, g, unknown or other
  misc_feature (398)..(398): n is a, c, g, or t
tcagactgtacagtcacgaccggtgctcgatttagagctcacgtattgggtttgggggaagaggaagactgacggtcctcccaggagttcaggtgctgggcaccttgggcgacgggggaggtgtgtcacaagatttgggctctgggcaccgtggagtctgggggaggcgtggtccagcctggggaagtccctgagactctcctgtgtggcgcctagactcaccttcagttagttatgggtctttcgtcgtgggtccgccagtcgtccagggcaaggggctggagtggcgtgggattacgttggtctgacagaacaaatgacatatcacggcggagtccggtaggcggggcctattcacctatccgtcgaagggactaattccgaaagacgtaaccctntaactctagactaaaagtagaaactaacgttgaagtaggtacggaaggtacgtaccggtacgttttattacgtgtacgcgtacctacgaggtggtaggtacgtaaggtaaaacgtcgtagtctacgtacttcccgtaccgtaccgtcggtcgggccgtacgggcctaccgtcggtcccgtaccgttccgtcccgtacacggtcctacccgaaccgaaccgggtcccacggttcccggttcccttccccggtggtccccg

SEQ ID NO: 251564 - DNA, 709 bp, Homo sapiens
  misc_feature: GYAE6OF01CN763.25.28.C06.1.454.CMB.1.raw
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
tcagactgtacagtcacgaccggtgctcgatttagagctcacgtattgggtttgggggcagaagtctctctcagtcaggacacagcatggacatgagggtccctgctcagctccgtgggactcctgctgctctggcctcccagctatcagatgtgcatccagatcgacccagtctccatcctccctgtctgctatctgttgganacagctcactatctacgtgccggnagtcgaggcagttaggaatttagttcgctggtancagcaaggaaccagggtaacttcctaacctcctacatctancgtcngcatcctattgaccttaggtttcgggtccctgtcgtacttcgacggtcggtagaggggttcggtacgtacggggtaacgtaacggttaaccttaccggttaaccttaccccgtacccgtaaacccctacgttaccggtacgacccgtaaccgtcccttacggacccgttaccggacccgttaaggtaaacggttagtttaacgggtttaccaaccgtttaaaccgttttaacttaaccggtttaacttaaacccgtttaaaagtttcggaaaccgttaggttaaccccgtaccgggttaggttaccggttccgggttaccccgggaccccgggtaaaccgggtacggtaaaccgggttaccggaacaacgtttaacccgaaaccgtcgggttgttaccggg

SEQ ID NO: 251565 - DNA, 802 bp, Homo sapiens
  misc_feature: GYAE6OF01A9YMS.25.28.C06.1.454.CMB.1.raw
  modified_base (329)..(329): a, c, t, g, unknown or other
  misc_feature (329)..(329): n is a, c, g, or t
tcagactgtacagtcacgaccggtgctcgatttagagctcacgtattgggtttgggggggaagaggaagactgacggtcctcccaggagttcaggtgctgggcaccttgggcacgggggaggtgtgtcacaagattgggctctgggcaccgtggagtcgtgggggaggcgtggtccagccgtgggaagtccctgagactctcctgtgtggcgcctagactcaccttcagtagttatggtcttcgtcgtcgggtccgccaggtcgtccagggcgaagggggctgggaggtggcgtgggtagttacgttggtctgacagacaatgacatancacggcggagtccggtaggacggggcctatacacctatcctaccggaggactaactaccaaagaccgaaccctctaactacgtacgactaaagtacgaaactaacgttaggaaggtacggtacggtaacgggtaacttaaccggggttacctttttaaactttacgtacgggttacggtaccccggtaacgtacgtaacgggtaagggtacgggtaacgttaaacggggaaaagtttccgttaacgttccgtaaccgtttaccgtttacccccgggtaccgggttaacccgtttcggggtccgggggtaacccgtacgggtaaccccgttacccggtttcgggtaccccgaacccggtttccgttcccccgtagtaccccggttacccctaccccgggtaaacccggaacccgggttaccccctacggtttaccccgggtttccccccgtttccccggtcgggtaccccccgg

SEQ ID NO: 251566 - DNA, 879 bp, Homo sapiens
  misc_feature: GYAE6OF01B1SO9.25.28.C06.1.454.CMB.1.raw
  modified_base (285)..(285): a, c, t, g, unknown or other
  misc_feature (285)..(285): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtcgtgggggaggcgtggtccagcctgggaacgtccctgagactctcctgtgtggcgcctagactccaccttcagttagttatggtcttcgtcgtcgggtcccgcctagtcgtccaggcgaagggggtcnggaggtgggcgttggggagtttacgttgggtctgacagaacaaagtcgaactatataccgacggccggtacggttcccggtagggacgggggccctaactttccgaaccctacgttcccgttacccggaaacggggtaacctaaacgtttacccgaaaacggtaaccgtaaacccccttacgtttaacgtaccgtacggtaaacctaaaaacgttacgaaaaaccttaaacgtttggaaacgggtaacggtaaccgggtaacgggttaacggttaacccgggtttacccggtttttaaagtttaacccggttagggttaccgggtaacccggttaacccgttaccgggtaaaggggtaacgggttacgggtaaccggttaaaaggggtaaaaacgtttcgggttaaacgttccgtttaaccgttacccgtttaccccggtaccgtaacccgttccgggtaccggggtccgaccgggtacccacccggttcggtcccgtaacccgttccgttcccgtaccgaccgttcccgtacccgtacccggaccgggtccccttacggttccccggttccccgttccccgtcgggtcccccg

SEQ ID NO: 251567 - DNA, 249 bp, Homo sapiens
  misc_feature: GYAE6OF01A34GE.25.28.C06.1.454.CMB.1.raw
  modified_base (249)..(249): a, c, t, g, unknown or other
  misc_feature (249)..(249): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgaccgtggatgttcggcccaggaccaaggtgacatcaaacgactgtggctgcaccatctgtcttcatccttccgccatcctgaactgtacagtctgagcggctggcaggctcatagn

SEQ ID NO: 251568 - DNA, 842 bp, Homo sapiens
  misc_feature: GYAE6OF01C97CM.25.28.C06.1.454.CMB.1.raw
  modified_base (797)..(797): a, c, t, g, unknown or other
  misc_feature (797)..(797): n is a, c, g, or t
tcagactgtacagtcacgaccggtgctcgatttagagctcacgtattgggtttgggctgaactgggtttcctcgttgctcttttaagaggtgtccagtgtcgaggcgcatcgtgggtggagtcgtggggggaggcgtggtccagcctgggaacgtccctgagtactctccgtgtgtggcgctagacctctaccttcagttagttatggtcttcgtcgtgggtcccgccaggtcgtaccgaggcgaaggggtctagggaggtggccgtaggggtacgtttacgttggtctagaccgaagaacaaagtcggaacctaatacgtaccgaaccgggtaccgggtacggttaccggtaggggaaccggggggtacccttaacgtttaccccaaaccgtaacgttaccccggttaaccggaaaccggggaaccttaaacgtttaccccgaaaaacggttaaaccccgtaaaccctttcgtaacgttaccgttaacggaaaacctaaagtaacgtaaaacctaacgttagaagtacggtacgaggtaacgttacggttaccgttttagtacgtgtacgtccgtaccgtaggacggtagtaccgggtagtaaacgggtaaaacgttcgttacgtaaccgttacgtaccgtttcccggaccgtacccggtcggtacgggccgtaacggggtacccctaaccggtcggtaacccctcccggttacccttaccgaccggtacgttacccttacccggaacccggtaccgttcctacccggttccgttccccgtacccggcggtccccncgttcccgtaccgacgtacgacctcggacccgttggccggtaacg

SEQ ID NO: 251569 - DNA, 341 bp, Homo sapiens
  misc_feature: GYAE6OF01AJ466.25.28.C06.1.454.CMB.1.raw
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (301)..(311): a, c, t, g, unknown or other
  misc_feature (301)..(311): n is a, c, g, or t
  modified_base (313)..(341): a, c, t, g, unknown or other
  misc_feature (313)..(341): n is a, c, g, or t
tcagactgtacagtcacgaccggtgctcgatttagagctcacgtattgggtttgggacagaattcactctcaccatcagcagcctgcagcctgaagatgttgctaacttattactgtacaaaaatttgacagtcgaccgtggatgttcggccgagggaccaaggtggacatcaaacgactgtgactgccacatctgttctcacgtcccttaccgcctagtcctacgtaacgtcgtaaccgttagtccgtaagccggagggtccgtggacggtaacggcgacagtagcangtcngctgntgnnnnnnnnnnncnnnnnnnnnnnnnnnnnnnnnnnnnnnnn

SEQ ID NO: 251570 - DNA, 883 bp, Homo sapiens
  misc_feature: GYAE6OF01EUI0J.25.28.C06.1.454.CMB.1.raw
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcacttcagtagttatggcttcgtctgggtccgccagtgtccaggcaagggggctggagtggcgtgggagttacgttggtctgacagacaaatgacatatcacggcggagtccggtaggacgggggcctagttacaccgattccaccgaaggggacctaaacgttccaaaaggaacgtaaaccccttacttaaacttcctacggactaaaaacgtacgtaaaacctaaaccgtttaggaaggtaacgggttaccggtaacggggtaaacgttaaaccggggttaccgttttttaaacgttttaacccgttagggttaccggtacccggtaacccgttaccgtaaaggggtacgggttacgggtaaccggttaaaggggtaaaaaaacggggtttaccggttaacggttaccgtttaccgttaaccgttttacccccggttaccggtaaccccgttaccgggttaccgggggtacccggacgggggtaccccgtaaccccggttacggggttacccgttaacccccggtttacccgttacccccgttacccgtaccggtcccttaaccccccgtaaaccccgggtaaacccgggtaaccccccggttaaccggtttaacccccgggtttcccccggtttccccccccgtacggggttcccccccggg

SEQ ID NO: 251571 - DNA, 777 bp, Homo sapiens
  misc_feature: GYAE6OF01D9FH7.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctccagctatcagatgtggcatccagatcgacccagtcctccacttccctcctgtctgctattcgttggtaggacgacgagacgtaccaccgattccacgttcggcccgggagtagtcgacgggtactaagttaggtaaatttcgttcggaccgttaggtactacgaggtacgaaaacggtaaaaccggtaaggggttaaacctttacccctaaaccgttccctactacttaccgttagtcggacttacgtacctacttaccctagtttacggacgtttaacggtttcccggggtacccttacttacgtaacgtttccggaacgggtccggtacggttacgggttcgggttaccggtaggggtaaacctaaacggttaacttttccccgaacgtttcccctaaccgtaaccctacgtaccgtacgcctaaccgtccgttacgacctacgtccgtaagtaaacgtgttacgtaaccgtaactttaacgtttaacgttaacgtagttaaacgttaaagttcggacgtaacggttacggtacccggttaggtaccgttaccgggttacccggaccggtaacggggtaaaccgtagggtaaccgtaaccgttaaacgtaaacccgtaaacggtacgttggtaaccgg

SEQ ID NO: 251572 - DNA, 584 bp, Homo sapiens
  misc_feature: GYAE6OF01BGBEM.25.28.C06.1.454.CMB.1.raw
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggagcgtggtccagcctgggaagtccctgagactctcctgtgtggcgcctagactcaccttcagttagttatggtcttcgtctgggtccnccagtgtccaggcaagggggctggagtggntgggattacgttggtctgacagacaatgacatatcacggcggagtccgtggacgggccattcacntcncaggacaattcaagacacctntatctgacaaatgaaactaagttgaagtcgtagaggtacgtacggtaccgtttattacgtgtcgacgaccgtacgtaggaggtggcgtaaggaaacgttcgtagtctctacttccgcgtacctcggtgggaccaggccaccgtcgtaccctccgtcctcctgactccttaccaccgacggtacccagtacccgttcccgtccccgtgtccccg

SEQ ID NO: 251573 - DNA, 690 bp, Homo sapiens
  misc_feature: GYAE6OF01B98W7.25.28.C06.1.454.CMB.1.raw
  modified_base (242)..(242): a, c, t, g, unknown or other
  misc_feature (242)..(242): n is a, c, g, or t
tcagactgtacagtcacgaccggtgctcgatttagagctcacgtattgggtttgggggcagaagtctctctcagtcaggacacagcatggacatggagggtccctgctcagctccgtgggactcctgctgctctggctccagctatcagatgtgcatccagatcgacccagtcctccactcctccctgtctagcattcgtgttggacgacagactacgaccataccgacgtcgggaccgggngaggtcgaggggtactaagttaggtaatttacgttggtccgtagtagtacgaaggtacgaaacggtaaaccggaaggggttaaacctttacccgttaaccctaccgtacgtacttaccgtaattcgacttccgactaccgttccttaacgtttacgtacggttaaacggttttccggggtacccttacgtacgtaacgttcgaggtcggacgtagggttcggacgtacgggataactacttacgactctacacgctacgacgtacacgccttacgacgtcgtaccgtaaggaacgttgtacggttactaactaactttagttaacctagttaaacgtaacttggaactacggtacccgtaggtagtacgtccggttacccgggaaccggtaagggacccggtaaaggtcgtaacctaaagtaacccgtaaacggtaggtcggtaccgg

SEQ ID NO: 251574 - DNA, 670 bp, Homo sapiens
  misc_feature: GYAE6OF01D0D81.25.28.C06.1.454.CMB.1.raw
  modified_base (384)..(384): a, c, t, g, unknown or other
  misc_feature (384)..(384): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggccaccgtggagtctgggggagcgtggtccaggcctgggaacgtccctgagactctcctgtgtggcgcctagacctcaccgttcacgttagttactgggtcttcgtctgggtccgccagtgtccgaggcaaggggctggagtggctgggattacgtggtctgacagacaatgacatatcacgcggagtccgtggacgggcctattcacatcgccgaggactatccgaagacgtaaccctntactcgtggactaaatcgaaaacctacgttggaaggtacgtacgaacggtaacgttacggtaccgttttaacttacgtagttcgacggtaccgtacgaaggtagtcggtacgtaacggtaaaacggttcgtacgttctacgtaccgttacccggtaccgtaccgttcggtacgggaccgtacgggacctacccgtcggtacccgaccgttccgttcccgacgtaccgtccgttacccgaaccgtaaccgggtccctacggtcccgttccctccccgtggtaccccg

SEQ ID NO: 251575 - DNA, 253 bp, Homo sapiens
  misc_feature: GYAE6OF01CPHAL.25.28.C06.1.454.CMB.1.raw
  modified_base (180)..(180): a, c, t, g, unknown or other
  misc_feature (180)..(180): n is a, c, g, or t
  modified_base (246)..(246): a, c, t, g, unknown or other
  misc_feature (246)..(246): n is a, c, g, or t
  modified_base (251)..(253): a, c, t, g, unknown or other
  misc_feature (251)..(253): n is a, c, g, or t
tcagactgtacagtcacgaccggtgctcgatttagagctcacgtattggggtttggggggaagaggaagactgacggtcctcccaggagttcaggtgctgggcaccctggtcaccgtctcctcagcttccaccaagggcccatcggtcttcccctggcgccctgctccaggagcactcgngggcacagcgcctggctgcctggtcaaggactactcactgtacagtctgagcggctggcaaggcgnatagnnn

SEQ ID NO: 251576 - DNA, 696 bp, Homo sapiens
  misc_feature: GYAE6OF01BGH11.25.28.C06.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccactccctccctgtctgctatctggttgganacagactccaacctntccacgttcggccgggcgagtcgagggctagtttaggtaaatttagtttcggccgttaggtactcaaggacgaacggtaaaccgaaggggtaaacctttaccccgtaaccttcctacgtacttctacgtcgtacctacgtcacttaccctacgtttcgacgttacggtttcggggtaccccttgtccgttatccgtaggcccggtgtaggtcggggttacgtacgggactaaggtaactttaccgtacttcccactacctaacgtcgacgtcccgacgtcccacggaccgtacgtaccgaagtacgtgttacgtacgtacttaactttacgttaaccgtattaaaaccgtaattaccggacgttacgggtaccgtaccggtaggtttacccggaccgggtttacccggaaccggttaacgggaaccggtaacgttacggaaacctacgttaaacgaccgttaacggttcggtacg

SEQ ID NO: 251577 - DNA, 706 bp, Homo sapiens
  misc_feature: GYAE6OF01BFGTY.25.28.C06.1.454.CMB.1.raw
  modified_base (153)..(153): a, c, t, g, unknown or other
  misc_feature (153)..(153): n is a, c, g, or t
  modified_base (218)..(218): a, c, t, g, unknown or other
  misc_feature (218)..(218): n is a, c, g, or t
  modified_base (555)..(555): a, c, t, g, unknown or other
  misc_feature (555)..(555): n is a, c, g, or t
tcagactgtacagtcacgaccggtgctcgatttagagctcacgtattggggtttgggggcagaagtctctctcagtcaggacacagcatggacatggacgggtccctgctcagctccgtgggctcctgctgctctggcctcccagctatcagntgtgctactccagatcgaccatcctaccacttccctccctgtcctagctcgttgttggtaggaanacgagtactaccacctagttccgtaccggttcgggacccgggagacggtacggagggtactaaggttaaggttaaaactttggttcggaccgttaggtactacgaacggtaacctaaaacgggaaaaccggtaagggttaaaccctttaccccttaacctccgtaactacttaccgtagtgtcctacgtaccttacttacccgtttagttaacggtacgtttaaccggggtttccgggtacccttcgtacgttaccgtcggacgggtcgtacggttagggtcggtacgaggtactactaacgttccacttccgtaccaatcaacgcgtaaccggtcnccggtacgacgaacggtcgtaagaagttcgtacgtaacctactttaacttacgtataaaccgttaataacgttgacgtaccggtagtacggtcgttacgtacgggcccgaacggacggtacgagacgtactaagtaaccgacgtgtgaccg

SEQ ID NO: 251578 - DNA, 700 bp, Homo sapiens
  misc_feature: GYAE6OF01BZZGT.25.28.C06.1.454.CMB.1.raw
  modified_base (407)..(407): a, c, t, g, unknown or other
  misc_feature (407)..(407): n is a, c, g, or t
tcagactgtacagtcacgaccggtgctcgatttagagctcacgtattgggtttggggggaagaggaagactgacggtcctcccaggagttcaggtgctgggcaccttgggcgacgggggaggtgtgtcacaagatttgggctctgggcaccggtggagtcgtgggggaggcgtggtccagccgtgggaacgtccctgagactctcctggtgtggcgcctagactcaccttcagttagttatggtctttcgtcgtgggtcccgccagtgtccagggcgaagggggctgggagtggcgtgggagttacttggtctgacagacaaatgacatatcgacggcggagtccggtggacggggccattccgacctagtctaccgagggaactaagttaccaaagacgaaccctntactcgtgactaaaatacgaaactaacgttgaggtagtacgaaggtaacgtacggttacgttttaattacgttggtacgacgtaccgtgaaggtagtacggtacgtaagggtaaaacgttcgtaacgttctacgtacgtttccccgtacgtacccgttcggtaccggggaccgtacgggaccctacccggtcggtaccctacccggttccctacccgtcgtaccgttcccttacccgaaccgaccggggtacccctacggttccccggttcccgttccccggtccggtccccg

SEQ ID NO: 251579 - DNA, 269 bp, Homo sapiens
  misc_feature: GYAE6OF01DOADE.25.28.C06.1.454.CMB.1.raw
  modified_base (258)..(269): a, c, t, g, unknown or other
  misc_feature (258)..(269): n is a, c, g, or t
tcagactgtacagtcacgaccggtgctcgatttagagctcacgtattgggtttggggggaagaggaagactgacggtcctcccaggagttcaggtgctgggcaccctggtcaccgtctcctcagcttccaccaagggcccatcggtcttcccctggcgccctgctccaggagcacctctgggggcacagcggccctgggctgcctggtcaaggactacttccactgtacagtctgagcgggctggcaaggcgcatagnnnnnnnnnnnn

SEQ ID NO: 251580 - DNA, 706 bp, Homo sapiens
  misc_feature: GYAE6OF01ADZ7E.25.28.C06.1.454.CMB.1.raw
  modified_base (190)..(190): a, c, t, g, unknown or other
  misc_feature (190)..(190): n is a, c, g, or t
  modified_base (206)..(206): a, c, t, g, unknown or other
  misc_feature (206)..(206): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtgcatccagatcgacccagtctccactccctcctgtcngctatcgtggtagganacagtacgtccacctatccgtacgttcggaccgggacgtacgtacggacgggtactaagttaaggttaaatttacggttcggccgttaggtactacgaacgtaccgaaacggtaaaccggtaagggttaaccttaccctaaccgtcctactacttactagtcgtctacgtactactccttagttcgtacgttaacgggtttccgggtaccctacgtacgtacgttcgacgggtccggtacgtacgggttcggtacggtacgggtaacctagttaaccttcctaaccgtccgtaaccgtaaccgtactcgaacgtacgaccggtctacggacgtaccgaccggttaagtacgtacggttactaacgtaacctttaattacgttacgtaagttaaacttaacgtcggactaggtccgtaaccggtgttaccggtaccggtaccggaacgggtaggtaaacgtagggtaaccaacttaacgaaacggtacgtagtggtaaccc

SEQ ID NO: 251581 - DNA, 846 bp, Homo sapiens
  misc_feature: GYAE6OF01CJLRX.25.28.C06.1.454.CMB.1.raw
  modified_base (154)..(154): a, c, t, g, unknown or other
  misc_feature (154)..(154): n is a, c, g, or t
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (327)..(327): a, c, t, g, unknown or other
  misc_feature (327)..(327): n is a, c, g, or t
  modified_base (370)..(370): a, c, t, g, unknown or other
  misc_feature (370)..(370): n is a, c, g, or t
tcagactgtacagtcacgaccggtgctcgatttagagctcacgtattgggtttgggggcagaagtctctctcagtcaggacacagcatggacatgacgggtccctgctcagctccgtggactcctgctgctctggctccagtctatcagtatgngcatccagactgaccctagtctccatcctccgtgtcctgcagtcgttagtggaanctagatcacagtctacgtcgccggagagtcgaggtntaagttaggtaaattcgttggccttaggtacacaggacaagaaaaccgtaggtaaacttccaaacctctatatacttaagcncgtacgctaactctaatttcggacttaaggtttcgggaccctntactagtccgacggtcgtacggaggttacggttaccgtaagggaaccgttaagtaacgtttaccaaacctttccgtaaccggtaacccgaacttccgtaaaacggggtaccaaccgggtttccccttaagggtaaaccctcccggtttaacccggggtaaagttaaaaacccgttgggttaacggggtttttaaccgtaaacccctttaaaaagggtttttaaacccgttttaaacccttaaaagggttttaaaaaacccccttttaaaaaacggtttttacccgggtaaaacggtttaaccgggttaaacccgggttaccccgtttaagggggttaaacttttacccggggttaaccccggggtacccggaaaaaaccggggggttaaccccgtaaaaggggttacccggggaaaccttttaaaaacggaaacccgtaaaaaaacgggttcccgggttgtttaaaaccccggggg

SEQ ID NO: 251582 - DNA, 730 bp, Homo sapiens
  misc_feature: GYAE6OF01DQZJ5.25.28.C06.1.454.CMB.1.raw
  modified_base (170)..(170): a, c, t, g, unknown or other
  misc_feature (170)..(170): n is a, c, g, or t
  modified_base (462)..(462): a, c, t, g, unknown or other
  misc_feature (462)..(462): n is a, c, g, or t
  modified_base (714)..(714): a, c, t, g, unknown or other
  misc_feature (714)..(714): n is a, c, g, or t
tcagactgtacagtcacgaccggtgctcgatttagagctcacgtattgggtttgggggcagaagtctctctcagtcaggacacagctagtggacatgaggtccctgctcagctcctggactctgcttgctctgcttccagctatcagtatggtggcatccagatcgaccngtctccgatcctcctggctagctagtctaggttcgagacagactacaccagtccacgttcggccggggacgtagtccggaacgggtcctaagtttagggaaaatttcgtttacgggacctttgggttaacttaccggacggtaccgaaaacggaaacccgtaagggggttaaaacctttcccctaaaacccggttcccttacgaaacgttcgttaagttcggtcttacggtaccttaagttccgttacggttttacgaaccttaaacgggtttttccggggaaccccggttntaccggttaactcggaacggggcccggtagtaacgggttcggttacccgtagggtaacccgtagtaaacgttccaaccgttaccttacccgaactacgtacacggtacctacggtcctagaccgtacgacgttacgaacgtgtacggtaacgtactaaacgttacgttacgtacgttaacttaaagtttcgacgtacgtgaaccgttgacggttcggtacggaccggtaggaccgtaggtacgtactagtanaacggacgtggtacgg

SEQ ID NO: 251583 - DNA, 263 bp, Homo sapiens
  misc_feature: GYAE6OF01CDQ14.25.28.C06.1.454.CMB.1.raw
  modified_base (256)..(263): a, c, t, g, unknown or other
  misc_feature (256)..(263): n is a, c, g, or t
tcagactgtacagtcacgaccggtgctcgatttagagctcacgtattgggtttggggggaagaggaagactgacggtcctcccaggagttcaggtgctgggcaccctggtcaccgtctcctcagcttccaccaagggcccatcggtcttcccctggcgccctgctccaggagcacctcgtggggcacagcggccctgggctgcctggtcaaggactacttccactgtacagtctgagcggctggcaagcgcatagnnnnnnnn

SEQ ID NO: 251584 - DNA, 825 bp, Homo sapiens
  misc_feature: GYAE6OF01EPTWQ.25.28.C06.1.454.CMB.1.raw
  modified_base (613)..(613): a, c, t, g, unknown or other
  misc_feature (613)..(613): n is a, c, g, or t
tcagactgtacagtcacgaccggtgctcgatttagagctcacgtattgggtttgggggcagaagtctctctcagtcaggacacagcatggacatggacgggtccctgctcacgcctcgtggactcctgctgctcgtcgcctccagtctatcgagtatcggtacggctactaccaggtactaccgaccctagttcctacctaccttcccctccgttggtcctcgtcttaacgttcggttaggttacggaacgtacgacggtaccgtaccctacctaacgttccgtaccgggtaccggggaccggggacgttacggtacggtaacgggtacttaaggtttaacggttaaacttttcggttccggtagttacggttaactacgaacggtaacgaaaaccggtaaaccgggttaacggttaaccctttaacccctacttacctactaacttacgtacgtcggtactacctccttaccttacggttaccttacggtaaccgtttcggggttcccgtccttacggtttactaccgtcggtcggacggtacgttacggggtacggtttacggacggtactaacgtacttacctcttaccgtctactaacgtcgacgtacncgtacgctacgtacgtacgtacgtacgttcgtaagttacgtaaccttaagtttaccgttaacttaacgttaaacgtttaacggtacgtaaccgttacggttaaccggtccggtaacgggtttaccggtacccgggttaacccggacggttaaccgggaacggttaacgggtaacttaacggaaacgtaccgtaaaggggtactcgggtaccg

SEQ ID NO: 251585 - DNA, 813 bp, Homo sapiens
  misc_feature: GYAE6OF01AXYKQ.25.28.C06.1.454.CMB.1.raw
  modified_base (216)..(216): a, c, t, g, unknown or other
  misc_feature (216)..(216): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctggggggaggcgtggtccagcctggggaagtccctgagactctcctgtgtggcgcctagactcaccttcagtagttatggcttcgtctgggtccnccagtcgtccgaggcgaagggggctgggagtggcgtggggagtttacgttggtctgacagacaaatgacatatcacgcggagtccgtggacggggccattcgaccatcctaccgagggacaattccgaaagacgaaccctctatcctagacaaacgtagaaactaacgttcgaagaacggttacggaaggtaaccgtaaccgggttacccgttttaagtttaacgtcggtacggaccgtaacccgttaccgtaagggtacgggttagggtaccggttaaggggttaaaaaaacggtccgtttaacggttaccgttacctaaccggtttacccccgggtacccggttacccgttacccgggtacgggggtaccccggtaacggggtccccgtaaccccggttcgggtacccgttacccggtaccccttcccgtaccgtaccgtacccgttaccccgaaacccggtaaccggggtacccctaaccggttccccggttaccccgtttacccccccgtcggggccccgtcccccggtcggtaccccgttacccgggtacggtacccggacccgttaccccgtccgggttcgggggaccccg

SEQ ID NO: 251586 - DNA, 306 bp, Homo sapiens
  misc_feature: GYAE6OF01CCPT6.25.28.C06.1.454.CMB.1.raw
  modified_base (101)..(101): a, c, t, g, unknown or other
  misc_feature (101)..(101): n is a, c, g, or t
  modified_base (288)..(306): a, c, t, g, unknown or other
  misc_feature (288)..(306): n is a, c, g, or t
tcagactgtacagtcacgaccggtgctcgatttagagctcacgtattgggtttggggggaagaggaagactgacggtcctcccaggagttcaggtccccgntgggcaccctggtcaccgtctcctcagcttccaccgaagggcccatcggtcttcccctggcgccctgctccaggagcacctcgtgggggcacgaggccggcccgtggggctgcccgtagggtacgaacggtactaccttccactagtaccagtctggacggcgggtctggacgaagggcgacatagnnnnnnnnnnnnnnnnnnn

SEQ ID NO: 251587 - DNA, 729 bp, Homo sapiens
  misc_feature: GYAE6OF01CPEUD.25.28.C06.1.454.CMB.1.raw
  modified_base (160)..(160): a, c, t, g, unknown or other
  misc_feature (160)..(160): n is a, c, g, or t
  modified_base (199)..(199): a, c, t, g, unknown or other
  misc_feature (199)..(199): n is a, c, g, or t
  modified_base (453)..(453): a, c, t, g, unknown or other
  misc_feature (453)..(453): n is a, c, g, or t
  modified_base (539)..(539): a, c, t, g, unknown or other
  misc_feature (539)..(539): n is a, c, g, or t
tcagactgtacagtcacgaccggtgctcgatttagagctcacgtattgggtttgggggcagaagtctctctcagtcaggacacagcatggacatggacgggtccctgctcagcctccgtgggacctcctggcctggcctcgtcggcctcccagtccttancgagtctggtaggctagtccaggactcgacccagttccncctactccctcctgtcacgctatcgtggttcggaacacgagtacctcaacctattccgacgtcgggcgggtacgcgtacgaggtcttagttaacggtaaattttcgtcggtcgttggtaactcgaacgacgtaaacgggaaaaccgtaacgggttaaccttacccgtaacctcctatactactagtcgtctacgtacctactcgttaccgttagtaccggtttaaagggttccgggttaacctcgtacgttacncggtaacgggcgggtacgacgggttcgggtacgtaacggactagttacctacctacgtcctaccgaacttcgactacgcgttaccncgtacggcacgtcgtaagtagttacgtacgttaacttaacgttaactttacgttaacttaagtaaatttaaaccgcggaaacttccgggtacctagggttcgtaccgttaccgggacccgggaacggtaccggaaaggttacgggactaaaccggttaaacaccggggtaaaacttccgggtcgtaccgg

SEQ ID NO: 251588 - DNA, 924 bp, Homo sapiens
  misc_feature: GYAE6OF01ENTCC.25.28.C06.1.454.CMB.1.raw
  modified_base (870)..(870): a, c, t, g, unknown or other
  misc_feature (870)..(870): n is a, c, g, or t
tcagactgtacagtcacgaccggtgctcgatttagagctcacgtattggggtttgggggggaagaggaagactgacggtcctcccaggagttcaggtgctgggcaccttgggcacggggggaggtgtgtcacaagtatttggggctcgtggggcaccggtgggaggtcgtgggggggaggcgtgggtccaggccgtaggggaactcccgtgacgtcctccgtccgtggtggtggccgtaccgtacgaccttcctacctttcgagttagttgtcggtcttcgtcggtcgggtccgccgtaggtccgtaccgagggacggacggggtcgtagggtagggtcgggtcgggtaggggttacgtttacggtttcgggtacgtacgaacgtaacggtaaaactaaaggttacggtaaacgtaattaacggtacccggtaacgggggaccgggggttaacgggttacccggggtacggggggtaaccgggggggtacccttaaccgttacccggtaaaccctcttaaccccggtaaccggggaaccgggtaaaccttaaaaccggttaccgaaaaacggtaaccccgtaaccccttacgtttaacttccggttaaacgaaaccgtaaaccgttaacgtaaaaaaccgttacggttagggtaacgggtaacgggttacgggaaaccggtttaaccgggtttaacccggtttaacgttttaacgtttacggtcgtaaccggtaccgtaccgtagggtacggtagggtacggtaacgtaaacgggtaacgttcgtacgttcctacggtacccgttccggtaccgtccggtcgggccgggtaccgcgggtaccgtcccgttcgtaccctcggtccgtaccncggacctcccgtacgaccgaccgtcctacgtccgttcccttccggccggtaccg

SEQ ID NO: 251589 - DNA, 375 bp, Homo sapiens
  misc_feature: GYAE6OF01B997P.25.28.C06.1.454.CMB.1.raw
  modified_base (282)..(282): a, c, t, g, unknown or other
  misc_feature (282)..(282): n is a, c, g, or t
  modified_base (313)..(375): a, c, t, g, unknown or other
  misc_feature (313)..(375): n is a, c, g, or t
tcagactgtacagtcacgaccggtgctcgatttagagctcacgtattggggtttgggacagaattcactctcaccatcagcagcctgcagcctgaagatgttgctaacttattactgtaacaaaaaatttggacaggtcgcccgtggattcggtccggccgaagggaccaagggtcgaacatacaaaaccgtagtggtaggctgaccactatctactcttacacttccttaccccgctaactctacggtaaactcgtaacaggtcctaggacggccgggtanacggaaccgaaaggtcccgagtaaaagtgcnnnnnnnnnnnnnnnnnnnnnnnnnnnnnnnnnnnnnnnnnnnnnnnnnnnnnnnnnnnnnnn

SEQ ID NO: 251590 - DNA, 259 bp, Homo sapiens
  misc_feature: GYAE6OF01BMNQ3.25.28.C06.1.454.CMB.1.raw
  modified_base (221)..(221): a, c, t, g, unknown or other
  misc_feature (221)..(221): n is a, c, g, or t
  modified_base (254)..(259): a, c, t, g, unknown or other
  misc_feature (254)..(259): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgaccgtggatgttcggccagggaccaaggtgacatcaaacgactgtggctgcacatctgtcttcatccttccgcatctagaactgtacngtctgacgtcggctggacaaggtcgactagagnnnnnn

SEQ ID NO: 251591 - DNA, 816 bp, Homo sapiens
  misc_feature: GYAE6OF01E5PWK.25.28.C06.1.454.CMB.1.raw
  modified_base (173)..(173): a, c, t, g, unknown or other
  misc_feature (173)..(173): n is a, c, g, or t
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
tcagactgtacagtcacgaccggtgctcgatttagagctcacgtattgggtttgggggcagaagtctctctcagtcaggacacagcatggacatgagggtccctgctcagctcctggactcctgctgctctggctcccagctatcagatgtggcatccagatcgacccagtcnccatcctcccngtctgcatctgtgganacagacgtcacctatccgacgttcggcccgggtagtacgtccgaaggggtcctaatttgggtaaaaacttttgtttcgggcccgtttaggtactccgaaggacccgaaacggtaaaacccgtaacggggtaaaacgttttccccctaaacccgttcccctccgtaaatttccgtaagttacggtccttacggtacccttaacgttaccccgttaaccgtttttcggaaccggtttaaaccgggttttttcccgggggggtacccccctttacgtttaccggtaaaccggtttttcccgaacggggtcccgggttacgttaacggggttcggggttacccggttagggggaaacctaacggtaaccgtttacccgacctttacccgtaccctaaacccgtacttaccggacgtaccgaccggtccgtacgtccgtacggtacccgtaacggtaacgtacgtttacgttaccgaacctttaacgtttacttaacgttaacgtaaaccttaaaagttcgtaacgtcgttaaccggtaccggtacggttacgttccggttacccggaccggtaacggaccggtaaggtacgtaacgtactaacgaacgtacgtggtacgg

SEQ ID NO: 251592 - DNA, 713 bp, Homo sapiens
  misc_feature: GYAE6OF01CE1PY.25.28.C06.1.454.CMB.1.raw
  modified_base (238)..(238): a, c, t, g, unknown or other
  misc_feature (238)..(238): n is a, c, g, or t
tcagactgtacagtcacgaccggtgctcgatttagagctcacgtattgggtttgggggcagaagtctctctcagtcaggacacagcatggacatggacgggtccctgctcagcctcctgggactcctgctgctctggctcccagctatcagatgtggcatccagatcgacccagtcctccatccctcctgtctgctatcttgtggagacagactcacctatccacgttcggccggggngagtcgagggctagttaggtaaatttacgttggccttggtactcgagacaacgaaaccgtagggtaaacttccctaacctctacatctatcgctgctactcctacgttcgtacgttaggtttcggggttaccctttgtacttcgacggcggtcgtagggttcggtcgtagggactagttaaccgttcctaccgttacctacctaactactaccgtacgacctaccggtccctagacccgtaccggtacccgttaaggaacgttaacggttactttaccggtaaactttaaccgtttaacgtttaccttaacggtttaaactttaaacgtttcgaacggttaccggttaccgggtaccggttacggtaaccggttcccgggttaacccgggaacccggtaacgggtaacccgggtaacggtaaccggtaacgtaacctaaacggtaaaacccgttcggttacgggtcggtaacccg

SEQ ID NO: 251593 - DNA, 703 bp, Homo sapiens
  misc_feature: GYAE6OF01AWM2M.25.28.C06.1.454.CMB.1.raw
  modified_base (476)..(476): a, c, t, g, unknown or other
  misc_feature (476)..(476): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccactccctccctgtctgcattctggtggagacagacgtcaccatccacgttcggccgggcgagtcgaggactagttaggtaaatttgtttcggccttagggtactcgaagacgaaacggaaaaccggtaggggtaaaactttcccctaaacccgtcctacactctatcgctcgactactcctactttacgacgttacggtttcgggtcccttcgtcgtacttcgacggtcggcgtagggttcggtcgtgggacagtaacttcgacttccgactacgactcgagccacgtcctacggaccncgtaaccgtaggtaagtcgttttacggtactaacctttaacgttttactttaaaccgtaactttaaaacgttaaagttttcggaaaccgttacggttacccggtacccgggttagggttaccggttcccggggttaacccgggaccccgggtaaacggggtaccgtaaacgggtaccggtaaaccgtaacgttaaacccggaaaggttaacccgtggggtaaccggg

SEQ ID NO: 251594 - DNA, 644 bp, Homo sapiens
  misc_feature: GYAE6OF01AYX6K.25.28.C06.1.454.CMB.1.raw
  modified_base (303)..(303): a, c, t, g, unknown or other
  misc_feature (303)..(303): n is a, c, g, or t
  modified_base (513)..(513): a, c, t, g, unknown or other
  misc_feature (513)..(513): n is a, c, g, or t
tcagactgtacagtcacgaccggtgctcgatttagagctcacgtattgggtttggggggaagaggaagactgacggtcctcccaggagttcaggtgctgggcaccttggcacgggggaggtgtgtcacaagatttgggctctgggcaccgtggagtctgggggaggcgtggtccagcctgggaagtccctgagactctcctgtgtggcgcctagacctcacctttcagttagttatgggctttcgtctgggtcccgccagtgtccaggcaagggggctggagtggctggggattacgtggtcngaccagacaaatgacatatcacgcggagtccgtggacggggtccgacttccgaaccctagtcctaccgacgggacaaatttccccaaagtaaccgaaaccctctaacgtacctgaccaaaatcgaaacaacttggagagtcgaggaacgtacgaccgttttattacgtagttacgcgcctcgaggagtggacgaggaaaagtgtacgtcnctaacttcccgtccgacctacgtcgggtcgacggaccgtacccgtcggtccgaccgttcctccctacacgtcccttacccgaacccgaacgggtcccacgttaccgtccccgtttcccccgtcggtccccg

SEQ ID NO: 251595 - DNA, 796 bp, Homo sapiens
  misc_feature: GYAE6OF01A7464.25.28.C06.1.454.CMB.1.raw
  modified_base (317)..(317): a, c, t, g, unknown or other
  misc_feature (317)..(317): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtcgtgggggaggcgtggtccagcctgggaagtccctgagactctcctgtgtggcgcctagactcaccttcagtagttatggcttcgtctgggtccgccagtcgtcaggcgaaggggctggagtggctgggagttacgttggtctgacagacaatgacatancacgcggagtccgtggaggggccgattccacgatccgtaccgaggactaacttccgaaagacgaacccctctaattctacgaacaaaatacggaaacctaaacgtttagaaggtaacgtacggaagggttaacgtaaccgggttacccggtttttaactttacgttcgggttacggtaccctaacccggttacggtaacgggtagggttaccgggtaaccggttaaaggggtaaaaaccggtttacggttaacgtttacgtaccgttaaccgtttacccccggttaccgtaaccccgttcgggtaccgggggtcccgtacggggtacccctacccccgggttcgggtacccctaaccccggttcccgttacccgtacccggtaccggttaccccgttaccccggaacccccggtaaacgggtccccttaccccgggttacccgggttcccccttttcccccccgggcggtaccccccgg

SEQ ID NO: 251596 - DNA, 811 bp, Homo sapiens
  misc_feature: GYAE6OF01CO6BJ.25.28.C06.1.454.CMB.1.raw
  modified_base (660)..(660): a, c, t, g, unknown or other
  misc_feature (660)..(660): n is a, c, g, or t
tcagactgtacagtcacgaccggtgctcgatttagagctcacgtattggggtttgggggcagaagtctctctcagtcaggacacagcatggacatgagggtccctgctcagctcctgggactcctgctgctctggcctcccagctatcagatgtgcatccagatcgaccctagtcctcctactcccttccctgtctgctacttcgttaggttggacgacgaggtacgtcctaaccacttaccgtaccgttcgggacccgggggtacggtaacggtccggaaggggtcctaaggtttagggttaaaacttttaacggttttcggaccgttacgggttaactaccgaacggaccgaaaacggaaaacccggtaaacggggttaaacccgtttaaccccttaaaacccttccctacgtaacttcttaacgtcggtcttacgaccttaccgttacccttaacgttttaccgtacgtttaaacggttttcccgggggttaccccttcgttaccgttaacgttcgacgggtccggtaacggtggggtttaccggggtcgacgggtaactaacgggttaacttaccctacttccgtaacccaccccttaagacccaagtaccgtaccgtaccttcgggaacccacggtaccgttaagtaaccggttnttacggttcctaaccgtttaaacctttatttaccgttaatttaaacgttaaattcggaacgtacgggtacgtaccggtagtacgttcccggacggtaacccggagggacccgtaaggtacgaactagaaacccgtaaacggtgtggtaccg

SEQ ID NO: 251597 - DNA, 680 bp, Homo sapiens
  misc_feature: GYAE6OF01BSO1U.25.28.C06.1.454.CMB.1.raw
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (406)..(406): a, c, t, g, unknown or other
  misc_feature (406)..(406): n is a, c, g, or t
tcagactgtacagtcacgaccggtgctcgatttagagctcacgtattgggtttggggggaagaggaagactgacggtcctcccaggagttcaggtgctgggcaccttgagcactgaacgcagcggactcaccatggagtttgggctgaacttgggttttcctcgttgcttcttttaagaggtgtccagtgtcaggcgcatcgtgggtggagtcggtggggggagcgtggtccagccgtagggaacgtccctgacgtcctctctgtgtggcnctagctcaccttnagtagttagtggtcttcgtcgtcgggtccnccgtaggtcgtccgaggacgaggggcgtggaggtggcgttgggtattcgttggtctagacagaanaatgacatanccgacgcggtagtcggngggacgggcctacttcacctacgtcctaccggaaggtaactaacttaccgaaacgtaacccgtaacccttactacttctaacgtaaccgtaaagtaccgaaacttaacgttagaacggtaaggtacgaacgggtacgttaaccggtttacgtttacgttacgtcggtaccgtaccgtaccgtagtacggtaggtcggtaagttaagggtaaaacggttcgttaaggtccttaccgttaccgttacccggttaccgtaccggtccgggtacgggg

SEQ ID NO: 251598 - DNA, 690 bp, Homo sapiens
  misc_feature: GYAE6OF01A2DAA.25.28.C06.1.454.CMB.1.raw
  modified_base (357)..(357): a, c, t, g, unknown or other
  misc_feature (357)..(357): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctggggtccgccagtgtccaggcaagggggctggagtgggctggggagttacttggtctgacagacaaatgacatatcgacgcggtacgtccgtggacggggccagttccaccatccgtaccgagggactaattccaaagacgtaacccctntactctagacaaatacgaacaacgttgagacgtcggaaggtactacgggtccgttttaatacgtggtacgccgtacctcgaggtagtgtacgtaagggaaaacgtcgtagtcctacgtacttcccggtacgaccgtcggtcggggcccgtacgggtcctacccggttcggtacccaccggttccttcccctacgtaccgttacccttaccccgaaccggtaccgggtccccttaaccggtcccggttcccccgtttacccccggtcgggtccccgtccccgttcggccctcccggaaggtccgacccgtaccggtccgggtacgggggtaccc

SEQ ID NO: 251599 - DNA, 713 bp, Homo sapiens
  misc_feature: GYAE6OF01D3TG7.25.28.C06.1.454.CMB.1.raw
  modified_base (211)..(211): a, c, t, g, unknown or other
  misc_feature (211)..(211): n is a, c, g, or t
  modified_base (252)..(252): a, c, t, g, unknown or other
  misc_feature (252)..(252): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtcgtgggggagcgtgggtccagcctgggaactccctgagactctcctgtgtggcncctagactcaccttcagttattatggcttcgtctgggtccncagtgtccaggcgaaggggctggagtggcgtgggatttacgttggtctagacagaacaaatgaacatatcgacggcggacgtccggtggacggggcctattccgaacctagttccgtaccgaagggaacctaaacgttaccgaaagtaaccgtaaacccctctaagtccgtagaacctaaaagtacgaaaactaacgttaggaacgtacgtacggaaggtaacgttaccgggttacgttttaattacgtgtacgaccgaccgttagaagggtagtacggtacgtaaaggtaaacgttcgtaacgtactaccttaccggttacccgtaccgtaccgttcggtaccgggaccgacgggtacccacccgttcggtacctacccgttcctcccgtacgtacgtcccgttacccggaccgtaaccggtccctacggttcccggttcccctccccggtggtcccccg

SEQ ID NO: 251600 - DNA, 601 bp, Homo sapiens
  misc_feature: GYAE6OF01BF4CW.25.28.C06.1.454.CMB.1.raw
  modified_base (229)..(229): a, c, t, g, unknown or other
  misc_feature (229)..(229): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtccaccatcacgttggccgggngagtcagggcattggaaattatttggcctggtatcagcagaaaaccagggaaagttcctaacctcctacatctatcgctgctatcctactttgctaaagttttcggggtacccgtcgtccgtatttcgaggtcggacgtaggtgggtctagggactaggtaacttcaacttcgtacaccctatcagccgacgtcctgcacgcctaggaagattgttgacctaactttaattacttagttaacttaaaagtttcgaacgtagttacggtacccggtaggtacgttcggttacccgggaccccgtaacggggtaacccgtaaaggggtacggtaacctaacggtaaccgaaaacggtaccgtgggttaaccggg

SEQ ID NO: 251601 - DNA, 778 bp, Homo sapiens
  misc_feature: GYAE6OF01DAGKL.25.28.C06.1.454.CMB.1.raw
  modified_base (333)..(333): a, c, t, g, unknown or other
  misc_feature (333)..(333): n is a, c, g, or t
tcagactgtacagtcacgaccggtgctcgatttagagctcacgtattgggtttgggctgaactgggttttcctcgttgcttcttttaagaggtgtccagtgtcaggcgcatctggtggagtcgtgggggaggcgtggtccagccgtgggaacgtccctgagactctcctgtgtggccgctagactcaccttcagtagttatggtcttcgtcgtgggtccgcagtcgaccgaggcgaaggggctggagtggcgtgggatttcgttggtctagacagaacaatgatatatcgaacggcggtacggtccggtgggacgggccgtacttccgaaccnctaccgtaccggaaggaacctaaacttaccgaaacgtaaccgtaaaccctgtaactcgtacgaactaagtacgtaaactaacgttaggacgtacgtacggacggtacgtaccggttactttacttacgtggtcgaccgtacgcgaagggtaggtcggaacgttaaagggaaaacggttcgtaacgtccgttaccgtaccgttccccggacgtacccgtacgggtccggggtacccaaccggggtccctacccgggttcgtacccgtaccccggttcctacccgtaccgaccttacccggttacccgaacccggaaccggtccccttaaccggttccccggtttcccccgttccccggtacccggtccccgtcccctccgggtaccccggtaacccgtacccgggacccggtaccccgtccccgggttgggtacccgggggacccc

SEQ ID NO: 251602 - DNA, 331 bp, Homo sapiens
  misc_feature: GYAE6OF01BHPAA.25.28.C06.1.454.CMB.1.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (279)..(331): a, c, t, g, unknown or other
  misc_feature (279)..(331): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatggtcggcccagggaccaaggtgacatcaaacgactgtggctgcaccatctgtcttacnctccttcccgcctaattcngaaactgtaaccagtccgtagacgggccgggtctaggaccgaaggcgtatagagncntnnnnnnnnnnnnnnnnnnnnnnnnnnnnnnnnnnnnnnnnnnnnnnnnnnnnn

SEQ ID NO: 251603 - DNA, 706 bp, Homo sapiens
  misc_feature: GYAE6OF01A0J0X.25.28.C06.1.454.CMB.1.raw
  modified_base (114)..(114): a, c, t, g, unknown or other
  misc_feature (114)..(114): n is a, c, g, or t
  modified_base (150)..(150): a, c, t, g, unknown or other
  misc_feature (150)..(150): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (664)..(664): a, c, t, g, unknown or other
  misc_feature (664)..(664): n is a, c, g, or t
tcagactgtacagtcacgaccggtgctcgatttagagctcacgtattgggtttgggggcagaagtctctctcagtcaggacacagcatggacatgaggtccctgctcagctcgngggactccgtgctgctctggcctcccagctatcagntgtgcatccagactcgacctagtctccattccctcctgtcctgcattcgtgtggacanagtctccactatcacgttcggaccggngacgtcgaggtctaagttaggtaaatttgtttcggccgttaggtactcgacgtacgaacggtaaaaccggtagggttaaacctttaccctaacccgttcctacttaacttactagtcgtaccgtcgaccttaacttcccttacggtttacgaccgtttaacgggttttccggggaccccttgtaccgttagttccgaacggcccgggtatacggggttcgggtctaacgggactaacgtacgtttacccaccttccgtaccacgtactccgaacgttccgactcccgtatccgaccgtcgttagaagttcttcgggttactaaccgtttaacgtttaccttaagttaacccgttaaataacgtttgaaccgttcgtaacggtcccttaggtaccgttcgggtaaccccggagggtaccgtaaaccgggntaaacggtaccgtaacgtaaacggacggtccgtggtaaccgg

SEQ ID NO: 251604 - DNA, 308 bp, Homo sapiens
  misc_feature: GYAE6OF01AS0TU.25.28.C06.1.454.CMB.1.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (275)..(308): a, c, t, g, unknown or other
  misc_feature (275)..(308): n is a, c, g, or t
tcagactgtacagtcacgaccggtgctcgatttagagctcacgtattgggtttgggacagaattcactctcaccatcagcagcctgcagcctgaagatgttgctaaactttattactagtacaaaaaatttgacaggtcgacccgtggatggtcggccgagggaccaaggtgacatacaaaacgatggtgctgaccacntcgtctctcactcctccgctatcagtaactgtacngtcgnggacggccggngtaggacgtaacggccagatagcannnnnnnnnnnnnnnnnnnnnnnnnnnnnnnnnn

SEQ ID NO: 251605 - DNA, 869 bp, Homo sapiens
  misc_feature: GYAE6OF01BNVMB.25.28.C06.1.454.CMB.1.raw
tcagactgtacagtcacgaccggtgctcgatttagagctcacgtattgggttgggggcagaagtctctctcagtcaggacacagcatggacatgagggtccctgctcagctcctgggactcctgctgctctggcctccagcctatcagatgtgcatccagatcgacccagtcctccactccctcctgtctgctattcctggttggagacgaggactaccaccacttcctacgtttcggggcccgggtacggtacggttcgaacggggtacctaagttaggttaaaagtttacggtttcgggtacccgttagggttaacctacggaacggtaaccgaaaacgggtaaaacccggtaaacgggggttaaaacccgtttacccccgttaaaaccccgtttccccgttaaccgtaactttaccgttaacgttccggtaccgttaccggtaccttaaccttcccgtttaacgttttacggtaacccgtttaacggggttttcccggggttacccccggtttcgttcccggttaacttccggtacgggaccgggtccgttacgggggttacgggttaccggttacggggaactaacggttaacctttccgaccgttacctacacccgtaacgtacccgtacgaccgtaacgtcccttacggacccgtaaccgtaacccgttaggtaaacgtccgtttggttaaccgtaccttaaaccgttttaattaaccgtttattaaaacccgtttaaagttaccgaacgttacggtaccgggtaaccggttggttaacggttcgggttaaccccggaccgggtaaccgggtacggtaaacgttacggactaacggtaaccgaaccggtacgttacggtaccg

SEQ ID NO: 251606 - DNA, 769 bp, Homo sapiens
  misc_feature: GYAE6OF01AJUBE.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtgcatccagatcgacccagtctccactccctcctgtctgcatctggttgagacagacgtcaccatctacgttcggccgggcgagtcgagggtctagttaggtaaatttcgtttcggccgttaggtactcgaagtaccgaaacggtaaaaccggtaagggtaaaccgtttacccctaaacccttccttaacgtaacttacctaacgttcgcttcgacctaccttacccgttacgttttacggtaccgtttaacgggttttcccggggttccccgttacgtttacgtaacgttccgacgggtccggtacggttacggggttcggggttaccggttacgggaaaccttaacggttaccttacccgtaccttacctaacccaacccgttaacgtaccgaccggtaccgacccggtcccgtcgtacccgaccggtaccgtaacggtagttacgttaccggttacgtaaacctttaacttacttaaccggtaccctaaactaactaaattaaacttaaatttaacgttaccgtacctaccgttacggtttacggaacccgggtaacgggaaccggtaagggtcggtaaacgtaccgtaaacgtaaccgttcggtggtacccgg

SEQ ID NO: 251607 - DNA, 964 bp, Homo sapiens
  misc_feature: GYAE6OF01C9HOO.25.28.C06.1.454.CMB.1.raw
  modified_base (154)..(154): a, c, t, g, unknown or other
  misc_feature (154)..(154): n is a, c, g, or t
tcagactgtacagtcacgaccggtgctcgatttagagctcacgtattggggtttgggggcagaagtctctctcagtcaggacacagcatggacatggacgggtccctgctcagctccgtgggcctcctgctgctcgtcggcctcccgagcttancgagtatggagcacgtaccaaggactccgaaccctacgttcctcctccttccccgttcccgtgttaccgtcgaccttgttcggttagggttaggaaccgaagtacggacgtaccctaacctacgttcccgtacgggttccggggccggggaacggtaccggtacgggaagggttaaccgttaaggttttaacggttaagtttttacgggttccggtcggttaacggttacacggaacggaaaccgtaaaccgggtaaaaaccggttaaccgggtttaaacccttacccccgtaaccctttaccttacctaacttaccgttacgtcgtaccgttaccgaccttaccgtttacctttacggggtttacgttacccgggttacggggtttcccgggttccttaacggtcgttactaccggtcgggtacggtaccgggttaggggtccggtaaggttaccgggtaactaaccgttacccgtaccgttaaccctaccggtacaacccgttcgacgaccgtccgtaacggttcccgacgtacccggtacggttaacgtaacgggttacgttacggttaacgtttaacgtttaaacccccttttaagttttacccgtaaacggttttaaacttaaaccggtttaaacgggtaccgtaccgggtttaaacccgggtccggttaacccggggtttacgaccccgggttttacccggggaacccgggtaaaccggggttaaccccggggtaagggtaaacccgtcgtaaaacccggttaaccgtaaaacccggttaggggtacccttaccgggttaaccg

SEQ ID NO: 251608 - DNA, 816 bp, Homo sapiens
  misc_feature: GYAE6OF01D58AS.25.28.C06.1.454.CMB.1.raw
  modified_base (810)..(810): a, c, t, g, unknown or other
  misc_feature (810)..(810): n is a, c, g, or t
tcagactgtacagtcacgaccggtgctcgatttagagctcacgtattggggtttgggggcagaagtctctctcagtcaggacacagcatggacatggacgggtccctgctcagctccgtgggactcctgctgctcgtcggcctccgagtctagtcagtagttcggcgactactccgaaggtactaccggaaccctacttcctaccctaccttccccttccgtgtaccgtcgtacttacgttcgttagggtagaacgtactagacgtacactatccgtacgtcgggcggtagacgtcggacggtacttagttaagttaaactttcggtacggtacgttagtacacgaacggtaaccgtaacggtaaaccggtaaacgggttaaccctacccttaaccgttcctaacttaacttcgtacgtcggtaccttacgacctaaccgtttacttaccgttacggtaacggtttacccgggtttcggtacccgttacgtacggttaccgtaaggcccggttacgggtaacgggttggggttacgggtaaccgtaaggggtaaccttaacggttccttaccggttaaccctacgttacccgaacgtacggtaccgtaccgaacggttaccgtccgtacggtaccgacgggtaccgtaagtaacgggttacttacggttacttaaacctcgtttaacgtaacttacgttaaaacgttcgtacgtaacggtacggacccggtttagtacgtaccgggttcccgggacggaccggtacggaacggtaacgcgttaaaaccgcgaaaacgtttcgaacgggtntacggg

SEQ ID NO: 251609 - DNA, 282 bp, Homo sapiens
  misc_feature: GYAE6OF01CDTVB.25.28.C06.1.454.CMB.1.raw
  modified_base (271)..(282): a, c, t, g, unknown or other
  misc_feature (271)..(282): n is a, c, g, or t
tcagactgtacagtcacgaccggtgctcgatttagagctcacgtattgggtttgggacagaattcactctcaccatcagcagcctgcagcctgaagatgttgactaactttattactgtactaaaaatttgacagtcgaccgtggatgttcgcccagggaccaaggtgacatacaaacgactgtgctgaccacatctgtctcactcctcccgcctatctagaacttgtactagtcgtggacggcgggctcggaccgaaggcctacaagtgnnnnnnnnnnnn

SEQ ID NO: 251610 - DNA, 835 bp, Homo sapiens
  misc_feature: GYAE6OF01BH0RI.25.28.C06.1.454.CMB.1.raw
  modified_base (241)..(241): a, c, t, g, unknown or other
  misc_feature (241)..(241): n is a, c, g, or t
tcagactgtacagtcacgaccggtgctcgatttagagctcacgtattgggtttgggggcagaagtctctctcagtcaggacacagtatggacatgagggtccctgctcagctactgggactcctgctgctctggctccagactacagatgtgacgtcagatcgacccagtctccattccctcctgtctagcctagttcgtgttggacactagaatccgagctatcgtacgttggccggganaggtcgagggtctaagttacgacttaatttacgtttacgccgttaggtaactaccgtaaaacgtaaacggtaaaccggtagggtaacgttaccgtttaacctaacggtccttaccgttaggtaactttacgttaacgttcgtacccgtttcgtaacccccgtttaaccgttaaccggttttaaccgaccgttacccgggtaaaccggggttccccttaagttcccgggttttaccggttaccgacgggtacccggtagtaacggttacgtaaacgtttcgggaaggtaacccgtaaggttacgttacccgtaccgtttaccgtaactacgtttaacgaccccggttaagaacccggtccgttaccgtcgaaccggttacgtaccccgtaaggtaacgttcgttaaccgtttaaccggaacctttaaacggtttaccgttagttaacgtaacttaaacggttaacttacgtacccgtacccttccccgtaagttcccgttaacgggttacccggggaacggtaaccgggaaccggttaagggtaccggtaaggtttaacctaaacccggtaaaagttcccggttggggtaaaccc

SEQ ID NO: 251611 - DNA, 854 bp, Homo sapiens
  misc_feature: GYAE6OF01DV04U.25.28.C06.1.454.CMB.1.raw
  modified_base (166)..(166): a, c, t, g, unknown or other
  misc_feature (166)..(166): n is a, c, g, or t
  modified_base (396)..(396): a, c, t, g, unknown or other
  misc_feature (396)..(396): n is a, c, g, or t
tcagactgtacagtcacgaccggtgctcgatttagagctcacgtattgggtttggggggaagaggaagactgacggtcctcccaggagttcaggtgcgtgggcaccttgggcgacgggggaggcgtggtccagcctgggaagtccctgagactctcctgtgtggcncctagactcaccttcagttagtatggcttcgtcgtgggtccgccaggtcgtccgaggcgaaggggctgggagtggcgtgggtattacgttggtctgacagaacaaatgaactatactcgacgcggacgtccggtaggacggggcctagttccaacctactccgtaccgaaggggaactaaacgttaccgaaaggaccgtaaaccctctaagtcctagaaccaaaagttanaaaaccgtaacgttaggaacggtaagtccggaaggtaacgttacgggtaccgttttaatacgttgtcggaccgtaaccgtcgtagggtagttaggtaacgtaaacgggtaaaaaggttcgttacgttacgtacgtaaccgtttccccggtacgtaacccgttcgggtaccgggtaccgacgggtaccccgtacccgttcgggtacccgtaaccgttcctacccgtactaacggtaccccgtttaacccgaacccggtaaaccgggaccccgttacggttaccccggtttaccccgtttacccccggtacggggttccccgacccccgttcggtaccccttaacccgggaacgggttaacccggaccccgttaaccccgggtttaccggggtacccggggggtaacccgaaccggaccggggtacccccggggttccccggttcggggttaaccccggg

SEQ ID NO: 251612 - DNA, 679 bp, Homo sapiens
  misc_feature: GYAE6OF01D2NMW.25.28.C06.1.454.CMB.1.raw
  modified_base (172)..(172): a, c, t, g, unknown or other
  misc_feature (172)..(172): n is a, c, g, or t
tcagactgtacagtcacgaccggtgctcgatttagagctcacgtattggggtttgggggcagaagtctctctcagtcaggacacagcatggacatgagggtccctgctcagctcctgggactcctgctgctctggcctcccagctatcagatgtggcatccagatcgacccngtcctccacttccctcctgtctgctattctggtaggagacagactccaccatcacgttcggccggcgagtcgaggctagttaaggttaaatttagtttggccgttaggtactacgaacgtacgaaacggaaaaccggtaacggggtaaacctttacccctaacccttcctactacttcttagtcactcgtactacttccttacgtttcgtacgtttacgggtttccggggtcccttcgtacgtacttcggacggtccggtacggtaggttcgggttcggtagggtaacgtagttaaccttaccgaccttacctaccaaccccgtagtacacgacccgtcgtcccgcgacccgtacggtaccgtaaggaattcgttacggttaactaactttaactttaacgtttacttaacttaaacttaaagttcgaaccgtaggttaccggtaccgtaggtccgttcggtaccggaccgacgggtacgaggacgaactagaacaacgtgtgtacg

SEQ ID NO: 251613 - DNA, 261 bp, Homo sapiens
  misc_feature: GYAE6OF01A075V.25.28.C06.1.454.CMB.1.raw
  modified_base (204)..(204): a, c, t, g, unknown or other
  misc_feature (204)..(204): n is a, c, g, or t
  modified_base (252)..(261): a, c, t, g, unknown or other
  misc_feature (252)..(261): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgaccgtggatgttcggccagggaccaaggtgacatacaaacgactgtgctgcacatctgtctcatccttccnccatctgaactgtacagtctgagcggcgtggacgaacggcgacatagnnnnnnnnnn

SEQ ID NO: 251614 - DNA, 608 bp, Homo sapiens
  misc_feature: GYAE6OF01A6RZX.25.28.C06.1.454.CMB.1.raw
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctggtccgccagtgtccaggcaaggggctggagtggctggggagttacgtggtctgacgtagacaaatgacagtactcacgcgatccgtggacggggcgattacgacctatctaccgtaggacaacgttccgaagacgaaccctctatctgacaatacgaactacgtagagagtacggaggactaccgggacgttttaagtacgtacgtacgaccggtacctagacggaggtggtacgtaggaaaacgttgtaaggtctacgtacttcccgtacgaccctggaccgggccgaacgggtctaacccgtgtacccgaccgtctaaccgtcaagccttacgacctacggccacgttccgctcccgtgaccgcctacgcgtaccgcgacacctccgtcgtcgggacc

SEQ ID NO: 251615 - DNA, 849 bp, Homo sapiens
  misc_feature: GYAE6OF01C98MG.25.28.C06.1.454.CMB.1.raw
  modified_base (211)..(211): a, c, t, g, unknown or other
  misc_feature (211)..(211): n is a, c, g, or t
tcagactgtacagtcacgaccggtgctcgatttagagctcacgtattgggtttggggggaagaggaagactgacggtcctcccaggagttcaggtgctgggcaccttgggcgacgggggaggcgtggtccagcctgggaagtccctgagactctcctgtgtcggcgcctagactcaccttcagttagttatggtcttcgtcgtcgggtccnccagtcgtccaggcgaaggggctgggaggtggcgtggggtagtttacgttggtctaggacagtaacaaatcgacatatacacgacgggtacgtccggtggacggggaccgtacttccgacctactccgtaccgaagggaacctaaccttaccgaaacgaaccgtaacccttcgtactactacgaactaaaactacgaaactaaagttacggaaggtacggtacgaaggtaacgttaaccggttaccgttttaatttcgtgtacgccgtaccgtacgagggtacggtaggtacggttaaagggtaaaacggttcggttacgttccttaccgtaccgtttccccggtaccgtaaccgttcgggtccggggacccgtacgggtaccccgtaacccgttcggtacccgttaccgttcccgttacccgttccgtaaccgttcccgttaaccccgtaaccggtaacccgggtaccccgttaacccggttccccggtttccccgttacccccggtcccggtccccggtacccccgttcggtaccccgtacccggtaacgggtacccgtccccgtacccgggttccgggtcccggggaacccgacggtacccgggccccgggttaccccgggtcgggttacccggg

SEQ ID NO: 251616 - DNA, 740 bp, Homo sapiens
  misc_feature: GYAE6OF01EM6TS.25.28.C06.1.454.CMB.1.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (334)..(334): a, c, t, g, unknown or other
  misc_feature (334)..(334): n is a, c, g, or t
tcagactgtacagtcacgaccggtgctcgatttagagctcacgtattgggtttgggggcagaagtctctctcagtcaggacacagcatggacatgagggtccctgctcagctccgtggacctcctgctgctctggctccagctatcagatgtgcatccagtatacgaccctagtcctaccatccctccgtgtctgctatctgtagganacagtcaccacatcgacgttcggccggngacgtcgaggtntaacgttagtaagtttgttcggccttaggtactcgacgtaccgaagtaaaccggtagggttaaacttacccctaaccgtcccttanacgttctactgactacgactacgtcccgttagtttccggacgtttaagggtttccccgggtcccttacgttacgtacgttacgacggtcggtaccgttaaggtcggggtacctagggaacttaggtacccttcgtaccgtcgtaaccctacctaacgtacgagttaccccgacgttcccgagaccgtaccgtaccggtaaggtacttacggtttacgttccgaaacctttttaccggtattttaaccccggttaaataaccgttaaactttacgcgtttaacgtacccggggtaccgttacggttcggttaacccgggcccgtaacgggggtaaaccgtaaacgggttacgggaaccgtaacggtaaacccgttaaacctaaacggttacgttgggtaaaccccgg

SEQ ID NO: 251617 - DNA, 725 bp, Homo sapiens
  misc_feature: GYAE6OF01B3VFY.25.28.C06.1.454.CMB.1.raw
  modified_base (236)..(236): a, c, t, g, unknown or other
  misc_feature (236)..(236): n is a, c, g, or t
  modified_base (347)..(347): a, c, t, g, unknown or other
  misc_feature (347)..(347): n is a, c, g, or t
  modified_base (385)..(385): a, c, t, g, unknown or other
  misc_feature (385)..(385): n is a, c, g, or t
  modified_base (641)..(641): a, c, t, g, unknown or other
  misc_feature (641)..(641): n is a, c, g, or t
  modified_base (718)..(718): a, c, t, g, unknown or other
  misc_feature (718)..(718): n is a, c, g, or t
tcagactgtacagtcacgaccggtgctcgatttagagctcacgtattggggtttgggggcagaagtctctctcagtcaggacacagcatggacatggacgggtccctgctcagctccgtgggactcctgctgctcgtggcctcccgaagactaaccaggtatgtcgacgtcaagactcgaccctagtcctccacgttccctcctgtcctgctatcgtgttaggacaagaagaactnagacattaccgacggttacggaccggggagtaacgtccggaaggtactaagtagtaactaagtttactacgcgtagtacaacaagaacgaaccgaggatacgtactacgtnacgtatactagacgtacgcttcgaccctactacgtacncgacgggtacggacctgtacccgttacgcgacgggtacgtactaaggtaactaggtacggtaacggtaactaaccggttacgtacctacccgtacgtttacgaaactaccgtaaccggataccccgaacggttccggaacgttaacccgaaggtacccggtaagggaactttcgttacgggtaacctaaccgtttaaattaacgggttaacaaaccgtaaagtaaacgtacttaccgtaacccgtccttaaacccngttaaccggtacggggtacccgagggtaaaccccgtaagggtaggtaaccaacgttaaccgaacgaaacccgggttntccgggg

SEQ ID NO: 251618 - DNA, 910 bp, Homo sapiens
  misc_feature: GYAE6OF01CKPMG.25.28.C06.1.454.CMB.1.raw
tcagactgtacagtcacgaccggtgctcgatttagagctcacgtattgggtttgggggcagaagtctctctcagtcaggacacagcatggacatggacgggtccctgctcagctccgtgggactcctgctgctctggcctcccagctatcgagtatgtggcatccagtactcgaccctgtcctccacttcccgtcctgtctacgctagttcgtggttaggacgacacggtacgttaccaaccgtacttaccgaccggtttcggggaccccggggtacggtacggttaaccggaacgggtacttaaggtttaaggttaaaacgttttaggtttaccgggtaccgtttagggttaacctacggaaggaacccgaaaacgggtaaaaccggaaacgggtaaacccgttttaacccccgtaaccccttacccgttactaaaccttacgttacgttaccggtacgtaccgtaacgttaacccttccgtttaacccgttttacggttaaccgtttaacccggggttttcccggggtacccccgttgttaccggttacgttaccggtacggggtcccgggttaccgtaggggttccggggttacggtaacgggtaacgtaacggttaccttaccgtaccgttacctaacccgtaacctacgtaccgaacgtccgtaaccgtccgttacggaccctacggtaacccgtaggttaaccgttaggttacgtttacgtaaaccgtttaacgtttaacgtttaaccggtaacgtttaaaacgttaaagttaccggtaacgttacccggttacggtaccggttacgggtacgttaccggtacccgggtaaccgggtaccgggtaacgtaaccgggtacggaaccgttaacgtaacccggtaaaggtccggttccggtaccggg

SEQ ID NO: 251619 - DNA, 784 bp, Homo sapiens
  misc_feature: GYAE6OF01C9DYS.25.28.C06.1.454.CMB.1.raw
  modified_base (145)..(145): a, c, t, g, unknown or other
  misc_feature (145)..(145): n is a, c, g, or t
  modified_base (263)..(263): a, c, t, g, unknown or other
  misc_feature (263)..(263): n is a, c, g, or t
  modified_base (588)..(588): a, c, t, g, unknown or other
  misc_feature (588)..(588): n is a, c, g, or t
tcagactgtacagtcacgaccggtgctcgatttagagctcacgtattgggttggggcagaagtctctctcagtcaggacacagcatggacatgaggtccctgctcagctccgtggactcctgctgctctgctccagctatcagtntgtcgctatccagtatcgaaccctagtcctcctatccctcctagtctacgtcctattcgtggttaggaacgaccgtagtaacgtcccaaccgtagttaccgtaacggttacccggggntaaggttccgagggtacctagttaaggtaaatttacgtttacggccgttaggtacttacacggtaaccgtaaacggaaaaccggtaacgggtaaaaccgttttcccctaaacccgttccttacgtaacgtttcttaagtcgtaactccggtacttaccgttacctacgtttacgtaccggtttaaacggtttccgggggttaccccttagtaccggtttactttaccggaacggtccgggtaccgtagggttcccggggtgtaaccggggtactaaggttaaccgttcctaacccttacgtacctaacgtacgtacgacgttacncccgtacgttcgacgtacgtccgtagaacgtcgttacgtacgtactttaaccgttattaccggtaattaaccgtaaagtttcgactacgggtaccgttaccggtaggtacgtttcggaaccggtaccggtaaccgggtaacgtacgggttaacgaacgttaaccgtaaacgaaccggttactcggttactacccgg

SEQ ID NO: 251620 - DNA, 920 bp, Homo sapiens
  misc_feature: GYAE6OF01BSQHB.25.28.C06.1.454.CMB.1.raw
  modified_base (358)..(358): a, c, t, g, unknown or other
  misc_feature (358)..(358): n is a, c, g, or t
tcagactgtacagtcacgaccggtgctcgatttagagctcacgtattggggtttgggggaagaggaagactgaccggtcctcccgaggtagttcaggtgcgtgggcaccgttgggcgacgggggaggtgtgtcacaagtagtttcgggctcgtgggcaccggtggagtcggtgggggaggtcggtcggtaccacggcccggtaggggtaacgtccctaggacgtacccttccgtccgttcggttggtggccgtacctagtacctcctaccgttacgaaggtttattagtcggtcctttccggtgtaccggggtcccaccgtacggttcgtaccgagggacgaacgggggtcgtagggnggttccgggtacggttagggggttaaacgttttacggttcgggttacctacggtaacgtaaaccgaaaacgttaaaaggtccggtaaacctaagtttacgaccgggaccggtacccgggtaaccggtttcccggggtaacgggggtaacggggtaccctactttacccggaaccgtaacctttaccccgggaaccggtaaccgggtaaacctttaacggtaaaccgaaaccggtacccgttaaacccgtctttaacgtacgtaacgaaacctaaagtacgaaagtacgttagacggtagtaacgagtacgttacggttacttatcgtacgtacgacctccggagttagggagtacggaacgtaaggtaaagtctttacggcttaccgttaccggttaccgccgttaacccggtggggtacccggccggaacgaccccgtacccggttacgtacccgtaaccgttccctaacggacccttaccccgttaaaccccggtaacccgaccccgtaaccgggttccccacggttttacccccgttccccggtaccgccccgggtacc

SEQ ID NO: 251621 - DNA, 803 bp, Homo sapiens
  misc_feature: GYAE6OF01CR700.25.28.C06.1.454.CMB.1.raw
  modified_base (312)..(312): a, c, t, g, unknown or other
  misc_feature (312)..(312): n is a, c, g, or t
tcagactgtacagtcacgaccggtgctcgatttagagctcacgtattgggtttggggggaagaggaagactgacggtcctcccaggagttcaggtgctgggcaccttgggcacgggggaggcgtgggtccagcctgggaagtccctgagactctcctgtgtggcgcctagactcaccttcagtagttatggcttcgtctgggtccgccagtgtccaggcgaaggggctggagtggcgtgggtagttacttggtctgacagaacaatgacatatcacgacggacgtccgtggaacggggcctaattccgaacntaccgtaccgaagggactaaacttaccaacggtaaccgaaccctacttaatcctagaactaaaagtacggaaactaacgttagaggtaacgtcggaagggtaacttaaccgggtcgttttaacttacgttggtacgtaccgaccgttacgaggtaggtacggtagttacgggaaaaggttcggtaacgttccgtaccgtaacgtttccccggtaccgtaaccgttccgggtacggggtacccaaccggggtccctacccggttaccgggttaccgtaaccccgttccgttacccgtaccgtaaccgttacccgttaccccgtaacccgggtaaccggttacccgtaaccgttccccggtttccccgtccccccggtacggtccccgtacccgtccggtcccgtccggtaccggaccgtaccccgacccggtaccgggtccggggtacctaaccggcccggtaccccgggtccccgggttggggtaccccgg

SEQ ID NO: 251622 - DNA, 256 bp, Homo sapiens
  misc_feature: GYAE6OF01BH948.25.28.C06.1.454.CMB.1.raw
  modified_base (242)..(242): a, c, t, g, unknown or other
  misc_feature (242)..(242): n is a, c, g, or t
  modified_base (248)..(256): a, c, t, g, unknown or other
  misc_feature (248)..(256): n is a, c, g, or t
tcagactgtacagtcacgaccggtgctcgatttagagctcacgtattgggtttgggacagaattcactctcaccatcagcagcctgcagcctgaagatgttgctaacttattactgtactaaaaatttgacagtgaccgtggatgtcgccaggacaaggtgacatacaaacgactgtgctgcacatctgtctcatccttccgcatctagaactgtacagtctggagcggtctggacaggcanagtagnnnnnnnnn

SEQ ID NO: 251623 - DNA, 786 bp, Homo sapiens
  misc_feature: GYAE6OF01AV3GV.25.28.C06.1.454.CMB.1.raw
  modified_base (167)..(167): a, c, t, g, unknown or other
  misc_feature (167)..(167): n is a, c, g, or t
  modified_base (183)..(183): a, c, t, g, unknown or other
  misc_feature (183)..(183): n is a, c, g, or t
  modified_base (210)..(210): a, c, t, g, unknown or other
  misc_feature (210)..(210): n is a, c, g, or t
  modified_base (307)..(307): a, c, t, g, unknown or other
  misc_feature (307)..(307): n is a, c, g, or t
  modified_base (492)..(492): a, c, t, g, unknown or other
  misc_feature (492)..(492): n is a, c, g, or t
  modified_base (714)..(714): a, c, t, g, unknown or other
  misc_feature (714)..(714): n is a, c, g, or t
  modified_base (738)..(738): a, c, t, g, unknown or other
  misc_feature (738)..(738): n is a, c, g, or t
tcagactgtacagtcacgaccggtgctcgatttagagctcacgtattgggtttggggggaagaggaagactgacggtcctcccaggagttcaggtgctgggcaccttgggcgacgggggaggcgtgggtccagccgtgggaacgtccctgagactctctgtgtggcncctagactcaccgttnagtagttatggtcttcgtcgtgggccncgagtcgtccaggcgaaggggctgggagtggcgtgggatttacgttggtctgacagaacaaagtcgactatactaccgacggcgggtacgttccggngggaacgggggccctattaccgaacctagtacccgttaccggaaggggtaactaaaccgttaccgaaaacgtaacccggtaaacccttctacgtaccgtacgtaaactaaaagtaacgaaacgttaacgttagaacggtacggtacggaagggttaaccttacgggttacggtttactttaacgnggttacggacgtaccgtacgaaaggttacggtacgggaacgttaaacggtaaaacggttcggttaacgttcgtaccttaaccgtttacccggtaaccgtacgttcgggaccgggaccgtaacgggaccctacccggtcggtcccgtaaccgttccgtacccagtcccgtaccgtaaccaccggtaacggtccttacgtccggttacccctccgtccggtccnccgtacccgtcgacgacgggaccncggtcccggtggaccggtaccgacgtccgacggtccgtcggtacccgg

SEQ ID NO: 251624 - DNA, 864 bp, Homo sapiens
  misc_feature: GYAE6OF01BY6MV.25.28.C06.1.454.CMB.1.raw
  modified_base (200)..(200): a, c, t, g, unknown or other
  misc_feature (200)..(200): n is a, c, g, or t
tcagactgtacagtcacgaccggtgctcgatttagagctcacgtattgggtttgggggggaagaggaagactgacggtcctcccaggagttcaggtgctgggcaccttgagcactgaacgcagcggactcaccatggagtttgggctgaacgttgggttttcctcgttgcttcttttaaggaggtgtccagtgtcaggcncatcgtgggtggagtcggtgggggaggcggtcggtccagccgtggggaacgtcccgtgacgtactccttccgtggtggcgggccgtacctacgtacctcctaccctttctaaggttagttacgtcgggtccgtttcgttccggtcggggtccccgaccgtaggttcggtaccggagggccggtaaggggggcgtaggggtaggttcgggcggttaggggtacggttttacgtttgggtcttacggaactaaggtaaacctaaagtacggaactaagttaaccgtaccggaaccggggtacgggtaaccgggttccgggtacggggggacgggggtacccgttaacttacccgaaccgttaccgttacccgtaaccgggtacggggtaaaccctaaccgttaaccccgaaaacggtaaccccgttaaccccttacgttaacctcgtaacgaacctaaacgtaaccgtaaccttaacggttaggaacggtaaggtaacggaacgggtaacgttaaccggtttaccgtttaagtacgttacggtcggaccggtaccgtaggagggtacggtacgggtaacggttaaacgggtaaacggttccggttaacggttacctacggtttacccggttacccggttaccgtcccgggttacggggtcccgggg

SEQ ID NO: 251625 - DNA, 815 bp, Homo sapiens
  misc_feature: GYAE6OF01BXFYH.25.28.C06.1.454.CMB.1.raw
  modified_base (205)..(205): a, c, t, g, unknown or other
  misc_feature (205)..(205): n is a, c, g, or t
tcagactgtacagtcacgaccggtgctcgatttagagctcacgtattgggtttgggggaagaggaagactgacggtcctcccgaggagttcaggtgctgggcaccttgggcacgggggaggcgtggtccagcctgggaagtccctgagactctcctgtgtggcgcctagactcaccttcagtagttatggcttcgtctgggtccncagtgtccagggcaaggggtctggagtggcgtgggtactttacgttgggtcctggaaccaggaactaaagtcgaactatacgtcgacggacggtacggtccggtagggaccggggtcctacgttaccacctacgttccgtaccgaacgggtaactaacgttaccgaacgtaaccgtaacccttactacgtacgtacgaactaaacgtacgtaaacgtaacgtaggaacggtacggtacggaacggtacggttaaccgggttaccgtttaacgttacgtcgtacgtaccggtaccgtacggaagggtacggtacgggtaacggtaaacggtaaacggttcggttaacgttaccgttaccgttaccgttccccggtaccggtaccggtacgggtaccggggacccgtacgggtacccgtacccggttaccggtacccgtacccggttaccgtacccgtacgacccgtacccgtacccgaccggtaccggtcccgttaccggttcccgttccccgtcccggtcggtccccgtaccgtccgtacccgtccgacggacccgtcccgtaacccgtaccgacgtaccgaccgaccggtccggtcccggtccggtcgg

SEQ ID NO: 251626 - DNA, 971 bp, Homo sapiens
  misc_feature: GYAE6OF01ANPD8.25.28.C06.1.454.CMB.1.raw
  modified_base (253)..(253): a, c, t, g, unknown or other
  misc_feature (253)..(253): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggtcttcgtctgggtcccnccgagtgtccaggcaagggggctggagtcggcgtggggtacttacgttggtctcgtacaggtaaccaaagtgaactagtactaccgaccggcgggtacgttcccggtacgggacggggtcccgtaacgtttcccgaacccaacttccgttacccgaagggggtaaccctaaaacgttacccccgaaaaaggtaacccggtaaaaccccctttccttaaacgttacccgttacggaaacccttaaaaaagttaccgtaaaaaacccgtaacgttttaacggaaacgggtaacggttaccggaaacggggttaacgttaaacccggggtttacccggtttttaaactttaaacccggtttagggttaaccggtaccccgggtaaacccttacccggggtaaggggttaaccgggtttaccggggtaaccggttaaacggggtaaaaaaccggtttaccgggtttaaaccggtttaccgtttaacccgtaacccgttttacccccggtacccggttaacccgttcccgggtacgggggtaccccggtacgggggtacccctaccccgggttcgggttacccgtaaccccggtttcccgtacccgttacccaccggttcccccttaccccggaaacccccgtaaaccccgggggtacccccttaaccgggtttccccgggttaccccccttttccccccgggtccgggttaccccccccggg

SEQ ID NO: 251627 - DNA, 255 bp, Homo sapiens
  misc_feature: GYAE6OF01BAFYP.25.28.C06.1.454.CMB.1.raw
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (253)..(255): a, c, t, g, unknown or other
  misc_feature (253)..(255): n is a, c, g, or t
tcagactgtacagtcacgaccggtgctcgatttagagctcacgtattgggtttgggacagaattcactctcaccatcagcagcctgcagcctgaagatgttgctaacttattactgtacaaaaatttgacaggtcgacccgtggatcgtcggccaggaccaaggtggacatcaaacgactgtgctgcaccatctgtctcatccttcccgcatctgactgtacagtctaggngcggntggacaggcgacatagnnn

SEQ ID NO: 251628 - DNA, 331 bp, Homo sapiens
  misc_feature: GYAE6OF01A6OTH.25.28.C06.1.454.CMB.1.raw
  modified_base (303)..(304): a, c, t, g, unknown or other
  misc_feature (303)..(304): n is a, c, g, or t
  modified_base (306)..(331): a, c, t, g, unknown or other
  misc_feature (306)..(331): n is a, c, g, or t
tcagactgtacagtcacgaccggtgctcgatttagagctcacgtattgggtttgggggaagaggaagactgacggtcctcccaggagttcaggtgctgggcacccgtggtcacccgtctcctcacgtcttccaccaacgggcccatcggtccttcccctcggccgccctggcctccgacggacgccacccgtcgtgggggcaaccgcggccggcccgtgggctacgccgttcggtcaaggtcctaccttccgacttcgtacgagtcctaggcggcgggtctaggacacgggtcactagtacgnngnnnnnnnnnnnnnnnnnnnnnnnnnn

SEQ ID NO: 251629 - DNA, 1044 bp, Homo sapiens
  misc_feature: GYAE6OF01AVQZ6.25.28.C06.1.454.CMB.1.raw
tcagactgtacagtcacgaccggtgctcgatttagagctcacgtattgggtttgggggcagaagtctctctcagtcaggacacagcatggacatggacgggtccctgctcagctccgtgggactcctgctgctcgtggcctcccagctatcagtatgtgacactaccagactacgaccctacgttcctcctaccttcccgttcccgttcgtcctcgaccttacttcggttagggttacgggaacgtacggtacggtaccgtaccccaacctactacccggttacgggttcccggggaccggggtacggtacggtacggaacgggtacgtttaagttaaacgggttaaacgttttacggttccgggtacgttaggttacgacggaacgaacggtaaaacggggaaaccgggaacggggtaaccttacccgtaaccgttaaccggtccttaacgttacgttactttacggtttacgtaacccgttaccggtacccgtttaacgggtttaacggggtttaacgggaacggggttaccgttaacccggttaacccgtaagtttaacccgggttaaacgggttacggtaaccgggtaccgggttaacgggtagggtttaaccgggttaccgggttagggttaaacccggggtacttttaaacgggtttcctttttaaccccgaaccgtttaccccgttaaccctaacgtaaccccggttacaacccggtaccgtccggtaccgttaccggccggttaaccgcggtttaacgaacgttttccggttaaccttaacccgtacggtttttaaacttaccgttaagttaaacccgtttaaaccttaaaacggttttaaaaccgttttcccccgttaaaacccgtttttcccccggttaacccggttccccgggggttttaaacccggggacccggggttaaaacccggggggtttaaaccgggaaacccggggtaagggtttaaaccgggtaaacccgtttaaaccggaaaaccggttttaaaccgggggtttcgtacccgggtaaaccccgg

SEQ ID NO: 251630 - DNA, 843 bp, Homo sapiens
  misc_feature: GYAE6OF01DWOYN.25.28.C06.1.454.CMB.1.raw
  modified_base (532)..(532): a, c, t, g, unknown or other
  misc_feature (532)..(532): n is a, c, g, or t
tcagactgtacagtcacgaccggtgctcgatttagagctcacgtattgggtttggggcagaagtctctctcagtcaggacacagcatggacatgacggtccctgctcagctcctgggactcctgctgctcgtggctcccagtctatcagatgtcggctactccgagactacgaccctagtctccaccttccctccgtgtctcgtctacgttcgttaggttacggaacgacgtaaggtactacccgaacctacgttaccggtaccggttccggacccgggtagtaccggtacgtaacggggaccgttaagttaacggtttaaaagttttaggtttaccggtcgttacgggtaatccggaacgacgaaaaccggaaaaccgggtaacgggttaaacccgttaacccgttaaccccggttcctactaacttcgtttgtaacgtccgttaccgacttaccgttacccgtttaactttacggttaaccgtttaccgggttttacgggttccccgttacgttaacgtacggtaccggnggtaccgggtacggttcggtacgggttacgtacgggtacgtaacggttaccgtaccgttacctaccgttaaccctaccccgttacgtacgtaaccgccggttaaccgtccgttacgaaccgtacgtaccggtaacgttaacgttacggttacgtttaccgtaaccgttaactttaacgtaccgttaaacgttaaacgtttaacgtacgtacggtaagttaccgggtccgttaagttccggtccggtacccggacggtaccgaacggggtaacgtacgaaaccgtacaaaccggtaacgtccgtgtaaccgg

SEQ ID NO: 251631 - DNA, 829 bp, Homo sapiens
  misc_feature: GYAE6OF01ARYNZ.25.28.C06.1.454.CMB.1.raw
  modified_base (413)..(413): a, c, t, g, unknown or other
  misc_feature (413)..(413): n is a, c, g, or t
  modified_base (526)..(526): a, c, t, g, unknown or other
  misc_feature (526)..(526): n is a, c, g, or t
  modified_base (630)..(630): a, c, t, g, unknown or other
  misc_feature (630)..(630): n is a, c, g, or t
  modified_base (742)..(742): a, c, t, g, unknown or other
  misc_feature (742)..(742): n is a, c, g, or t
  modified_base (782)..(782): a, c, t, g, unknown or other
  misc_feature (782)..(782): n is a, c, g, or t
tcagactgtacagtcacgaccggtgctcgatttagagctcacgtattggggtttgggggggaagaggaagactgacggtcctccaggagttcaggtgcgtgggcaccttgagcactgaacgcagcgactcaccagtgggtagtttgggctagtaacgtttcgggttttcctcggtttgtcctttacgttttaaaggtaggttcttcgaggttggtacgacgggcctactagttcggtggggtcgggtacggttcggggtaggggggaggtcgggttcgggttacccgacggtccggtaggggaaccttcccggtagaacggtccttccgtccgtggtcggtacggcctccgtagtaccctaccgtcttacgaagtttcgttagttcggtccgtttcggtccggtacgggtccncgtggtaccgtccgagggacggtacggtcggtagggtggtcgggacggttcgggttacgtttacggttcgtaacgtacgaacgtaagttaagagtaactaagtacgtaccggngggtcgtacggtaccggggttcgggaccgggtacgtacctccgaacccttgtaccccgtaacgggaggtaaacctagggtaaccccaaacggaacccgttaccnccggtttaacccggttaacaaacgttaaaccgagtaaaccgtaggttaccgaagggaacgggtacgtaggtaaccggttctttaaccgtattacggtgacgtaccgtaccgngttagggagtccggtaaaggtaccgtaaggtccgtttacnccggttaaccgtcctaacccgggtgtaacccggtggtaccggggacg

SEQ ID NO: 251632 - DNA, 831 bp, Homo sapiens
  misc_feature: GYAE6OF01BCEOS.25.28.C06.1.454.CMB.1.raw
  modified_base (146)..(146): a, c, t, g, unknown or other
  misc_feature (146)..(146): n is a, c, g, or t
  modified_base (207)..(207): a, c, t, g, unknown or other
  misc_feature (207)..(207): n is a, c, g, or t
  modified_base (637)..(637): a, c, t, g, unknown or other
  misc_feature (637)..(637): n is a, c, g, or t
tcagactgtacagtcacgaccggtgctcgatttagagctcacgtattgggtttgggggcagaagtctctctcagtcaggacacagcatggacatggacgggtccctgcctcagctccgtggacctcctgctgctctggcctcccanctatcagagtcgtgctactccagactcgaccctagtcctcctagtccccttccgtagtccngactcttccgttaggttacggaacgtaaccgaagtaacgtccgacggtacctaacgttaccgtaccggttccggggccggggtaaccgtacggttaccggggaaacgggtccttaaaacgtttaacggtaacctttaaaaggttttacgttaccggacccgtttaggtaaactaacccgaaaaggaaaccgggtaaaaccgtggggtaacttaccggttacctaaccggtcgttacctaggtactacgttacggtcgtcccttcccgacccgttaacgtaaacccgttcgacccgttaccgggtaccggtacccttacgttaccggttccggacgccggtaccggtacgtaggtaccggtacgtacgggtacggtaaccgtacggttactaccgtactccgtaacctacgtactaccgagtacccggtcnccggtgacccgtacgtaccgtaagacgttacttacgggtacttaacccgttaacgtaacgttaacgacgttaaaaacgtacgttaaccttaccttacccgtacccgttacccgtaccgtacggttaacccggtcgggaacgggtaacggtaaccggtagggaaagttaaccggaccggtaacgttaaaccgggg

SEQ ID NO: 251633 - DNA, 702 bp, Homo sapiens
  misc_feature: GYAE6OF01B78GM.25.28.C06.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
tcagactgtacagtcacgaccggtgctcgatttagagctcacgtattggggtttgggggcagaagtctctctcagtcaggacacagcatggacatgagggtccctgctcagctcctgggactcctgctgctctggctccagctatcagatgtggcatccagatcgaccagtctccactcctcctgtctgcatctggttgganacagagtccacctatcacgttcggccgggngagtcgagggctaagttaggtaaatttgttcgggaccttagggtatccgagtaccgaaacggaaaaccggaacgggttaaacgtttaccccgtaacctccctactaatactatgccgttgacctacgttcctacgtttgaccgttaagggttttccgggcccttcttacggacttacgacgggtccgaccgtagggtcgggtacgtagggtacgtaagtaacttcctaactcctacgtaacccacttccgacgtacgacggtacctcgacccgtacgtctaaggtaacggtacgttacggttacgtaaccgttaaacttagtttaaccgtaagtttaaacgtaaaagtttcgaaacgtccggtaccggtaccgggttaggtacggttccgggttaccggaccgggtaccgggaacgtaacgggtaacggaacccgttaggaaacccgaaaggttaccgttgggtacccgg

SEQ ID NO: 251634 - DNA, 839 bp, Homo sapiens
  misc_feature: GYAE6OF01CHIS5.25.28.C06.1.454.CMB.1.raw
  modified_base (258)..(258): a, c, t, g, unknown or other
  misc_feature (258)..(258): n is a, c, g, or t
tcagactgtacagtcacgaccggtgctcgatttagagctcacgtattggggtttggggggaagaggaagactgacggtcctcccaggagttcaggtgctgggcaccttgggcacgggggaggtgtgtcacaagatttgggctctgggcacgtggagtcgtgggggagcgtggtccagcctgggagtccctgagacttctcctggtgtggcgtacctagactcacctttcagtagttatgggtcttcgtcgtcgggccncctagtcgtccaggccgaaggggctggacggtggcgtaggggatttacgtggtcttgacctagaactaatcgactaatacgcgtacgcggtacgtccgtggacggggactattaccacgtactaccgtccgaaggggaaccttaacgttacccgaaaaggtaaccgaaccccgtagttaacgtccgtagtaacctaaaagtacgaaaacttaacgtacgaacgggtacgtaacgggtaacgggtacttacccgggttacccgttttaagttacccggtagttaccggtaacgtacccgttaacgggaacgggttacggttaccgggtacggtaaaacggggtaaacgttaccggttaaacggttccctaaaccgttacccggtttaaccccggttaacccgttaccgttaccggggtaccgggggtacccgaacggggtccccctaaacccggttcggtaacccgtaaccccgttcggttcccctacggacccggttccccttaaccgaaccccgggaaaccggggtccccttaaggttccccccgggttacccttcccccgggtccggttaacccccggg

SEQ ID NO: 251635 - DNA, 679 bp, Homo sapiens
  misc_feature: GYAE6OF01BCO35.25.28.C06.1.454.CMB.1.raw
  modified_base (136)..(136): a, c, t, g, unknown or other
  misc_feature (136)..(136): n is a, c, g, or t
  modified_base (254)..(254): a, c, t, g, unknown or other
  misc_feature (254)..(254): n is a, c, g, or t
tcagactgtacagtcacgaccggtgctcgatttagagctcacgtattggggtttgggggggaagaggaagactgacggtcctcccaggagttcaggtgctgggcaccgttgggcacgggggaggtgtgtcacaagntttgggctctgggcaccggtggagtcgtgggggagcgtggtccagcctgggaactccctgacgactctcctgtgtggcgctagctcacttcagttattatggcttcgtcgtgggtccncagtcgtccagggcgaaggggctggagtggcgttgggtacgtttacgttggtcctgaccagaacaatgactatactcgacggcggtaggtccggtagggacgggcctaatccgacctacgtccgtaccgaagggaactaacgttaccgaacgtaccgtaaccctctaacgtctacgactaaaatcgaaacgtacttggaacggtagtacgagtacgtacggtacgtttatacgtgtacgtacgtaccgtagacggtaggtacggtacgtaaggtaaacgtcgtacgtctacgtacgttcccgtacgtaccgttcggtcgggaccgtacgggacccgtaccggtcgtccgtaccgtccgttcgtacctacgtcctacccgacggtaacccgccctacggtcccgttcccttcccggtcggtccccg

SEQ ID NO: 251636 - DNA, 787 bp, Homo sapiens
  misc_feature: GYAE6OF01EQLIH.25.28.C06.1.454.CMB.1.raw
  modified_base (161)..(161): a, c, t, g, unknown or other
  misc_feature (161)..(161): n is a, c, g, or t
  modified_base (221)..(221): a, c, t, g, unknown or other
  misc_feature (221)..(221): n is a, c, g, or t
  modified_base (775)..(775): a, c, t, g, unknown or other
  misc_feature (775)..(775): n is a, c, g, or t
  modified_base (781)..(781): a, c, t, g, unknown or other
  misc_feature (781)..(781): n is a, c, g, or t
tcagactgtacagtcacgaccggtgctcgatttagagctcacgtattggggttgggggcagaagtctctctcagtcaggacacagcatggacatggacggtccctgctcagcctccgtggtacctcctgctgcttcgtcgtccctaccatactatcgaagngttcggcactacgtccgaagctaccggaccttaactcctacctacccgtccctcccgttntcgtcgctacttcgttagggtacgaactacgactaccgactaccgtacgtaccgtaacgggtacggacgtaggtaccgaggttaaccgttaggtaaggttaacgtttcggttcgtacgtcgtaactacgtacgaaacggtaaaccggtaaaccggttaaacggtaaccccttacccgttaacccgtctacttacgtacgttacgtctactcgtaaccgttccgttacgttacgttaccgttacggttaaccggttcggtaccttacgtaccgttacgacgtcggtacgtacgggttacgggtcggttacgtaacggtacgttaacgtttaaccgtccttacccgtaacgtaccgtaaccgttacgcgtaacgtaccgaccgtcgacccgttgaacggtacgttaacgggtattacgttaccttaacgtaacttttaacgtaacgtttaattaaacgttaactaacggtttaacgacgtcgggtaacgtaccggtacggtaccgtaacgggtaccgtaacggaccggagtaacggtacacgtaaacgacgtacgnggtacncggtac

SEQ ID NO: 251637 - DNA, 780 bp, Homo sapiens
  misc_feature: GYAE6OF01BEQK3.25.28.C06.1.454.CMB.1.raw
  modified_base (251)..(251): a, c, t, g, unknown or other
  misc_feature (251)..(251): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggagcgtggtccagcctgggaatccctgagtactctcctgtgtggcgcctagactcaccttcagtagttatggtcttcgtctgggtccnccagtgtccaggcgaaggggtctggagttggactggggtactttacgttggtctgacagaacaaatgactatagtccacggtgacgtccgtaggacggggcctagttccaacctagtccgtaccgaagggacctaaacgtttccgaaaaggtaccgtaaaccccttctaacgttccgtacggaacctaaaaagtccgtaaaacctaaaccgtttgggaagtaccggttacggaacgggttaacgtaccggggttaaccgttttaacgtttaacgttacgggtaccgaccggtaaccttacggaagggtacggtacgggtaccgttaaagggaaaacgtttcggtaacgttcgttaccgtaccgtttaccccggtaccggtaacccgtttcgggttaccgggggacctaacgggtccctaacccgggtcgttaccccgaccggttccgtacccgtcgaaccgttcccgttacccgaaccggtaaacccggtccctacgttcccggttccccttccccggcggtacccccg

SEQ ID NO: 251638 - DNA, 759 bp, Homo sapiens
  misc_feature: GYAE6OF01DFOQY.25.28.C06.1.454.CMB.1.raw
  modified_base (166)..(166): a, c, t, g, unknown or other
  misc_feature (166)..(166): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgcctctggcctccagcctatcagtatcgtgcatcccagntcgaccctagtcctccactccctccctgtctcgctatctggttaggaacgacgagactccaacctattccacgttcggcccgggagtacgccgaagggtcctagttaggtaaatttacgtttcggccgttaggtatacacgacgaaacggaaaaccgtaagggtaaaccgttcctaacctccgtctattcctatggctgaccattcccgtacgttttcgaacgtttacgggtttaccggggtcccttaccgtttacggactttaccggacgggtccggtaggtccggtggttaccggtaagggtaacgtaacggtaacttccgtactccgttaaccacctactacgtacgcgaacgtcctacggacctacgtaccgtaaggtaagttaccgttacgttaacgactttaaacgtttacgtttaaccttaacgttaaacgttaaaacgttaacgttaaacgtttaccccgttacccgttaccccctttaggttaccccgttaccgggtaccggggtaacggtaaccggggtaaaccgtaacgggtacggtaacggttaaacgaacccggtaaaaccggtcggttaggtaaccggg

SEQ ID NO: 251639 - DNA, 872 bp, Homo sapiens
  misc_feature: GYAE6OF01CGNHG.25.28.C06.1.454.CMB.1.raw
  modified_base (195)..(195): a, c, t, g, unknown or other
  misc_feature (195)..(195): n is a, c, g, or t
tcagactgtacagtcacgaccggtgctcgatttagagctcacgtattgggtttgggctgaactgggttttcctcgttgctcttttaagaggtgtccagtgtcaggcgcatctgggtggagtcgtggggggaggcgtggtccagccctggggaacgtccctgagactctcctgtgtggcgcctagactcacctttnagttagttagtggctttcggtcgtcggggtccgccaggtgtccgagggaccgaagggggcttgggagttcgggacgttgggggtaacgttttaccgtttgggtacctaggaacgaagaacctaaaagtgaaactagtactacgaaccggcgggtaacgttccccgggtgggaacgggggtccctacgtttaccgaacctacgttccgtacccggaaaggggaacctaaacgtttaccgaaaacggaacggtaaacccctttcggtaactcctacggaaaccttaaaagtacgaaaactaaaccgtttggaaacggtaacgggttacggaaacgggtaacgttaccggggttaccctttttaatttaaccggttcggtaaccggccgtaaccgtaccggaacggggtagggttacgggtacggttaaaggggtaaaaacgtttcgtaaaggttccttacgttaccttcccggtaccgtacccgttcgggaccgggtccgacgggaccttcccggtacggttacccgcccgttcccgttcctccgttaccgtcccgttacccgaacccgtacgggtcccctaacggttcccgttacccgttcccccggacggccccgttcccggcgtacccgtacccggacggtaccggacccctccgggttcggggcggggtaacccg

SEQ ID NO: 251640 - DNA, 879 bp, Homo sapiens
  misc_feature: GYAE6OF01DT3G1.25.28.C06.1.454.CMB.1.raw
  modified_base (192)..(192): a, c, t, g, unknown or other
  misc_feature (192)..(192): n is a, c, g, or t
  modified_base (363)..(363): a, c, t, g, unknown or other
  misc_feature (363)..(363): n is a, c, g, or t
tcagactgtacagtcacgaccggtgctcgatttagagctcacgtattgggtttgggggaagaggaagactgacggtcctcccgaggagttcaggtgcgtgggcaccttgggcgacgggggaggtgtgtcacgaagatttggctctgggcaccgtggagtcgtggggagcgtggtcagccgtgggaacgtccngagactctcgtgtgtggcgcctagactcaccttcgagttagttagtggccgtttcgtcgtcgggtcccgctaggtcgtccgaggacgaaggggctgggagtcggcgtggggagttttaccgtggtcctagacagaaacaaacgtgacagtactcgacggcggtgtaccggnggacgggcctagttaccactctcgtaccgaacggaactaacgttaccgaaagaaccgtaacccttattaacgtcgtagaaccgtaaagtacgaaacttaacgttacggaaggtacggttaaccggaaaggtaaccgtttaaccccgggttaccgtttttaaacgttacggtttacggtacccggtaaaccgtaccccgtacggggtaaaggttaccgggttaccggggtaacgttaaaaccggggttaaaaaccggtttcgttaacggttacccgtttaccgttaaacccgtttcccccgggtacgttaccccggttacgggtacccggggtaaccgaccgggttaccccgtaaccccgtttgggaccccttaaccccgggttcccgtaccccgtttacgaacccccggtttaaccccttcccccgggtaaaacccccgaaccggggttaccccccgtttaaccggttcccccggtttaacccccccgtttacccccggtccggtaaccccccggg

SEQ ID NO: 251641 - DNA, 717 bp, Homo sapiens
  misc_feature: GYAE6OF01E2OPH.25.28.C06.1.454.CMB.1.raw
  modified_base (166)..(166): a, c, t, g, unknown or other
  misc_feature (166)..(166): n is a, c, g, or t
  modified_base (178)..(178): a, c, t, g, unknown or other
  misc_feature (178)..(178): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
tcagactgtacagtcacgaccggtgctcgatttagagctcacgtattggggtttgggggcagaagtctctctcagtcaggacacagcagtggacatgagggtccctgctcagctcccgtgggactcctgctgctctggcctccagctatcagatggtgcatccagntagacccagtcnccactccctcctgtctgcattcgtggtgganacganaccgtcactcgtctacgtggcccgggtgagtcgagggctagttacggtaaatttcggttcggaccttggtatcgaacgtacgtaacggaaaaccgaggttaaccgtttaccctaaccgttcctatacgtctagtgcttacaccgtacttacccgtatttacggccgtttaacgggtttcccgggtcccttacgtacgttacgtacggacgggtcgtacggttaggtcgggttacgaaggtaactacgacttaccgtaccgtcaccacgaactcgaagtacccgacgtccgtacgaccgtacgtacaggttaacgtacgttagttaaccgttaaccttaagtttaacgttaacccgttaaagttaaacgttaaacccgttggaaccgttagggtacccggttaccgttaggtacccggttcggttaaccccggggaaccggtacgggtaacccggtaaggttaaccggaactaacgtaaaacggtccgttaggcccgttacggg

SEQ ID NO: 251642 - DNA, 942 bp, Homo sapiens
  misc_feature: GYAE6OF01DE2FF.25.28.C06.1.454.CMB.1.raw
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccggtggagtcgtggggggagcgtggtccaggccgtgggaagtccctgagactctcctggtgtggcgcctagactctaccttcagttagttatggcctttcgtcgtgggtcccgccagtcgtccagggcgaagggggctgggagtggcgtggggtactttacgttggtctgacagaacaaatgactatactcgaacggtcggagtccggtaggacggggtcctaatttccaaccgtatacccgtaccgaaggggaaccttaaacgtttaccaaacgggtaaaccgtaacccccttacttaacgttaccgtacggtaaccaaaacgtttacggaaaaacccgtttaaactttacgggaaagggttacgggtaaccgggtaaacgggttaaaccggtttaacccggggtttaaccggtttttaaacgtttaaccgggttacggttaccgggtaacccgttaacccgttacgggtaacggggtaacgggttacgggtaaccggttaaaggggtaaaaacggtttaccgggttaacgtttacccggttaaccgtttaacccggtttaccccgggttacccgggtaaccccggtttccggggttacccgggggtacccgggttaccggggtacccgttaacccccggtaccgggttacccgtaccccggtttaccccgttacccgttaccggtacccggttcccctttaacccccggaacccgggttaacccgggttacccccgttaaccggtttcccccgggtttacccccttccccccggggtccggttcccccggg

SEQ ID NO: 251643 - DNA, 901 bp, Homo sapiens
  misc_feature: GYAE6OF01BRQSL.25.28.C06.1.454.CMB.1.raw
tcagactgtacagtcacgaccggtgctcgatttagagctcacgtattgggtttgggctgaactgggttttcctcgttgctacttttaagaggtgtccagtgtcaggcgcatctggtggagtcgtgggggaggcgtggtccagccgtggggaacgtcccgtgagtacctcctccgtggtgtcgggccgtacctaagacctcctacctttcgaacggttagttatcggtcctttcggtcgttcgggtccgcctaggtcgtaccagggtcgaagggggtctagggacgttcggacggttaggggtaactttcgttgggcctaggaacctaagtaaccgtaaagtcgaactacttacgtaccggaacggtccgggtacggttaccgggtacggggtaacgggggtacccttaacttaccgaacccgttacgttacccggtaaccggaacggggtaaccctaaccggtttaccgaaacggtaaccgtaacccctacgttactcgtaacgtaactaaaggtaccgtaactaacgtaggtacgtaacggtacggaacggtacgttaccgggttacgtttaacgttacggtcgtacggtacctaaccgtacgtacgggtacgtacggtaacgtaaacgggtaaaacgtccggttaacgtcctacggtacccgttacccgtacggttacccggtccggtacgggtaccgtaacggtcccgtaaccggtcggtacccgtacccgttcgtacccttaccggtaccttacccgtacccgtaacccggtacccgggtcccttacgggtaccccggtttaccccgtacccgggttcccgtaccccggtcccgttcccggtacccggtaccggtaacgggaccgtaccggtcccgttggggtcccgggtaacccgg

SEQ ID NO: 251644 - DNA, 253 bp, Homo sapiens; identical to SEQ ID NO: 251341
  misc_feature: GYAE6OF02G55N5.25.28.C06.1.454.CMB.1.raw
  modified_base (252)..(253): a, c, t, g, unknown or other
  misc_feature (252)..(253): n is a, c, g, or t

SEQ ID NO: 251645 - DNA, 468 bp, Homo sapiens
  misc_feature: GYAE6OF02IQRXS.25.28.C06.1.454.CMB.1.raw
  modified_base (321)..(321): a, c, t, g, unknown or other
  misc_feature (321)..(321): n is a, c, g, or t
  modified_base (416)..(416): a, c, t, g, unknown or other
  misc_feature (416)..(416): n is a, c, g, or t
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccggcagtcagggcattggaaattattggcctggtatcagcagaaaccagggaaagttccaactcctcatctatgctgcatccatttgcaatttgggccctntcgattcagcgcagtggtctgggacagaattcactctcacatcagcagcctgcagcctgaagatgttgctaacttattactagtacaaaaatttnacagtgaccgtgatgttcggccaggacaaggtgacatacaaacgactgtcgg

SEQ ID NO: 251646 - DNA, 253 bp, Homo sapiens; identical to SEQ ID NO: 251341
  misc_feature: GYAE6OF02G3QA4.25.28.C06.1.454.CMB.1.raw
  modified_base (252)..(253): a, c, t, g, unknown or other
  misc_feature (252)..(253): n is a, c, g, or t

SEQ ID NO: 251647 - DNA, 220 bp, Homo sapiens
  misc_feature: GYAE6OF02HTE32.25.28.C06.1.454.CMB.1.raw
  modified_base (219)..(220): a, c, t, g, unknown or other
  misc_feature (219)..(220): n is a, c, g, or t
tcagactgtacagtcacgaccggtgctcgatttagagctcacgtattggggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnn

SEQ ID NO: 251648 - DNA, 255 bp, Homo sapiens
  misc_feature: GYAE6OF02IO6OP.25.28.C06.1.454.CMB.1.raw
  modified_base (252)..(255): a, c, t, g, unknown or other
  misc_feature (252)..(255): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgcatctgaactgtacagtctgagcgggctggcaaggcgcatagnnnn

SEQ ID NO: 251649 - DNA, 260 bp, Homo sapiens
  misc_feature: GYAE6OF02GINJT.25.28.C06.1.454.CMB.1.raw
  modified_base (257)..(260): a, c, t, g, unknown or other
  misc_feature (257)..(260): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctgggggcacagcggccctgggctgcctggtcaaggactacttccactgtacagtctgagcgggctggcaaggcgcatagnnnn

SEQ ID NO: 251650 - DNA, 260 bp, Homo sapiens
  misc_feature: GYAE6OF02F37W5.25.28.C06.1.454.CMB.1.raw
  modified_base (256)..(260): a, c, t, g, unknown or other
  misc_feature (256)..(260): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctggggcacagcggccctgggctgcctggtcaaggactacttccactgtacagtctgagcgggctggcaaggcgcatagnnnnn

SEQ ID NO: 251651 - DNA, 218 bp, Homo sapiens
  misc_feature: GYAE6OF02HYSHQ.25.28.C06.1.454.CMB.1.raw
  modified_base (214)..(218): a, c, t, g, unknown or other
  misc_feature (214)..(218): n is a, c, g, or t
tcagactgtacagtcacgaccggtgctcgatttagagctcacgtattgggtttgggaagaggaagactgacggtcctcccaggagttcaggtgctgggcaccttgggcacgggaggtgtgtcacaagatttggctctgggcacagcggccctgggctgcctggtcaaggactacttccactgtacagtctgagcgggctggcaaggcgcatagnnnnn

SEQ ID NO: 251652 - DNA, 254 bp, Homo sapiens
  misc_feature: GYAE6OF02G2BYX.25.28.C06.1.454.CMB.1.raw
  modified_base (252)..(254): a, c, t, g, unknown or other
  misc_feature (252)..(254): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttccgccatctgaactgtacagtctgagcgggctggcaaggcgcatagnnn

SEQ ID NO: 251653 - DNA, 268 bp, Homo sapiens
  misc_feature: GYAE6OF02JGU5M.25.28.C06.1.454.CMB.1.raw
  modified_base (258)..(268): a, c, t, g, unknown or other
  misc_feature (258)..(268): n is a, c, g, or t
tcagactgtacagtcacgaccggtgctcgatttagagctcacgtattgggtttgggggaagaggaagactgacggtcctccaggagttcaggtgctgggcaccctggtcaccgtctcctcagcttccaccaagggcccatcggtcttcccctggcgccctgcttccaggagcacctctgggggcacagcggccctgggctgcctggtcaaggactacttccgactgtacagtctgagcgggctggcaaggcgcatagnnnnnnnnnnn

SEQ ID NO: 251654 - DNA, 253 bp, Homo sapiens; identical to SEQ ID NO: 251341
  misc_feature: GYAE6OF02I0MVM.25.28.C06.1.454.CMB.1.raw
  modified_base (252)..(253): a, c, t, g, unknown or other
  misc_feature (252)..(253): n is a, c, g, or t

SEQ ID NO: 251655 - DNA, 313 bp, Homo sapiens
  misc_feature: GYAE6OF02HHCFQ.25.28.C06.1.454.CMB.1.raw
  modified_base (262)..(313): a, c, t, g, unknown or other
  misc_feature (262)..(313): n is a, c, g, or t
tcagactgtacagtcacgaccggtgctcgatttagagctcacgtattgggttgggggaaggaggaagactgacggtcctcccaggagttcaggtgctggcaccctggtcaccgtctcctcagcttccaccaagggcccatcggtcttcccctggcgccctgctccaggagcaccgtctgggggctacagcggccctgggctgcctggtcaaggactacttccactcgtacagtctgacgcgggctggccaaggcgcatagcnnnnnnnnnnnnnnnnnnnnnnnnnnnnnnnnnnnnnnnnnnnnnnnnnnnn

SEQ ID NO: 251656 - DNA, 485 bp, Homo sapiens
  misc_feature: GYAE6OF02IV8YK.25.28.C06.1.454.CMB.1.raw
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccggcgagtcagggcattggaaattatttggcctggtatcagcagaaaccagggaaagttcctaactcctcatctatgctgcatccactttgcaatttggggtcccgtctcgattcagcggcagtggtctgggacagaattcactctcaccatcagcagcctgcagcctgaagatgttgctaacttattactgtactaaaatttgaacagtgaccgtggatgttcggcccagggaccaaggtcggacagtacaaacgactgtacgg

SEQ ID NO: 251657 - DNA, 220 bp, Homo sapiens; identical to SEQ ID NO: 251355
  misc_feature: GYAE6OF02IUGFW.25.28.C06.1.454.CMB.1.raw
  modified_base (218)..(220): a, c, t, g, unknown or other
  misc_feature (218)..(220): n is a, c, g, or t

SEQ ID NO: 251658 - DNA, 272 bp, Homo sapiens
  misc_feature: GYAE6OF02GIB7M.25.28.C06.1.454.CMB.1.raw
  modified_base (201)..(201): a, c, t, g, unknown or other
  misc_feature (201)..(201): n is a, c, g, or t
  modified_base (253)..(255): a, c, t, g, unknown or other
  misc_feature (253)..(255): n is a, c, g, or t
  modified_base (257)..(272): a, c, t, g, unknown or other
  misc_feature (257)..(272): n is a, c, g, or t
tcagactgtacagtcacgaccggtgctcgatttagagctcacgtattggggtttgggacgagaattcactctcaccatcaggcagcctgcagcctgaagatgttgcaacttattactgtcaaaaatttgacagtgacccgtggatgttcggccagggaccaaggtggacatcaaacgactgtggctgcaccatctgtcttnatcttccgcatctgaactgtacagtctgagcggctggcaaggcgtcaatagnnnannnnnnnnnnnnnnnn

SEQ ID NO: 251659 - DNA, 276 bp, Homo sapiens
  misc_feature: GYAE6OF02F6GJ4.25.28.C06.1.454.CMB.1.raw
  modified_base (259)..(276): a, c, t, g, unknown or other
  misc_feature (259)..(276): n is a, c, g, or t
tcagactgtacagtcacgaccggtgctcgatttagagctcacgtattggggtttggggacgagaattcactctcaccatcagcagcctgcagcctgaagatgttcgcaacttattactgtcaaaaatttgacagtgacccgtggatgttcggcccagggaccaaggtggacatcaaacgactgtggctgtccacgatctgtcttcatcttcccgcatctgaactgtacagtctgagcgggctggcaaggcgcataggcnnnnnnnnnnnnnnnnnn

SEQ ID NO: 251660 - DNA, 255 bp, Homo sapiens; identical to SEQ ID NO: 251369
  misc_feature: GYAE6OF02GTABT.25.28.C06.1.454.CMB.1.raw
  modified_base (253)..(255): a, c, t, g, unknown or other
  misc_feature (253)..(255): n is a, c, g, or t

SEQ ID NO: 251661 - DNA, 277 bp, Homo sapiens
  misc_feature: GYAE6OF02GVVZB.25.28.C06.1.454.CMB.1.raw
  modified_base (257)..(277): a, c, t, g, unknown or other
  misc_feature (257)..(277): n is a, c, g, or t
tcagactgtacagtcacgaccggtgctcgatttagagctcacgtattgggtttgggggaagaggaagactgacggtcctcccaggagttcaggtgctgggcaccctggtcaccgtcctcctcagcttccaccaagggcccatcggtcttcccctggcgccctgctccaggagcacctctggggcacagcggccctgggctgcctggtcaaggactacttccactgtacagtctgagcgggctggcaaggcgcatagnnnnnnnnnnnnnnnnnnnnn

SEQ ID NO: 251662 - DNA, 256 bp, Homo sapiens
  misc_feature: GYAE6OF02GCE80.25.28.C06.1.454.CMB.1.raw
  modified_base (253)..(256): a, c, t, g, unknown or other
  misc_feature (253)..(256): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgccatctgaactgtacagtctgagcgggctggcaaggcgcatagnnnn

SEQ ID NO: 251663 - DNA, 253 bp, Homo sapiens
  misc_feature: GYAE6OF02IIFUP.25.28.C06.1.454.CMB.1.raw
  modified_base (252)..(253): a, c, t, g, unknown or other
  misc_feature (252)..(253): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttccgccatctgaactgtacagtctgagcgggctggcaaggcgcatagnn

SEQ ID NO: 251664 - DNA, 320 bp, Homo sapiens
  misc_feature: GYAE6OF02J1855.25.28.C06.1.454.CMB.1.raw
  modified_base (174)..(174): a, c, t, g, unknown or other
  misc_feature (174)..(174): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (272)..(320): a, c, t, g, unknown or other
  misc_feature (272)..(320): n is a, c, g, or t
tcagactgtacagtcacgaccggtgctcgatttagagctcacgtattggggtttgggacagaattcactctaacaccatcagcagcctgcagctgaagatgttggcaacttattacgtgtcaaaatttgacagtcgaccgtggatgttcggcccagggacccaaaggttcgganatcaaacgacgtgtggctggccaccgatcgtgtcttcatcttcccggcatctgaactgtacagtctgagcgggctggccaagggcncataagcancgnnnnnnnnnnnnnnnnnnnnnnnnnnnnnnnnnnnnnnnnnnnnnnnnn

SEQ ID NO: 251665 - DNA, 517 bp, Homo sapiens
  misc_feature: GYAE6OF02I9NTX.25.28.C06.1.454.CMB.1.raw
  modified_base (292)..(292): a, c, t, g, unknown or other
  misc_feature (292)..(292): n is a, c, g, or t
  modified_base (333)..(333): a, c, t, g, unknown or other
  misc_feature (333)..(333): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctcccctggctcccagctatcagatgtggcatccagatgacccagtctccatcctccctgtctgcatctgttggagacagagtcaccatcacttgccgggcagtcagggcattggaaattattggcctggtatcagcagaaaccagggaattcctaacctcctnatctattctgcatcctactttgctaagtttcggggtccctntcgattcagtcgcagtgggtctgggactagaattcactctccacatcagcagcctgcagcctagaagtatgtagctaacttattactagtaactaaaatttgaactagtacgtaccgtggattcggttcggacccgaaggggtaccaaggttcggaactacgtacgaaacgacgttggtagtcg

SEQ ID NO: 251666 - DNA, 232 bp, Homo sapiens
  misc_feature: GYAE6OF02HFDY0.25.28.C06.1.454.CMB.1.raw
  modified_base (219)..(232): a, c, t, g, unknown or other
  misc_feature (219)..(232): n is a, c, g, or t
tcagactgtacagtcacgaccggtgctcgatttagagctcacgtattgggtttgggggaagaggaagactgacggtcctcccaggagttcaggtgctgggcaccttgggcacgggggacggtgtgtcacaagatttgggctctgggcacagcggccctgggctgcctggtcaaggactacttccactgtacagtctgagcggctggcaaggcgcatagnnnnnnnnnnnnnn

SEQ ID NO: 251667 - DNA, 295 bp, Homo sapiens
  misc_feature: GYAE6OF02IF9Q1.25.28.C06.1.454.CMB.1.raw
  modified_base (239)..(242): a, c, t, g, unknown or other
  misc_feature (239)..(242): n is a, c, g, or t
  modified_base (244)..(295): a, c, t, g, unknown or other
  misc_feature (244)..(295): n is a, c, g, or t
tcagactgtacagtcacgaccggtgctcgatttagagctcacgtattgggggtttgggggaagaggaagactggacgggtcctcccaggacgttcaggtggcctggggccaccttgggcaacgggggaggtgtggtcacgaacgatttgggctctggggctacgagccggccctgggctgcctggtcaaggactacttccgactgtacagtctgagcgggtctggcgaaggcgcatagnnnngnnnnnnnnnnnnnnnnnnnnnnnnnnnnnnnnnnnnnnnnnnnnnnnnnnnn

SEQ ID NO: 251668 - DNA, 339 bp, Homo sapiens
  misc_feature: GYAE6OF02GJX20.25.28.C06.1.454.CMB.1.raw
  modified_base (265)..(270): a, c, t, g, unknown or other
  misc_feature (265)..(270): n is a, c, g, or t
  modified_base (272)..(273): a, c, t, g, unknown or other
  misc_feature (272)..(273): n is a, c, g, or t
  modified_base (278)..(339): a, c, t, g, unknown or other
  misc_feature (278)..(339): n is a, c, g, or t
tcagactgtacagtcacgaccggtgctcgatttagagctcacgtattgggtttgggacagaaggttcactctcaccatcagcaggcctgcagcctggaagagtgttgcaacttattactgtcaaaatttgacagtggacccgtggatgttcgggccccagggccaagggtcggacatcaaacgaactgtggctgcaccatctgtcttcatcttcccgcatctgaactgtacagtctgagcgggctggctaagggcgtcattaggnnnnnncnncaccnnnnnnnnnnnnnnnnnnnnnnnnnnnnnnnnnnnnnnnnnnnnnnnnnnnnnnnnnnnnnn

SEQ ID NO: 251669 - DNA, 220 bp, Homo sapiens; identical to SEQ ID NO: 251355
  misc_feature: GYAE6OF02JB931.25.28.C06.1.454.CMB.1.raw
  modified_base (218)..(220): a, c, t, g, unknown or other
  misc_feature (218)..(220): n is a, c, g, or t

SEQ ID NO: 251670 - DNA, 253 bp, Homo sapiens
  misc_feature: GYAE6OF02G5TZW.25.28.C06.1.454.CMB.1.raw
  modified_base (253)..(253): a, c, t, g, unknown or other
  misc_feature (253)..(253): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctacaccatctgtcttcatcttcccgccatctgaactgtacagtctgagcgggctggcaaggcgcatagn

SEQ ID NO: 251671 - DNA, 220 bp, Homo sapiens
  misc_feature: GYAE6OF02H9WX2.25.28.C06.1.454.CMB.1.raw
  modified_base (218)..(220): a, c, t, g, unknown or other
  misc_feature (218)..(220): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcggctggcaaggcgcatagnnn

SEQ ID NO: 251672 - DNA, 254 bp, Homo sapiens; identical to SEQ ID NO: 251477
  misc_feature: GYAE6OF02FME4Z.25.28.C06.1.454.CMB.1.raw
  modified_base (253)..(254): a, c, t, g, unknown or other
  misc_feature (253)..(254): n is a, c, g, or t

SEQ ID NO: 251673 - DNA, 749 bp, Homo sapiens
  misc_feature: GYAE6OF02IQHN1.25.28.C06.1.454.CMB.1.raw
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
tcagactgtacagtcacgaccggtgctcgatttagagctcacgtattgggtttggggccaacgaagtctcctctcagtcaggaccaccagcatggacatgagggtccctgctcagctcctgggacctcctgctgctctggctccagctatcagatgtgcactccagatcgacccgagtctccatcctcctgtctgctatcgtgtggagaccagacgtccaccatccagttgccgggcagtcgagggcattggaaacttnttggtcctggtatcagcagaaaccgnggaaacttcctaacctctacatctagtgcgtcgctactcctactttcgactaacgtttcgggtcccctatacgtatttcgaggtaccgttaccgaagggttcggtaccttggggaacctaaggtaacgtttcgaaccgttcgtacctaaccgtacgttacacgtacgtacgtccgttagaccgtaacgtccgttaacgaacgtacgttacggtttaccgtaaccgttaaaccgtttaacgttttaaccgtttaccggtttaaaaccgttaaaaacgtttttacgggaaacccgttaaacggggttacccgttaaccccgggtttagggttaaccggttttcccgggtttacccgggtaccccgtaaacggggttaaaaccccgttaaccggggtaaccggtaaacccggtaaccgtttaaacccggtaaaacccgggttacccggttacccgggtttaaccggg

SEQ ID NO: 251674 - DNA, 505 bp, Homo sapiens
  misc_feature: GYAE6OF02GDQJY.25.28.C06.1.454.CMB.1.raw
  modified_base (331)..(331): a, c, t, g, unknown or other
  misc_feature (331)..(331): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggcctggtatcagcagaaaccagggaaagttcctaacctcctcatctaatgctgcatccactttgcaatttggggtccctntcgattcagcgcagtggtctgggacagaatcactctcaccatcagcagcctgcagcctgaagatgttgactaactttattacttgttacaaaatttgaactagtacgacccgtggagttggttaccggcccgaagggaccaagggttcgacagtacgaaacgtacgtagtacgg

SEQ ID NO: 251675 - DNA, 254 bp, Homo sapiens; identical to SEQ ID NO: 251477
  misc_feature: GYAE6OF02F1GIY.25.28.C06.1.454.CMB.1.raw
  modified_base (253)..(254): a, c, t, g, unknown or other
  misc_feature (253)..(254): n is a, c, g, or t

SEQ ID NO: 251676 - DNA, 497 bp, Homo sapiens
  misc_feature: GYAE6OF02FW5D8.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggcctggtatcagcagaaaccagggaaagttcctaacctcctcatctatgctgcatccactttgctaatttggggtccctctcgattcagcggcagtgggtctgggacagaattcactctcaccatcagcagcctgcagcctgaagatgttgacaacttattactgttacaaaatttgaactagtagacccgtggagtggttaccggcccgaagggaccaaggtcggacatacaaacgactgtacgg

SEQ ID NO: 251677 - DNA, 254 bp, Homo sapiens; identical to SEQ ID NO: 251477
  misc_feature: GYAE6OF02GZX0I.25.28.C06.1.454.CMB.1.raw
  modified_base (253)..(254): a, c, t, g, unknown or other
  misc_feature (253)..(254): n is a, c, g, or t

SEQ ID NO: 251678 - DNA, 243 bp, Homo sapiens
  misc_feature: GYAE6OF02IWD01.25.28.C06.1.454.CMB.1.raw
  modified_base (214)..(214): a, c, t, g, unknown or other
  misc_feature (214)..(214): n is a, c, g, or t
  modified_base (220)..(243): a, c, t, g, unknown or other
  misc_feature (220)..(243): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcncatagnnnnnnnnnnnnnnnnnnnnnnnn

SEQ ID NO: 251679 - DNA, 254 bp, Homo sapiens
  misc_feature: GYAE6OF02GJNXU.25.28.C06.1.454.CMB.1.raw
  modified_base (252)..(254): a, c, t, g, unknown or other
  misc_feature (252)..(254): n is a, c, g, or t
tcagactgtacagtcacgaccggtgctcgatttagagctcacgtattgggtttgggacagaattcactctcaccatcagcagcctgcagcctgatgattttgcaacttattactgccaacaatataataattattcgaccacttttggccagggaccaaggtggagatcaaacgaactgtggctgcaccatctgtcttcatcttcccgccatctgaactgtacagtctgagcgggctggcaaggcgcatagnnn

SEQ ID NO: 251680 - DNA, 539 bp, Homo sapiens
  misc_feature: GYAE6OF02JAZVQ.25.28.C06.1.454.CMB.1.raw
tcagactgtacagtcacgaccggtgctcgatttagagctcacgtattgggtttgggggaagaggaagactgacggtcctcccaggagttcaggtgctgggcaccttgagcactgaacgcagcggactcaccatggagtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaaggggctgggagtggctgggagttacttggtctgacagacaaatgacatatcacgcggagtccgtgaggggccattcaccatctccagggacaattccaagacgaaccctctatctgacaaatgaacaacttgagagtcgaggatacggcgtttattactgtgcgacctcaggagtggacgtaggaaaagtcgtagtctctacttcccgtcgtacctcgtcggg

SEQ ID NO: 251681 - DNA, 261 bp, Homo sapiens
  misc_feature: GYAE6OF02GXWE2.25.28.C06.1.454.CMB.1.raw
  modified_base (257)..(261): a, c, t, g, unknown or other
  misc_feature (257)..(261): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctgggggcacagcggccctgggctgcctggtcaaggactacttccactgtacagtctgagcgggctggcaaggcgcatagnnnnn

SEQ ID NO: 251682 - DNA, 513 bp, Homo sapiens
  misc_feature: GYAE6OF02IF4HL.25.28.C06.1.454.CMB.1.raw
  modified_base (226)..(226): a, c, t, g, unknown or other
  misc_feature (226)..(226): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggnagtcagggcattggaaattatttggcctggtatcagcagaaaaccagggaaattcctaacctctcatctatgctgcatccatttgctaaagtttggggtccctctcgattcagcggcagtggtctgggacagaattcatctcacatcagcagcctcgcagccagagatagttgactaacttattaactacgtactaaaacttaagtaatagtagtaccgtacggtagtacgttacggtccgaacggaccgaacggtacggtacgattacgaacgaacgtacgtacgg

SEQ ID NO: 251683 - DNA, 220 bp, Homo sapiens; identical to SEQ ID NO: 251490
  misc_feature: GYAE6OF02GR8H9.25.28.C06.1.454.CMB.1.raw
  modified_base (219)..(220): a, c, t, g, unknown or other
  misc_feature (219)..(220): n is a, c, g, or t

SEQ ID NO: 251684 - DNA, 538 bp, Homo sapiens
  misc_feature: GYAE6OF02GTRVK.25.28.C06.1.454.CMB.1.raw
tcagactgtacagtcacgaccggtgctcgatttagagctcacgtattgggtttgggggaagaggaagactgacggtcctcccaggagttcaggtgctgggcaccttgagcactgaacgcagcggactcaccatggagtttgggctgaactgggttttcctcgttgctcttttaagaggtgtccagtgtcaggcgcatctggtggagtctgggggagcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccggtgaggggccgattcaccatctccagggacaattccaagacgaaccctctatctgacaaatgaacaacttgagagtcgagatacggtccgtttattactgtgcgacctcgaggagtggactaggaaagtcgtagtctctattcccgtcgtacctcgtcggg

SEQ ID NO: 251685 - DNA, 561 bp, Homo sapiens
  misc_feature: GYAE6OF02I0OCS.25.28.C06.1.454.CMB.1.raw
  modified_base (433)..(433): a, c, t, g, unknown or other
  misc_feature (433)..(433): n is a, c, g, or t
tcagactgtacagtcacgaccggtgctcgatttagagctcacgtattgggtttgggggaagaggaagactgacggtcctcccaggagttcaggtgctgggcaccttgggcacggggaggtgtgtcacaagatttgggctctgggcaccgtggagtctggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccattcaccatctccagggacaattccaaagagaaccctctatctgcaaaatgaaacaacttgagagtcgaggatacggccgtttattactgtgcgacctnaggagtggataggaaaagtcgtaagtctacattcccgtcgacctcgtgggccaggccacctggtcaccggtctccgtcacgtccttccaccgaacgggcccagtaccggtccttaccccgtggtcccg

SEQ ID NO: 251686 - DNA, 261 bp, Homo sapiens; identical to SEQ ID NO: 251681
  misc_feature: GYAE6OF02HR3WW.25.28.C06.1.454.CMB.1.raw
  modified_base (257)..(261): a, c, t, g, unknown or other
  misc_feature (257)..(261): n is a, c, g, or t

SEQ ID NO: 251687 - DNA, 220 bp, Homo sapiens; identical to SEQ ID NO: 251355
  misc_feature: GYAE6OF02FNHAQ.25.28.C06.1.454.CMB.1.raw
  modified_base (218)..(220): a, c, t, g, unknown or other
  misc_feature (218)..(220): n is a, c, g, or t

SEQ ID NO: 251688 - DNA, 356 bp, Homo sapiens
  misc_feature: GYAE6OF02ILS2L.25.28.C06.1.454.CMB.1.raw
  modified_base (202)..(202): a, c, t, g, unknown or other
  misc_feature (202)..(202): n is a, c, g, or t
  modified_base (258)..(260): a, c, t, g, unknown or other
  misc_feature (258)..(260): n is a, c, g, or t
  modified_base (262)..(262): a, c, t, g, unknown or other
  misc_feature (262)..(262): n is a, c, g, or t
  modified_base (265)..(266): a, c, t, g, unknown or other
  misc_feature (265)..(266): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (280)..(288): a, c, t, g, unknown or other
  misc_feature (280)..(288): n is a, c, g, or t
  modified_base (290)..(356): a, c, t, g, unknown or other
  misc_feature (290)..(356): n is a, c, g, or t
tcagactgtacagtcacgaccggtgctcgatttagagctcacgtattgggtttgggacagaagttcactctcaccatcagcagcctgcagcctgaagatgttgcaacttattactgtcaaaaatttgacagtgacccgtggatgttcggcccaggggaccaaggtggacatcaaacgaactgtggctgcaccatctgtcttnatcttccgcatctgaactgtacagtctgagcgggctggcaaggcgcaattacgatnnngnagnntcnganagcatcgnnnnnnnnncnnnnnnnnnnnnnnnnnnnnnnnnnnnnnnnnnnnnnnnnnnnnnnnnnnnnnnnnnnnnnnnnnnn

SEQ ID NO: 251689 - DNA, 261 bp, Homo sapiens
  misc_feature: GYAE6OF02GXMQW.25.28.C06.1.454.CMB.1.raw
  modified_base (251)..(261): a, c, t, g, unknown or other
  misc_feature (251)..(261): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgactgtggctgcaccatctgtcttcatcttcccgcatctgaactgtacagtctgagcgggctggcaaggcgcatagnnnnnnnnnnn

SEQ ID NO: 251690 - DNA, 497 bp, Homo sapiens
  misc_feature: GYAE6OF02GXD2P.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggcctggtatcagcagaaaccagggaaagttcctaacctcctcatctatgctgcatccactttgctaattttggggtccctctcgattcagcggcaggtgggtctgggacagaattcactctcaccatcagcagcctgcagcctgaagatgttgactaactttattactagtactaaaatttgaactagtcgaccgtggatcgttacgaccgaggaccaaggtcgacatacgaaacgtacgtgtcgg

SEQ ID NO: 251691 - DNA, 522 bp, Homo sapiens
  misc_feature: GYAE6OF02GHDVS.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaatttattggcctggtatcagcagaaaccagggaaagttcctaacctcctcatctatgctgcatccactttgctaagttttcggggtccctctcgattcagcggcaggtgggtctgggacagaattcactctcaccatcagcagcctgcagcctgaagatgttgactaactttattactagacctaaacaataataataattacttacgaactacgttttaggacccgtaaggggaaccctaagggtacggaagtaacgtacgaaacgtacgtggtacgg

SEQ ID NO: 251692 - DNA, 253 bp, Homo sapiens; identical to SEQ ID NO: 251332
  misc_feature: GYAE6OF02IGE00.25.28.C06.1.454.CMB.1.raw
  modified_base (253)..(253): a, c, t, g, unknown or other
  misc_feature (253)..(253): n is a, c, g, or t

SEQ ID NO: 251693 - DNA, 528 bp, Homo sapiens
  misc_feature: GYAE6OF02G8271.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggcctggtatcagcaagaaaccagggaaagttcctaacctcctcatctatgctgcatccactttgctaagttttcggggtccctctcgattcagtcgcaggtggtctgggacagatcactctcaccatcagcagcctgcagcctgagatgtgactaacttattactagttactaaaatttgaactagtacgaccgttggtacgttcggttccggacccggtaacgggtacccgtaagggtacggtaacgacgttaccgaaacggtacgtaggtacggg

SEQ ID NO: 251694 - DNA, 263 bp, Homo sapiens
  misc_feature: GYAE6OF02GTPAE.25.28.C06.1.454.CMB.1.raw
  modified_base (257)..(263): a, c, t, g, unknown or other
  misc_feature (257)..(263): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctgggggcacagcggccctgggctgcctggtcaaggactacttccactgtacagtctgagcgggctggcaaggcgcatagnnnnnnn

SEQ ID NO: 251695 - DNA, 516 bp, Homo sapiens
  misc_feature: GYAE6OF02H3JMK.25.28.C06.1.454.CMB.1.raw
  modified_base (201)..(201): a, c, t, g, unknown or other
  misc_feature (201)..(201): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgganacagagtcaccatcacttgccgggcgagtcagggcatggaaattattggctggtatcagcagaaaccaggggaaagttcctaaacctcctcatctatgctgcatccactttgctaagttttggggtccctctcgatttcagcgcagtggtctgggacagaattcactctcacatcagcagcctgcagcctagaagatgttgactaacgttattactagttactaaaattgaactagtgacccgtggtacgtcggttccggaccctaacgggaccgtaaggtacggacaacgttaccgaaaacgtacgtagtacgg

SEQ ID NO: 251696 - DNA, 268 bp, Homo sapiens
  misc_feature: GYAE6OF02FOKYU.25.28.C06.1.454.CMB.1.raw
  modified_base (255)..(268): a, c, t, g, unknown or other
  misc_feature (255)..(268): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgccatctgaactgtacagtctgagcgggctggcaaggccgcatacgnnnnnnnnnnnnnn

SEQ ID NO: 251697 - DNA, 486 bp, Homo sapiens
  misc_feature: GYAE6OF02F2D21.25.28.C06.1.454.CMB.1.raw
  modified_base (226)..(226): a, c, t, g, unknown or other
  misc_feature (226)..(226): n is a, c, g, or t
  modified_base (345)..(345): a, c, t, g, unknown or other
  misc_feature (345)..(345): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggngagtcagggcattggaaatttatttggcctggtatcagcagaaaccagggaaagttcctaacctcctcaatctatgctgcatccactttgcaatttggggtccctctcgattcagcggnagtggtctgggacagatcactctcaccatcagcagcctgcagcctgaagatgttgacacttattactgtactaaaatttgaacagtgaccgtgtagtgttacggccaggaccaaggtacggacatacaacgtactgtacgg

SEQ ID NO: 251698 - DNA, 507 bp, Homo sapiens
  misc_feature: GYAE6OF02HP0WA.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcagtcagggcattggaaattatttggcctggtatcagcaagaaaccagggaaacgttcctaaacctcctcactctatgctgcatccatttgcaagttttcggggcccgtctcgattcagcggcaggtgggtctgggacagaacttcactctcaccatcagcagcctgcagcctgaagatgttgactaacttattactagtactaaaatttgactagtcgaccgtggtatcggttccggaccgagggaccaagggtacgacagtacgaaacgtagtagtacgg

SEQ ID NO: 251699 - DNA, 569 bp, Homo sapiens
  misc_feature: GYAE6OF02HE8FJ.25.28.C06.1.454.CMB.1.raw
  modified_base (374)..(374): a, c, t, g, unknown or other
  misc_feature (374)..(374): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggagttactggtctgacagacaaatgacatatcacgcggagtccgtgaggggccattcaccatctccagggacaattccaagacgaaccctntatctgacaaatgaacaacttgagagtcgaggatacggcgtttattactgtgcgacctcaggagtgactaggaaaagtcgtagtctacacttcccgtcgacctcgtcgggccacgggccaccgtcggtcctaccgtcctcctcacgtccttaccgaaccgaacggcccagttccggtccttcccccgtggtcccg

SEQ ID NO: 251700 - DNA, 222 bp, Homo sapiens; identical to SEQ ID NO: 251359
  misc_feature: GYAE6OF02IE2CA.25.28.C06.1.454.CMB.1.raw
  modified_base (219)..(222): a, c, t, g, unknown or other
  misc_feature (219)..(222): n is a, c, g, or t

SEQ ID NO: 251701 - DNA, 604 bp, Homo sapiens
  misc_feature: GYAE6OF02HSCK1.25.28.C06.1.454.CMB.1.raw
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaaggggctggagtggcgtggggagtttacttggtctgacagacaaatgacatatcacgcggagtccgtggaggggccgattcaccatcctcgaggacaatccaagacgaaccctctaatctagacaaatagaacaacttgaagagtacgagatacggtcgtttatactgtcgcgacctagaggagtggctaaggaaaagtcggtaagtctactacttcccgtacgtaccgtcgtcgggccgagggccaccgtcggtaccacccgtcctcctcgacgtcctaccaaccgacggccctacgtccggttcccgttccccgtcggcccgtccccgtcgtacctcccggacggaccgcccgaccgttccggtacggggaccg

SEQ ID NO: 251702 - DNA, 268 bp, Homo sapiens
  misc_feature: GYAE6OF02ICP3Z.25.28.C06.1.454.CMB.1.raw
  modified_base (257)..(268): a, c, t, g, unknown or other
  misc_feature (257)..(268): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttccccctggcgccctgctccaggagcacctctggggcacagcggccctgggctgcctggtcaaggactacttccactgtacagtctgagcgggctggcaaggcgcatagnnnnnnnnnnnn

SEQ ID NO: 251703 - DNA, 253 bp, Homo sapiens; identical to SEQ ID NO: 251332
  misc_feature: GYAE6OF02F8T8R.25.28.C06.1.454.CMB.1.raw
  modified_base (253)..(253): a, c, t, g, unknown or other
  misc_feature (253)..(253): n is a, c, g, or t

SEQ ID NO: 251704 - DNA, 229 bp, Homo sapiens
  misc_feature: GYAE6OF02FR0UK.25.28.C06.1.454.CMB.1.raw
  modified_base (220)..(229): a, c, t, g, unknown or other
  misc_feature (220)..(229): n is a, c, g, or t
tcagactgtacagtcacgaccggtgctcgatttagagctcacgtattgggtttgggggaagaaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnnnnnnnn

SEQ ID NO: 251705 - DNA, 220 bp, Homo sapiens; identical to SEQ ID NO: 251355
  misc_feature: GYAE6OF02FP3BL.25.28.C06.1.454.CMB.1.raw
  modified_base (218)..(220): a, c, t, g, unknown or other
  misc_feature (218)..(220): n is a, c, g, or t

SEQ ID NO: 251706 - DNA, 696 bp, Homo sapiens
  misc_feature: GYAE6OF02JNBID.25.28.C06.1.454.CMB.1.raw
  modified_base (229)..(229): a, c, t, g, unknown or other
  misc_feature (229)..(229): n is a, c, g, or t
  modified_base (414)..(414): a, c, t, g, unknown or other
  misc_feature (414)..(414): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccactccctccctgtctgcatctgttggagcagagtcaccatcacttcggccgggngagtcgagggctaagttaggtaaatttagctttttggggaccttggtaagtccaagggaacccagggaaaaaccctcgggaaaacgtttccctaacctaccttccaattcgtacttggcctagtccaatttccgaaccttttaggtccggaacttttggggtccccgtatttcggagtttccganacgggtcgagttgggggtactagggggtaactacgaagtttccaaccgtaccttcgaacccaagttccaacggcctaaggccctaggtacctaggaacccgtgtaaagggtacttcggtttaacgtactaaaccgtttagttaaccttaaagtttactaaaaaacttttggaacctacggtttaggaacccgtttgggtaacgttaccggttaccggggacccgtaaggggtacccgtaacggttacgggaaccgtaaagtaccgtaaacgggtacgtcggg

SEQ ID NO: 251707 - DNA, 257 bp, Homo sapiens
  misc_feature: GYAE6OF02JEZBP.25.28.C06.1.454.CMB.1.raw
  modified_base (253)..(257): a, c, t, g, unknown or other
  misc_feature (253)..(257): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggcccagggaccaaggtggacatcaaacgaactgtggctgcaccatctgtcttcatcttcccgcatctgaactgtacagtctgagcggctggcaaggcgcaatagnnnnn

SEQ ID NO: 251708 - DNA, 591 bp, Homo sapiens
  misc_feature: GYAE6OF02JXYKX.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccggcgagtcagggcattggaaattagttggcctggtatcagcaagaaaccgaggtaaacgttcctaacctcctacatctatgctgacactcctactttgctaagtttcggggtcccttcgtcgtatttcgagcggtctaggttcgggtctcgggacacggtaattcgactcgtacaccatcgagccagtcccgttgaccgacgtccgtagaagtacgttagttcgacttaacgtttacgttacgttacgttaactaaaagttttcgaaacgttacgttacgacccggttaggtacggttcggttaccggaccggtaacgggtaccgtaagggttacggaacgtacgtaaccgaaacgtacgtggttacgg

SEQ ID NO: 251709 - DNA, 504 bp, Homo sapiens
  misc_feature: GYAE6OF02HSP6J.25.28.C06.1.454.CMB.1.raw
  modified_base (226)..(226): a, c, t, g, unknown or other
  misc_feature (226)..(226): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggngagtcagggcattggaaattattggcctggtatcagcagaaaccagggtaaagttcctaaacctcctcatctatgctgcatccatttgctaatttcggggtcctctcgattcagcgcagtgggtctgggacagaattcactctcaccatcagcacgcctgacagcctagaagtatgttgactaacttattactagtactaaaatttgaactagtgaccgttggacgtggttccggaccgaggacgtacgaaggtcggaactagtacaacgtagtacgg

SEQ ID NO: 251710 - DNA, 543 bp, Homo sapiens
  misc_feature: GYAE6OF02GCYU8.25.28.C06.1.454.CMB.1.raw
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaagggggctgggagtggctggggagttacttggtctgacagacaaatgacatatcacgcggagtccgtgaggggccgattcaccatctccaggggacaattccaagagaaccctctatctgcaaatgaacaacttgagagtcgaggatacggccgtttatactgtgcgacctcaggagtggctggaaaaagtcgtagtctcattcctgtcgacctctggggccaggggcaccctggtcaccgtctcctcagcttccaccaagggcccatcggtcttccccctggccgccctgcctccaggagccacctctcggggg

SEQ ID NO: 251711 - DNA, 253 bp, Homo sapiens; identical to SEQ ID NO: 251338
  misc_feature: GYAE6OF02GBZFP.25.28.C06.1.454.CMB.1.raw
  modified_base (252)..(253): a, c, t, g, unknown or other
  misc_feature (252)..(253): n is a, c, g, or t

SEQ ID NO: 251712 - DNA, 512 bp, Homo sapiens
  misc_feature: GYAE6OF02HQVAE.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggcctggtatcagcagaaaccagggaaagttcctaaacctcctcatctatgctgcatccatttgctaattttggggtccctctcgattcagcggcagtgggtctgggacagtaattcactctcaccatcagcagcctggcacgcctgaagatgttagactaactttattactagttactaaaaatttgaactagtcgaccgtggtagtgttccggacccgagggaccgtaaggtcggactaagtacgaaacgtactgtacgg

SEQ ID NO: 251713 - DNA, 560 bp, Homo sapiens
  misc_feature: GYAE6OF02FY7WT.25.28.C06.1.454.CMB.1.raw
  modified_base (373)..(373): a, c, t, g, unknown or other
  misc_feature (373)..(373): n is a, c, g, or t
  modified_base (459)..(459): a, c, t, g, unknown or other
  misc_feature (459)..(459): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccattcaccatctccagggacaattccaagagaaccctntatctgcaaatgaacacttgagagtcgaggatacggccgtttattactgtgcgacctcaggagtggctaggaaaagtcgtagtctnacttcccgtcgacctctggggccagggcacccgtggtccaccgtctcctcacgccttcccgaccaacgggcccaagtccggtccttcccccgtggtccccg

SEQ ID NO: 251714 - DNA, 557 bp, Homo sapiens
  misc_feature: GYAE6OF02FGESC.25.28.C06.1.454.CMB.1.raw
tcagactgtacagtcacgaccggtgctcgatttagagctcacgtattgggtttgggggaagaggaagactgacggtcctcccaggagttcaggtgctgggcaccttgggcacggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggatccgtgaggggccgattcaccatctccagggacaattccaagagaaccctctaatctgcaaatgaacaacttgagagtcgagatacggccgtttattactgtgcgacctcaggagtggctaggaaaagtcgtagtctcattcccgtacgacctctggggccagggcacccgtggtccaccgtctccctcacgccttccaccgacgggcccagtccggtccttccccgtcggtcccg

SEQ ID NO: 251715 - DNA, 681 bp, Homo sapiens
  misc_feature: GYAE6OF02GXGWD.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacttggccgggcgagtcagggcattggaaattatttggcctggtatcagcagaaaccagggaaacgttccctaaacccctcctactactactagtcgtctcgactacctaccttacgttcgtaacgtttaacgggttttcccgggttacccgttcgttaccgttacttacggcggtacccgggtacgttagggttcgggttacgggtacgggaacgtaacgttaccttaccgtacgttacctaccacctaactaaccaacgtacccgtccgacggactaccgtacgtaaagacgttagtttggtactaacttaacgtttacgtttaacgttaacgttaaaactttaaacgttacgaacgttacggtacccggtacggtagttacgttccgggtacccggaaccggtaacgggaaccggtaagggtaccgtaactaccgtaaaccgaaccggtagttcggacgtaccg

SEQ ID NO: 251716 - DNA, 483 bp, Homo sapiens
  misc_feature: GYAE6OF02FJI9D.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattattggcctggtatcagcagaaaccaggaaagttcctaacctcctcatctatgctgcatccatttgctaatttggggtccctctcgattcagcggcagtcgggtctgggacagattcactctcaccatcagcagcctgcagcctgacgatgttgactaacttattactagttactaaaatttgacagtcgaccgtggagtgtcgccgaggaccgaaggtgacatacaacgatgtacgg

SEQ ID NO: 251717 - DNA, 265 bp, Homo sapiens
  misc_feature: GYAE6OF02HVOIR.25.28.C06.1.454.CMB.1.raw
  modified_base (258)..(265): a, c, t, g, unknown or other
  misc_feature (258)..(265): n is a, c, g, or t
tcagactgtacagtcacgaccggtgctcgatttagagctcacgtattgggtttgggacagaattcactctcaccatcagcagcctgcagcctgaagatgttgcaacttattactgtactaaaaatttgacagtgacccgtggatgttcggccagggaccaaggtggacatacaaacgactgtggctgcaccatctgtcttcatccttcccgccatctagaactgtacagtctgagcgggctggacaaggcgcagtagnnnnnnnn

SEQ ID NO: 251718 - DNA, 260 bp, Homo sapiens; identical to SEQ ID NO: 251649
  misc_feature: GYAE6OF02FS502.25.28.C06.1.454.CMB.1.raw
  modified_base (257)..(260): a, c, t, g, unknown or other
  misc_feature (257)..(260): n is a, c, g, or t

SEQ ID NO: 251719 - DNA, 222 bp, Homo sapiens; identical to SEQ ID NO: 251346
  misc_feature: GYAE6OF02HXBAW.25.28.C06.1.454.CMB.1.raw
  modified_base (219)..(222): a, c, t, g, unknown or other
  misc_feature (219)..(222): n is a, c, g, or t

SEQ ID NO: 251720 - DNA, 255 bp, Homo sapiens; identical to SEQ ID NO: 251369
  misc_feature: GYAE6OF02FJILG.25.28.C06.1.454.CMB.1.raw
  modified_base (253)..(255): a, c, t, g, unknown or other
  misc_feature (253)..(255): n is a, c, g, or t

SEQ ID NO: 251721 - DNA, 579 bp, Homo sapiens
  misc_feature: GYAE6OF02HLGE1.25.28.C06.1.454.CMB.1.raw
  modified_base (226)..(226): a, c, t, g, unknown or other
  misc_feature (226)..(226): n is a, c, g, or t
  modified_base (310)..(310): a, c, t, g, unknown or other
  misc_feature (310)..(310): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacacagtctccatcctccctgtctgcatctgttggagacagagtcaccatcacttgccgggnagtcagggcagttggaaattatttggcctggtatcagcaagaaacccagggaaacgttcccaacctcctacatctatgctgacntcctactttgactaagtttcgggtccctcgtcgtattcgagtcggctaggtcgggtcgtgggacagtaacttcactctacaccatcagtcacgtcctagctacgcctagaacgtagttcgttacgacttaactttaactttacgttacgttaaacttaaaacttcgaacttacggtacgtaacccggttaggtaacgttacggttaccggacccgtaagggtaacccgtaagggtccgaacgtaacgtaaccgtaacgtaccgtacggg

SEQ ID NO: 251722 - DNA, 262 bp, Homo sapiens
  misc_feature: GYAE6OF02H9KDL.25.28.C06.1.454.CMB.1.raw
  modified_base (258)..(262): a, c, t, g, unknown or other
  misc_feature (258)..(262): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttccccctggcgccctgctccaggagcacctctgggggcacagcggccctgggctgcctggtcaaggactacttccactgtacagtctgagcgggctggcaaggcgcatagnnnnn

SEQ ID NO: 251723 - DNA, 586 bp, Homo sapiens
  misc_feature: GYAE6OF02G7VU0.25.28.C06.1.454.CMB.1.raw
  modified_base (342)..(342): a, c, t, g, unknown or other
  misc_feature (342)..(342): n is a, c, g, or t
  modified_base (538)..(538): a, c, t, g, unknown or other
  misc_feature (538)..(538): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaaggggctgggagtggctggggagttacttgggtctggacagacaaatgacatatcacgcggagtccgtgaggggccgaattcacatctccagggacaattccaagagaaccctntactctgcaaatagaacaacttgagagtcgagatacgggcctttaatactgtagcgacctcaggagtgcgtaggaaaaagtcgtaagtctcacttccgtacgaccctcgtcggggaccaggggccacccgtggtccacccgtctccctcacgcttccaccaacgggccccagtccggtacctcccccgtggacccncccgttcgccttcccgagggtaccgcgacccttccggtcggggacccg

SEQ ID NO: 251724 - DNA, 496 bp, Homo sapiens
  misc_feature: GYAE6OF02JH3BZ.25.28.C06.1.454.CMB.1.raw
  modified_base (332)..(332): a, c, t, g, unknown or other
  misc_feature (332)..(332): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggccttggtatcagcagaaaccagggaaagttcctaacctcctcatctatgctgcatccactttgctaatttcggggccctntcgattcagcgcaggtggtctgggacagaattcactctcacatcagcagcctgcagcctgaagatgttgacaacttattactagtactaaaagttgactagtgaccgtggattggttccggcccaagggaccaaggtcggacataccgaaacgtactggtacgg

SEQ ID NO: 251725 - DNA, 560 bp, Homo sapiens
  misc_feature: GYAE6OF02GG0U9.25.28.C06.1.454.CMB.1.raw
  modified_base (251)..(251): a, c, t, g, unknown or other
  misc_feature (251)..(251): n is a, c, g, or t
  modified_base (372)..(372): a, c, t, g, unknown or other
  misc_feature (372)..(372): n is a, c, g, or t
  modified_base (437)..(437): a, c, t, g, unknown or other
  misc_feature (437)..(437): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccnccagtgtccaggcaaggggctggagtggctgggagttacttggtctgacagacaatgacatatcacgcggagtccgtgagggccattcaccatctccagggacaattccaagagaaccctntatctagacaaatcgaaacaacttgaagagtcgaggatacggtccgtttattactgtgcgacctnaggagtggactaggaaaagtcgtagtctcagttcccgtcgacctcgtcgggccacggcaccgtgtccaccgtctcctcacgcttaccaccgacggcccagtccggtccttccccgtggtcccg

SEQ ID NO: 251726 - DNA, 225 bp, Homo sapiens
  misc_feature: GYAE6OF02GNUKU.25.28.C06.1.454.CMB.1.raw
  modified_base (219)..(225): a, c, t, g, unknown or other
  misc_feature (219)..(225): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnnnnn

SEQ ID NO: 251727 - DNA, 587 bp, Homo sapiens
  misc_feature: GYAE6OF02H8B4X.25.28.C06.1.454.CMB.1.raw
  modified_base (405)..(405): a, c, t, g, unknown or other
  misc_feature (405)..(405): n is a, c, g, or t
  modified_base (428)..(428): a, c, t, g, unknown or other
  misc_feature (428)..(428): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctggggggaggcgtggtccagcctgggaagtccctgagactctcctgtgtggcgcctagactcaccttcagtagttatggcttcgtctgggtccgccagtgtccaggcaagggggctgggagtggctggggagtttacttgggtctgacagacaaaatgacatatcacgcggagtccgtgaggggccgattcaccatctccagggacaattccaagagaaccctctatctgcaaatgaacaacttgagagtcgaggatacggcctttatactgtgcgactcaggngtggctaggaaaagtgtagtctnattcccgtcgtacctcgtcgggccgagggccacccgttcggtccaccgtcctcctcacgtccttccaccgaacgggccccacgtccggttcccttcccccgtcggcccgccccttcgccctcccgacgggaccgccgacccgttccggtcggggacccg

SEQ ID NO: 251728 - DNA, 252 bp, Homo sapiens
  misc_feature: GYAE6OF02I43GF.25.28.C06.1.454.CMB.1.raw
  modified_base (252)..(252): a, c, t, g, unknown or other
  misc_feature (252)..(252): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgcatctgaactgtacagtctgagcgggctggcaaggcgcatagn

SEQ ID NO: 251729 - DNA, 659 bp, Homo sapiens
  misc_feature: GYAE6OF02JHSSE.25.28.C06.1.454.CMB.1.raw
  modified_base (531)..(531): a, c, t, g, unknown or other
  misc_feature (531)..(531): n is a, c, g, or t
  modified_base (641)..(641): a, c, t, g, unknown or other
  misc_feature (641)..(641): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagacgtcacctatccacgttgcccgggcgagtcgagggcagttaggaaatttagtttggccttggtaatccagacaaggaaaaccagggtaaaacgttccctaaaccctccttctaaacttcttaactcggtctcggtacctaacttccctaacttttcgaacgttaaacggtttttccgggggttccccctcgttacgtactttccgaagggtccggtacgtagggttcggggttccgttagggggaacctaaggtaaactttccaacttcccgtacaaccctagtaccagtccacgtcccgttgaccaacggtccgtagaaacgtnttgtacgtaaccttaactttacgttacctaggtttaaactaaaagttttcgaacgtaggtccgtaccggttgtaccgttcggtacgacccgaggtaacgaggtggactanaacgtaacgagtggtacg

SEQ ID NO: 251730 - DNA, 254 bp, Homo sapiens
  misc_feature: GYAE6OF02GDAOZ.25.28.C06.1.454.CMB.1.raw
  modified_base (252)..(254): a, c, t, g, unknown or other
  misc_feature (252)..(254): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgcatctgaactgtacagtctgagcgggctggcaaggcgcatagnnn

SEQ ID NO: 251731 - DNA, 253 bp, Homo sapiens; identical to SEQ ID NO: 251338
  misc_feature: GYAE6OF02I5U9C.25.28.C06.1.454.CMB.1.raw
  modified_base (252)..(253): a, c, t, g, unknown or other
  misc_feature (252)..(253): n is a, c, g, or t

SEQ ID NO: 251732 - DNA, 255 bp, Homo sapiens
  misc_feature: GYAE6OF02F5ZKI.25.28.C06.1.454.CMB.1.raw
  modified_base (252)..(255): a, c, t, g, unknown or other
  misc_feature (252)..(255): n is a, c, g, or t
tcagactgtacagtcacgaccggtgctcgatttagagctcacgtattgggtttgggacagaattcactctcaccatcagcagcctgcagcctgaagatgttgcaacttattactgtcaaaatttgacagtgacccgtggatgttcggcccagggaccaaggtggacatcaaacgaactgtggctgcaccatctgtcttcatcttcccgccatctgaactgtacagtctgagcgggctggcaaggcgcatagnnnn

SEQ ID NO: 251733 - DNA, 825 bp, Homo sapiens
  misc_feature: GYAE6OF02JQ0MN.25.28.C06.1.454.CMB.1.raw
  modified_base (164)..(164): a, c, t, g, unknown or other
  misc_feature (164)..(164): n is a, c, g, or t
  modified_base (166)..(166): a, c, t, g, unknown or other
  misc_feature (166)..(166): n is a, c, g, or t
  modified_base (186)..(186): a, c, t, g, unknown or other
  misc_feature (186)..(186): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtggagtcggtgggngngtcgcacgcgaggactccgngagtctctctgtgtcggcctactagactcctaccttcgagttagttagtcgtcttcgtcggtcggccacgtgttcgacgacggacggacgggtcgtaggtaggtcggtcggtagggttaacgtttacggttcggtcgtacgacgaacgaactaaagtacgaactaagtactacgaccggacggtacggttccggtaggggaccgggaccgttacgttaccgaccgtacttcccgtacggaacgggtaaccttaacgttaaccgaaacggtaaccgtaacccttacttaacgttcgtacgtaaacgtaaactaaccgtaaaaccttacgttacggaagtacggtacgggaacggtacggtaaccggttacgttttaacttacgttcgtcgtaccgtaaccgacggtaaggtacggtacgtacggtaaaacggtaaaacgtttcggtaacttaccgttaccgttaccgttaccccggtaccgtcccgttacgggttaccgggaccggtaccggtacccgtaccgggttaccgtaccgtacccgttcccgtaccgtacgtaccgttccccgtaccgtaaacccggtacccggtacccgttacccgttccccggtttccccgttccccggtaccggtaccccg

SEQ ID NO: 251734 - DNA, 508 bp, Homo sapiens
  misc_feature: GYAE6OF02GH3W7.25.28.C06.1.454.CMB.1.raw
  modified_base (226)..(226): a, c, t, g, unknown or other
  misc_feature (226)..(226): n is a, c, g, or t
  modified_base (407)..(407): a, c, t, g, unknown or other
  misc_feature (407)..(407): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggngagtcagggcattggaaattattggcctggtatcagcagaaaccagggaaattcctaacctcctcatctatgctgcatccactttgctaagttttcggggtcccttctcgattcagcggcaggtgggtctgggacagtaattcactctcaccatcagcagcctgcagcctgaagtatgttnactaatttattactgtactaaaatttgaactagtcgaccgtggacgttggttaccggaccgaggaccgtaaggtacggacagtacgaaacgtactgtacgg

SEQ ID NO: 251735 - DNA, 253 bp, Homo sapiens; identical to SEQ ID NO: 251332
  misc_feature: GYAE6OF02G538E.25.28.C06.1.454.CMB.1.raw
  modified_base (253)..(253): a, c, t, g, unknown or other
  misc_feature (253)..(253): n is a, c, g, or t

SEQ ID NO: 251736 - DNA, 250 bp, Homo sapiens
  misc_feature: GYAE6OF02IX8SR.25.28.C06.1.454.CMB.1.raw
  modified_base (250)..(250): a, c, t, g, unknown or other
  misc_feature (250)..(250): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgtcggcccagggaccaaggtgacatcaaacgaactgtggctgcaccatctgtcttcatcttcccgcatctgaactgtacagtctgagcggctggcaaggcgcatagn

SEQ ID NO: 251737 - DNA, 550 bp, Homo sapiens
  misc_feature: GYAE6OF02GI1QJ.25.28.C06.1.454.CMB.1.raw
  modified_base (458)..(458): a, c, t, g, unknown or other
  misc_feature (458)..(458): n is a, c, g, or t
tcagactgtacagtcacgaccggtgctcgatttagagctcacgtattgggtttgggggaagaggaagactgacggtcctcccaggagttcaggtgctgggcaccttgggcacggggaggtgtgtcacaagatttgggctctgggcaccgtggagtctggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccgattcaccatctccagagacaattcccggaacattgtgtacttggaaatggtcagcctgagagtcgaggactcggctctgtattactgtgcgagatcgggagtggtagtagttagttacgggcncatgacgtggggccagggaccctggtcaccgtctccgtcgacgcctccgaccgaacggcccagtccggtccttcccccgtggccgccctcgg

SEQ ID NO: 251738 - DNA, 556 bp, Homo sapiens
  misc_feature: GYAE6OF02I90Q5.25.28.C06.1.454.CMB.1.raw
  modified_base (334)..(334): a, c, t, g, unknown or other
  misc_feature (334)..(334): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcgagggcattggaaattatttggcctggtatcagcagaaaccagggaaattcctaacctctcatctatgctgctatccactttgactaagtttcgggtcccgtntcgattcagcgcgaggtcgggtcgtgggacaggtacgttcacttcgtctaactatcacgcagcctgcacgcctagagagttgttgacctaactttattacttgtaactaaagtaattaaacgtactcgtccccttcttaccgtacgtttccgggacgggtaacggggtaacccgtaaagggttcggaacggtaacgtaccgtaaaccggtaacgtggtacgg

SEQ ID NO: 251739 - DNA, 261 bp, Homo sapiens
  misc_feature: GYAE6OF02H3OZQ.25.28.C06.1.454.CMB.1.raw
  modified_base (258)..(261): a, c, t, g, unknown or other
  misc_feature (258)..(261): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttccccctggcgccctgctccaggagcacctctgggggcacagcggccctgggctgcctggtcaaggactacttccactgtacagtctgagcgggctggcaaggcgcatagnnnn

SEQ ID NO: 251740 - DNA, 260 bp, Homo sapiens; identical to SEQ ID NO: 251649
  misc_feature: GYAE6OF02FK6QR.25.28.C06.1.454.CMB.1.raw
  modified_base (257)..(260): a, c, t, g, unknown or other
  misc_feature (257)..(260): n is a, c, g, or t

SEQ ID NO: 251741 - DNA, 556 bp, Homo sapiens
  misc_feature: GYAE6OF02HJI7A.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcagttggaaattatttggcctggtatcagcaagaaaccgagggaaacgttcctaacctcctcatctatgctgcatccactttgctaagtttcggggtccctcgtcgtattcgagcggtcaggtgggtcgtgggactagaattcactctcaccatcagcacgcctgcacgccgtagaagtattgttcgtactaactttattaacgtgtaaacttaaaatttcgaactagtacgtacccggttaggtacgttcggttaccggacccgtaacgggacctaagggtcggtaacctacgtaacgaaaccggtacgttaggtacggg

SEQ ID NO: 251742 - DNA, 516 bp, Homo sapiens
  misc_feature: GYAE6OF02JBU3O.25.28.C06.1.454.CMB.1.raw
  modified_base (225)..(225): a, c, t, g, unknown or other
  misc_feature (225)..(225): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacttgccgggngagtcagggcattggaaattatttggcctggtatcagcagaaaccagggaagttcctaacctcctcatctatgctgcatccactttgctaagttttcggggtccctctcgattcgagcgcaggtgggtctgggacagtaattcactctcaccatcagcagcctgcacgcctgaagatgttgactaacttattactagttactaaaattgtaactagtcgaccgtgtacgttcggttccggaccgtagggaccgtaaggtacggacgtagtaccgaaacgtacgtagtacgg

SEQ ID NO: 251743 - DNA, 560 bp, Homo sapiens
  misc_feature: GYAE6OF02F41LQ.25.28.C06.1.454.CMB.1.raw
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtgacgcctagactcaccttcagtagttatggcttcgtctgggtccgccagtgtccaggcaagggggctggagtggctggggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctaggaaaagtcgtagtctcattcccgtcgacctctcggggccagggccacccgtggtccaccgtctcctcagcctccaccaacggcccatccggtccttcccccgtggccgtcccctcgcctccgacgggacgcctacccgtcgtggggccc

SEQ ID NO: 251744 - DNA, 266 bp, Homo sapiens
  misc_feature: GYAE6OF02J2SKO.25.28.C06.1.454.CMB.1.raw
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
  modified_base (247)..(248): a, c, t, g, unknown or other
  misc_feature (247)..(248): n is a, c, g, or t
  modified_base (250)..(250): a, c, t, g, unknown or other
  misc_feature (250)..(250): n is a, c, g, or t
  modified_base (252)..(266): a, c, t, g, unknown or other
  misc_feature (252)..(266): n is a, c, g, or t
tcagactgtacagtcacgaccggtgctcgatttagagctcacgtattgggtttgggacagaattcactctcaccatcagcagcctgcagcctgaagatgttgcaacttatactgtcaaaatttgacagtgaccgtggatgttcggcccagggaccaaggtggacatcaaacgactgtggctgcacatctgtcttcattctccgcatctgaactgtacngtctgacgcgggctggcaaggcncatagnngnannnnnnnnnnnnnnn

SEQ ID NO: 251745 - DNA, 260 bp, Homo sapiens; identical to SEQ ID NO: 251649
  misc_feature: GYAE6OF02I97TF.25.28.C06.1.454.CMB.1.raw
  modified_base (257)..(260): a, c, t, g, unknown or other
  misc_feature (257)..(260): n is a, c, g, or t

SEQ ID NO: 251746 - DNA, 227 bp, Homo sapiens
  misc_feature: GYAE6OF02GLKFG.25.28.C06.1.454.CMB.1.raw
  modified_base (218)..(227): a, c, t, g, unknown or other
  misc_feature (218)..(227): n is a, c, g, or t
tcagactgtacagtcacgaccggtgctcgatttagagctcacgtattgggtttgggggaagaggaagactgacggtcctccaggagttcaggtgctgggcaccttgggcacgggggaggtgtgtcacaagatttgggctctgggtacagcggccctgggctgcctggtcaaggactacttccactgtacagtctgagcgggctggcaaggcgcatagnnnnnnnnnn

SEQ ID NO: 251747 - DNA, 750 bp, Homo sapiens
  misc_feature: GYAE6OF02HTA4F.25.28.C06.1.454.CMB.1.raw
  modified_base (236)..(236): a, c, t, g, unknown or other
  misc_feature (236)..(236): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccactccctccctgtctgctattctggttggagacagagtccaccatcacgttggccgggngagtccgagggctagttaggtaaatttagttcggaccttggtatcagacaagaaaccgtagggtaaacgttacctaacccttcctactatctatgctgcactcctactttcacgttacgtttcggggtcccttacgtcgtacttcgacggtcggtactagggttcgggtacgtaggggaacctaaggttaactttccgtaccttaccgtaccctaaccgtactaccgacgtaccgtacgtcccgttacgaccgtacgtacccgttaaggtaaacgtacgttggtttaaccgtaacctttaaaccgttttaacgtttaaaccgttaacggtttaaaacttaaaaacgttttcggaaaacgttaccggttaaccggacccgggtttaggttaaccggtttaccggggttaaccccgggaacccgggtaaccggggttaaacccgtaaggggttaaccgggaaaccttaacggttaaaacccgggtaaaacggttacccggttagggttaacccggg

SEQ ID NO: 251748 - DNA, 493 bp, Homo sapiens
  misc_feature: GYAE6OF02JHV1R.25.28.C06.1.454.CMB.1.raw
  modified_base (267)..(267): a, c, t, g, unknown or other
  misc_feature (267)..(267): n is a, c, g, or t
  modified_base (387)..(387): a, c, t, g, unknown or other
  misc_feature (387)..(387): n is a, c, g, or t
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccggcagtcaggcattggaaattattggcctggtatcagcagaaaccngggaattccaactctacatctatgctgcatccatttgctaagtttcggggtccctctcgattcgagcgctagtggtcctgggacagtaattcactctcaccatcagcagcctgcagtccngaacgattgtagactaacgttattactagtacctaaaatttgaactagtcgaccgtgagtcgttacggccgtaggacctaggtcgacatacgaacgtactagtcgg

SEQ ID NO: 251749 - DNA, 488 bp, Homo sapiens
  misc_feature: GYAE6OF02F7IVF.25.28.C06.1.454.CMB.1.raw
  modified_base (327)..(327): a, c, t, g, unknown or other
  misc_feature (327)..(327): n is a, c, g, or t
  modified_base (369)..(369): a, c, t, g, unknown or other
  misc_feature (369)..(369): n is a, c, g, or t
  modified_base (394)..(394): a, c, t, g, unknown or other
  misc_feature (394)..(394): n is a, c, g, or t
  modified_base (416)..(416): a, c, t, g, unknown or other
  misc_feature (416)..(416): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacttgccgggcgagtcagggcattggaaattatttggcctggtatcagcagaaaccagggaaattcctaacctcctcatctatgctgcatccatttgctaatttggggccctntcgattcagcggcaggtgggtctgggacagaattcactctcncatcagcagcctgcacgcctagaanattgttgactaacttattactntactaaaatttgacagtcgaccgtggatcgttcggcccgaggaccaaggtgacatacgaacgtactgtacgg

SEQ ID NO: 251750 - DNA, 510 bp, Homo sapiens
  misc_feature: GYAE6OF02GI32M.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggcctggtatcagcagaaaccagggaaagttcctaacctcctcatctatgctgcatccactttgctaatttggggtccctctcgattcagcggcagtgggtctgggacagaattcactctcaccatcagcagcctgcagcctgaagatgttgactaactttattactagttactaaaatttgaactagtcgaccgtggtaacgtggttaccggcccgtaagggaccaagggtcggacagtacgaaacgtacgtggtacgg

SEQ ID NO: 251751 - DNA, 552 bp, Homo sapiens
  misc_feature: GYAE6OF02JIDSE.25.28.C06.1.454.CMB.1.raw
  modified_base (226)..(226): a, c, t, g, unknown or other
  misc_feature (226)..(226): n is a, c, g, or t
  modified_base (340)..(340): a, c, t, g, unknown or other
  misc_feature (340)..(340): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggnagtcagggcagttggaaattattggccttggtatcagcaagaaaccgagggtaaacttcctaaacctcctacatctatgctgctatccactttgactaagtttcggggtccctntcgatttcgagtcggctaggtgggtctagggacagtaacttacacttcctacacctatcagccagcctgcagtccgtagaagtattgttcgactaacttattacttagtaactaaaattcgaactagtacgtaccgttgtacgttcggtaccgtaccggaacgggtaccgtaaggcggtaaccgtaagtaccgaaacggtacgtaggtacgg

SEQ ID NO: 251752 - DNA, 221 bp, Homo sapiens; identical to SEQ ID NO: 251337
  misc_feature: GYAE6OF02HGV8M.25.28.C06.1.454.CMB.1.raw
  modified_base (219)..(221): a, c, t, g, unknown or other
  misc_feature (219)..(221): n is a, c, g, or t

SEQ ID NO: 251753 - DNA, 589 bp, Homo sapiens
  misc_feature: GYAE6OF02IFKOC.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttggccgggcgagtcgagggcattggaaattattggcctggtatcagcaagaaaccagggtaaacgttcctaacctcctacatctatgctgcactcctactttgacttaagtttcggggtccccttctacgtattcaggtcggcgtaggtcgggtctaggggactagtaattcactctacacctatcagcacgcctgcacgctagagtattgtcgactaactttacttaacttacgttaaactaaaaagtttcgaacgtacgttacggtacccggttaggtacgttcggttaccggacccggtaacggggtaacccgtaaaggggtcggtaaccgtaacgtaacccgtaaaaccggtaccgtaggtaccggg

SEQ ID NO: 251754 - DNA, 636 bp, Homo sapiens
  misc_feature: GYAE6OF02JR5PO.25.28.C06.1.454.CMB.1.raw
  modified_base (252)..(252): a, c, t, g, unknown or other
  misc_feature (252)..(252): n is a, c, g, or t
  modified_base (448)..(448): a, c, t, g, unknown or other
  misc_feature (448)..(448): n is a, c, g, or t
  modified_base (477)..(477): a, c, t, g, unknown or other
  misc_feature (477)..(477): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcgagggtcagttaggaaatttntttggcctggtatcagtcaagaaaccgagggtaaacgttccctaaacctcctaccaatcctaatcgccttgccaatcctaacgtttcgacgttaacgtttcggggtacccttcgttacgtaactttcgacgtccgggtctagggttcgggtcgtagggaacctaggtaacttcaacgttctaccgtaccatccgancacgccttcgcacggtccctagtaacggnttaggttacgtaccttaaacgtttacttaacttacgttaacgtaaaaattacttaaacgtaacttccgtacccttctacgttaccggtttcgggaccgggtaacgtaccgtaagggttaacggtacgtaacgtaaccgtaaacggtacgttaggtacgg

SEQ ID NO: 251755 - DNA, 583 bp, Homo sapiens
  misc_feature: GYAE6OF02HD7H8.25.28.C06.1.454.CMB.1.raw
  modified_base (373)..(373): a, c, t, g, unknown or other
  misc_feature (373)..(373): n is a, c, g, or t
  modified_base (411)..(411): a, c, t, g, unknown or other
  misc_feature (411)..(411): n is a, c, g, or t
  modified_base (433)..(433): a, c, t, g, unknown or other
  misc_feature (433)..(433): n is a, c, g, or t
tcagactgtacagtcacgaccggtgctcgatttagagctcacgtattgggtttgggggaagaggaagactgacggtcctcccaggagttcaggtgctgggcaccttgagcactgaacgcagcggactcaccatggagtttgggctgaactgggttttcctcgttgctcttttaagaggtgtccagtgtcagatgcaactggcggagtcggggggaggcgtggtccaggccggggaagtccctgagactctcctgtgcagtgtccgcgtccaccttccgtcgttttggctattcactgggtccgccaggctccgaggcaagggctggagtgggtggcggtcagtagtggtgggatggaagtaatgctattttangcagactcgtagaacgggccgactcaccatcctccagngcagctaccaagactactttanctagactaattacgaaaaccgtgaacgtactacggacgacgacggctacgtactattacgtggcggcgggtctaggaacgacgtacgggtccgggcctacggtaacggcagtcgggaccggccgtacgggggacccaacggggcctacgg

SEQ ID NO: 251756 - DNA, 224 bp, Homo sapiens
  misc_feature: GYAE6OF02FWPBH.25.28.C06.1.454.CMB.1.raw
  modified_base (220)..(224): a, c, t, g, unknown or other
  misc_feature (220)..(224): n is a, c, g, or t
tcagactgtacagtcacgaccggtgctcgatttagagctcacgtattggggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnnn

SEQ ID NO: 251757 - DNA, 556 bp, Homo sapiens
  misc_feature: GYAE6OF02F02YI.25.28.C06.1.454.CMB.1.raw
  modified_base (374)..(374): a, c, t, g, unknown or other
  misc_feature (374)..(374): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccattcaccatctccagggacaattccaagagaaccctntatctgcaaatgaacaacttgagagtcgaggatacggccgtttattactgtgcgacctcaggagtggcgtaggaaaagtcgtagtctcattcccgtcgacctcgtggggccagggcacccgtggtcaccgtctcctcacgccttccaccacggcccagtccggtccttcccccgtggtcccg

SEQ ID NO: 251758 - DNA, 569 bp, Homo sapiens
  misc_feature: GYAE6OF02GHMDU.25.28.C06.1.454.CMB.1.raw
  modified_base (226)..(226): a, c, t, g, unknown or other
  misc_feature (226)..(226): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggnagtcagggcattggaaattatttggcctggtatcagcagaaaccagggaaagttcctaacctcctcatctatgctgcatccactttgctaagtttcggggtccctctcgattcagcggcaggtgggtctgggacagaattcactctcaccatcacgcacgcctgcagcctagaagtatgttgactaacgtttaattacttagttaacctaaaaatttacgtaacgtacgtacggtacccgtaggtacgttcggttaccggtaccccggtaacggggtaacccgtaaagggttacgggtaacgtaacgttaaccggtaaaaccgtaaccggttaggttaccggg

SEQ ID NO: 251759 - DNA, 525 bp, Homo sapiens
  misc_feature: GYAE6OF02GOQYU.25.28.C06.1.454.CMB.1.raw
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacttgccggcgagtcagggcattggaaattattggcctggtatcagcagaaaccagggaaagttcctaaacctcctacatctatgctgcatcctatttgactaagtttcgggtccctnttcgattcagcggnaggttggtctgggacagaattcactctcaccatcagcacgtcctcgcacgcctagaagtatgttgactaactttattactacgtaactaaaattcgaactagtacgtaccgtaggtagtcggttacggacccgtaaggaccgtaaggtacgacgaacgtaccgaaacgtacgtgtacgg

SEQ ID NO: 251760 - DNA, 549 bp, Homo sapiens
  misc_feature: GYAE6OF02ITPF8.25.28.C06.1.454.CMB.1.raw
  modified_base (338)..(338): a, c, t, g, unknown or other
  misc_feature (338)..(338): n is a, c, g, or t
  modified_base (417)..(417): a, c, t, g, unknown or other
  misc_feature (417)..(417): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttggccggcgagtcagggcattggaaattatttggcctggtatcagcagaaaccagggaaagttccgtaaacctcctcaatctaatgctgcatccactttgcaagttttcggggtcccgtntcgatttcaggtcggctaggtgggtctagggactaggaacttcactctcgaccatcagccagtcctgcacgcctagaanagttgtagactaactttattacttagtaactaaaaagtttgaacagttacgaccgtaggacgttggttaccggacccggtaagggtaccgaaggtacggaacgtaacgtaccgaaacgtacgtaggtacggg

SEQ ID NO: 251761 - DNA, 665 bp, Homo sapiens
  misc_feature: GYAE6OF02G75F2.25.28.C06.1.454.CMB.1.raw
  modified_base (203)..(203): a, c, t, g, unknown or other
  misc_feature (203)..(203): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctctcaggtggcagatgtgacatccagatgacccagtctccatccctccctggctgcttctggtggganacagaactcaccatcacttgccaggcgagtcaggacattagtcactgtagttaaattggtaatacaaacgaacgaaaccgacgggtaaaccccttaaactcctagactctaacgatcgtcctacctaagtttggacggtcgacgggtacccatactaaacgttcacgtaggaagtggactcgtagggactaggtttagttttagtttcgtacctagtaccagctacgtcctagtacctaactagtaagttacttttacgactaactaatttactttaccgttacgtaacctaaccttaagttacgttacgttaacttccgttacccttacccttaccgttaaccttaccggtttttaccggaacccggttaaccggggtaaaccgtaacgggtacggtaacgtaaccgttaaacgtaaaccggtaacgttacggttacgggtaccttacggacctaacccgg

SEQ ID NO: 251762 - DNA, 623 bp, Homo sapiens
  misc_feature: GYAE6OF02I3DKL.25.28.C06.1.454.CMB.1.raw
  modified_base (408)..(408): a, c, t, g, unknown or other
  misc_feature (408)..(408): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgcagtgtccgcgtccaccttccgtcgttttggcattcactgggtccgccaggctccaggcaagggctggagtgggtggcggtcatatggtgggatggaagtaatgctattttatgcagactccgtgaagggccactcaccatcctccaggaggcagcctaccaaagaaccttactttatcgtgactaagttacgaaaaccgtgaacgaccgtacgacgacgacggtctgtacttattacgnggcggcgggtctagaagaacgcgggtcgggccgtcgtacggcagcggacgtcgtcgggaccgaacgggaccagtcggtaccgaccgtcctccgtacgacgtccctaccgaaccgaccggtcccacgtccggttcccttccccgtcggccctacccctccgtaaccgaacgtccgacccgtaccgttccggcggggaccaccggaccggtcccggg

SEQ ID NO: 251763 - DNA, 542 bp, Homo sapiens
  misc_feature: GYAE6OF02H14N6.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctggtgctctggctcccagctatcagatgtggcatccagatgacccagtctccatccctccctgtctgcatctgttggagacagatcaccatcacttggccgggcgagtcagggcattggaaatttattggcctggtatcagcaagaaaccgagggaaacgttcctaacctcctacatctatgctgcatcctactttgactaagtttcggggtccctctcgtattcagcggcaggtgggtctgggacagtactcactctcaccatcagcacgcctgcagcctagaagatgttgactaactttattactagtaactaaaatttcgaactagtacgtacccgtagtacgttcggttccggacccggtaacgggaaccgtaaggtcggtaactacgtaaccgtaaacggacgttggaggtacg

SEQ ID NO: 251764 - DNA, 222 bp, Homo sapiens
  misc_feature: GYAE6OF02HE4T8.25.28.C06.1.454.CMB.1.raw
  modified_base (219)..(222): a, c, t, g, unknown or other
  misc_feature (219)..(222): n is a, c, g, or t
tcagactgtacagtcacgaccggtgctcgatttagagctcacgtattggggtttgggggaagaggaagactgacggtcctcccaggagttcaggtgctgggcaccttgggcacgggggaggtgtgtcacaagatttgggctctgggcacagcggccctgggctgcctggtcaaggctacttccactgtacagtctgagcgggctggcaaggcgcatagnnnn

SEQ ID NO: 251765 - DNA, 516 bp, Homo sapiens
  misc_feature: GYAE6OF02FS5LY.25.28.C06.1.454.CMB.1.raw
  modified_base (327)..(327): a, c, t, g, unknown or other
  misc_feature (327)..(327): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacttgccgggcgagtcagggcattggaaatttattggctggtatcagcaagaaccagggaaagttcctaacctcctcatctatgctgcatccactttgcaatttcgggccctntcgattcagcgcaggtggtctgggacagaattcactctcaccatcagcagcctgcagcctgaagattgttgacctaactttattactagttactaaaatttgaactagtcgtaccgtgtacgttcggttaccggacccgtaacgggaccgtaaggtacggaacgtagtaccgaaacgtacgtggtacgg

SEQ ID NO: 251766 - DNA, 577 bp, Homo sapiens
  misc_feature: GYAE6OF02HV161.25.28.C06.1.454.CMB.1.raw
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccgattcaccatctccagggacaattccaagacgaaccctctatctgcaaatgaacaacttgagagtcgagatacggtccgtttatactgtgcgactcaggagtggctaggaaaagtcgtagtctcattcccgtcgacctcgtgggccagggccacccgtggtccaccgtctcctcacgtccttacccaccgaacgggcccagtccggtccctttcccccgtcggcccgtcccctcgtcccgtcccgacggaccgccgaccctccggtcgggggacccg

SEQ ID NO: 251767 - DNA, 568 bp, Homo sapiens
  misc_feature: GYAE6OF02G91XY.25.28.C06.1.454.CMB.1.raw
  modified_base (251)..(251): a, c, t, g, unknown or other
  misc_feature (251)..(251): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccnccagtgtccaggcaaggggctggagtggctgggagttacttggtctgacagacaaatgacatatcacgcggagtccgtgaggggccattcaccatctccagggacaattccaagagaaccctctatctgcaaatgaacaacttgaagagtcgaggatacggccgtttatactgtgcgacctcgaggagtggctaggaaaagtcgtagtctctattcccgtcgacctcgtcggggccagggcacccgtggtccaccgtcgtcctcacgtccttaccgaccgtaacgggccctacgtccggtccttccccgtggtcccg

SEQ ID NO: 251768 - DNA, 690 bp, Homo sapiens
  misc_feature: GYAE6OF02IDL2B.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctccctgtctgcatctgttggagacagagtccaaccatcacgttcggccgggacgaggtcgaggggctaagttagggaaatttagttgggccttaggtatcagacaagaaaaccgagggtaaacgttcccaaaccttcctcatctatgctagctactcctatttcgacttaaggttttccggggtcccgttctcgtaacttcgaggtccggcgtagggttcgggtacgtacggggaactaagtaactttccgtaacctcctacgaacctactacgacgtccgaacgtccgtacggaccgacgtacccgtaggtaaacgtacgttcggtttaaccgtaacctttaaacgttttaacttaacgtttaacgtttaaacttaaaaacgtttacgaacgttaacgggttaccggtacccggttaggttacggttaccgggttacccggacccggaacgggtaacccggtaagggtcggtaacgtaacgtaaccggaaaacgtcggttaggtaccgg

SEQ ID NO: 251769 - DNA, 739 bp, Homo sapiens
  misc_feature: GYAE6OF02I64MB.25.28.C06.1.454.CMB.1.raw
  modified_base (233)..(233): a, c, t, g, unknown or other
  misc_feature (233)..(233): n is a, c, g, or t
tcagactgtacagtcacgaccggtgctcgatttagagctcacgtattgggtttgggggcagaagtctcttctcagtcaggtacacagcatggacatgaggtccctgctcagctcctgggactcctgctgctcgtggcctcccagctatcagatgtggcatccagatgacccagttcctcctatcctccctgtctgcatcgtgtggagacagagtcaccatcacgttcgccggngagtcgagggcagttaggaaatttagtttcggaccttggtaactcgacgcgaaggaaacccgagggtaaaacgtttaccctaaacccttcctactactacgtatcgtacttgacctacttccctacttttacgaccttaaggttttccgggggtccccttacgttaccggtaacttttacgaacggtccggacgtagggtttcggggtaccgttacggggaacctaaggtaactttcccgtaacgtttaccctaccgtaacccgtaacgtaccgaaggacccgtacggtacccttaggacccgtaacgtaccgttaaggaacgtagtttcggttagtaaccgtttaaccgtttacgtttaccgttaacgttaaacttaaaacggtttcgaaaccgtacgttaccgtacccggttggtaacgttcgggttacccggtacccggtaacgggtaacccgtaaggggtacgaacgttaaccgtaaccgaaaccggtcgttacggtaccgg

SEQ ID NO: 251770 - DNA, 573 bp, Homo sapiens
  misc_feature: GYAE6OF02F5IN7.25.28.C06.1.454.CMB.1.raw
tcagactgtacagtcacgaccggtgctcgatttagagctcacgtattgggtttgggggaagaggaagactgacggtcctcccaggagttcaggtgctggacaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccattcaccatctccagggacaattccaaagacgaaccctctatctgacaaaatgaaacaacttgagagtcgaggatacggccgtttattactgtgcgacctcaggagtggctaggaaaaagtcgtaagtctacattcccggtacgtaccgtcgtcggggccagggccacccgtggtcaccgtctcctcacgtccttccaccgaacggcccacgttccggtccttcccccgtggtcccg

SEQ ID NO: 251771 - DNA, 554 bp, Homo sapiens
  misc_feature: GYAE6OF02IWL0N.25.28.C06.1.454.CMB.1.raw
tcagactgtacagtcacgaccggtgctcgatttagagctcacgtattggggtttgggggcagaagtctctctcagtcaggacacagcatggacatgagggtccctgctcagctcctgggactcctgctgctctggctcccagctatcagatgtggcatccagatgacccagtctccatccctccctgtctgcatctgttggagacagagtcaccatcacttgccgggcgagtcagggcattggaaattatttggcctggtatcagcaagaaaccagggaaagttcctaacctcctcatctaatgctgcatccactttgcaagttttggggtccctcttcgatttcagcggcagtgggtctgggacagtaattcactctcaccatcagcagccttgcacgtcctgaagattggttgactaactttattaacttagtaacttaaaaagtttcgaaactagttacggtacccgttaggtacgttggttaccggacccgtaaggggtacccgaaagggttacgggaaccgtataaccgaaacggtaacgtggtacggg

SEQ ID NO: 251772 - DNA, 258 bp, Homo sapiens
  misc_feature: GYAE6OF02IWGF9.25.28.C06.1.454.CMB.1.raw
  modified_base (242)..(242): a, c, t, g, unknown or other
  misc_feature (242)..(242): n is a, c, g, or t
  modified_base (250)..(251): a, c, t, g, unknown or other
  misc_feature (250)..(251): n is a, c, g, or t
  modified_base (253)..(258): a, c, t, g, unknown or other
  misc_feature (253)..(258): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggattttcggcccagggaccaaggtggacatcaaacgactgtggctgcacatctgtctcatcttccgcatctagactgtacagtctgagcggctggcaaggcncataggcnntnnnnnn

SEQ ID NO: 251773 - DNA, 583 bp, Homo sapiens
  misc_feature: GYAE6OF02JHC34.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcagttaggaaatttagttcggccgttggttatcagtacaacggaaaccgagggtaaacgttaccctaaccgtcctacgtaacttctaatcgactgactactcctactttgactaagtttcggggtccctctcgtattcgacgtcgcgtaggtcggtcgtgggacagtacttcacttccacactatcgagcacgtctgcagcctagagtctgtcgactacgttattacgtagttaactaaaattcgaacgtagtaccgtaccgttaggtacgttcgggttaaccgacccggtaaggtacccgtaagggttccggaactacggttaaccgaaaccggtacgttggtacgg

SEQ ID NO: 251774 - DNA, 550 bp, Homo sapiens
  misc_feature: GYAE6OF02FN6OQ.25.28.C06.1.454.CMB.1.raw
tcagactgtacagtcacgaccggtgctcgatttagagctcacgtattgggtttggggggaagaggaagactgacggtcctcccaggagttcaggtgctgggcaccttgagcactgaacgcagcggactcaccatggagtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaaggggctggagtgggctggggagttacgttggtctgacagacaaatgacatatcacgcggagtccgtggacggggcctattcaccatctcagggacaattccaagacgaaccctctatctagacaaatgaactaactagagagtacgagacgtacggtcgtttaatactgtgcgacctcgaggagtggactaggaaaagtcgtagtctactacgttccgtcgtacctcgtcggg

SEQ ID NO: 251775 - DNA, 647 bp, Homo sapiens
  misc_feature: GYAE6OF02I515X.25.28.C06.1.454.CMB.1.raw
  modified_base (231)..(231): a, c, t, g, unknown or other
  misc_feature (231)..(231): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcctccatccctccctgtctgcatctgttggagacagagtcaccatcacgttcggccgggngagtcgagggctagttaggtaaattgtttggcctggtatcaggacaagaaaccgaggtaaaacgttcctaaacccttcctacactcttatcgtctgctactcctacttcgtacgttaacggttttcgggtcccgttcgtacgtacgttacgaggtccgtcgtacgggtgggtcgtcgggaacaagtaacgttctaccttcctacacctactcgacgaccgacgtcctcgcacgtccgttaagaacgtagttcggttacgtaacttaaccgtttactttaacgttacgttaaaccttaaaagtttacgaacgtagtacggtacccgttaggtacgttaccggtcccggtaacccggtaacgggtaaccgtaagggttacgacgtaacgtaaccgaaacgttaccgtgggttaaccgg

SEQ ID NO: 251776 - DNA, 576 bp, Homo sapiens
  misc_feature: GYAE6OF02HGBQ0.25.28.C06.1.454.CMB.1.raw
  modified_base (227)..(227): a, c, t, g, unknown or other
  misc_feature (227)..(227): n is a, c, g, or t
  modified_base (343)..(343): a, c, t, g, unknown or other
  misc_feature (343)..(343): n is a, c, g, or t
  modified_base (419)..(419): a, c, t, g, unknown or other
  misc_feature (419)..(419): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttggccgggngagtcgaggcattaggaaattgtttggcctggtatcagcaagaaaccgagggtaaacttccctaaacctcctcattcctatcgctgcactccatttgactagttttcggggccctntcgtattcaggcgctaggtggtctggacagacttcactctcacctatacagcacgccttgacgacgtcctagaagnttacgttcgtacctaactttagttaactacgttaacgttaaaaatttcgaactacggttaccgtacccggtggtaacgttcggttacccgggacccgtaacgggaaccgtaagggtacgaacgttacgtaaccgtaaacggtaccgtacggtacggg

SEQ ID NO: 251777 - DNA, 561 bp, Homo sapiens
  misc_feature: GYAE6OF02G8PBK.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtccaccatcacgttggccgggcgagtcgagggcagttaggaaattatttggccttggtatcagcaagaaaccgagggaaacgttccctaaacctcctcatctatgctgacactcctactttgactaagttttcggggtcccttctcgtattcgaggtccggactaggtcggggtctaggggactaggtaattccgactctaccaccatccagcacgcctgacacgctagatagttgtgactaacttattactagtaactaaaattcgaatagtacgaccgttggtacgtcggttaccggaccggtaacgggaccgtaagggtacgtacgagtaaccgaacggtacgtggtacgg

SEQ ID NO: 251778 - DNA, 808 bp, Homo sapiens
  misc_feature: GYAE6OF02JF0K6.25.28.C06.1.454.CMB.1.raw
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcccgtccctgtcctcgactattctggttaggacgacaggtacgtccaacctactcctacgttcgggcccggcgtacgtacggacgggtctaaggttaggtaaaattttgttcggaccgttaggtactcgacgaccgtaaacggaaacccggtaagggttaaaccgttacccttaaaccgttccctacgtaacttcttaagtcgtccttacgacttaaccttccttaacgttttcgaaccgttttaacggggttttttccccgggggtacccctttacggttaccgttaacgttttaccggacgggtacccgggttaaccgttagggggtttccggggtttacgtacgggggtaaaccgtaacggttaacgtttacccgtaccgttacccgttacctaaccgtactacgtacgacctacgtccgttacgacctaccgtccgtaaggtaacgtcgtttacgtacgtaaccttaacgtttacttaaccgttagttaaaccttaaaagtttcgaaacgttagtaacccggttaccgtaggttacgttaccgggttacccggaaccggtaaccggggtaaccgtaagggtaccgttacgtaaccgtaaccggtaaaccggtacggtacggttaccgg

SEQ ID NO: 251779 - DNA, 257 bp, Homo sapiens
  misc_feature: GYAE6OF02IA75L.25.28.C06.1.454.CMB.1.raw
  modified_base (237)..(237): a, c, t, g, unknown or other
  misc_feature (237)..(237): n is a, c, g, or t
  modified_base (253)..(257): a, c, t, g, unknown or other
  misc_feature (253)..(257): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggcccagggaccaaggtggacatcaaacgactgtggctgcaccatctgtcttcatcttcccgccatctgaactgtacagtctgagcgggntggcaaggcgcatagnnnnn

SEQ ID NO: 251780 - DNA, 590 bp, Homo sapiens
  misc_feature: GYAE6OF02IDVBV.25.28.C06.1.454.CMB.1.raw
  modified_base (383)..(383): a, c, t, g, unknown or other
  misc_feature (383)..(383): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctggggcaccgtggagtctgggggaggcgtggtccagcctgggaagtccctgagactctcctgtgtggcgcctagactcaccttcagtagttatggctttcgtctgggtccgccagtgtccaggcaagggggctgggagtggcgtggggagtttacttgggtctgacagacaaatgacatatcacgcggagtccgtgacggggccattcacatctcgagggacaattccaagacgaaccctntaatctagacaaatgaaacacttgagagtcgaggatacggtacgtttattactgtgcgacctgaggagtgacgtaggtaaaagtcgtacgtctacgacttcccgtacgtacctcgtcgggcctacggcctaccgtcgtcctaccgtctcctctacgtccttaccgaccgaacggcccacgttcccggtccttcccccgtggtccccg

SEQ ID NO: 251781 - DNA, 658 bp, Homo sapiens
  misc_feature: GYAE6OF02FFNNC.25.28.C06.1.454.CMB.1.raw
  modified_base (250)..(250): a, c, t, g, unknown or other
  misc_feature (250)..(250): n is a, c, g, or t
  modified_base (389)..(389): a, c, t, g, unknown or other
  misc_feature (389)..(389): n is a, c, g, or t
  modified_base (442)..(442): a, c, t, g, unknown or other
  misc_feature (442)..(442): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtggagtctggggaggcgtggtccagcctgggaagtccctgagactctcctgtgtggcgcctagactcaccttcagtagttatggtcttcgtctgggtccnccagtgtccaggcaaggggctgggagtggctgggagttactggtctgacagacaaatgacatatcacggcggagtccggtggacggggtccattcacctatcctaccgagggacctaacgttaccgaagacgaaccctntactctagacaaatcgaaactacgttgagagtcgagatacggtctttatacgngtacgaccgactacgaggtagtacggtacgtaagggtaaaacgttcgtaacgtcctacgtacgttacccggtcgtacctcggtacggggaccctacgggtcccgttacggtaccctaccggtcctacccgtaccgacgtacccttacccgaacccgtaaccgggtccctaacgttccccgggttacccttcccccggtacgggtccccgtccccgg

SEQ ID NO: 251782 - DNA, 567 bp, Homo sapiens
  misc_feature: GYAE6OF02IDMS9.25.28.C06.1.454.CMB.1.raw
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaagggggctgggagtggctggggagttacttgggtctgacagacaaatgacatatcacgcggagtccgtgaggggccattcaccatctccagggacaattcccaagagaaccctntatcngcaaaatgaacaacttgagagtcgaggatacggcgtttattactgtgcgactcaggagtggcgtaggaaaagtcgtagtctctagttcccgtcgacctcgtcgggccaggcaccgtcggtcaccgtctcctcacgtccttaccaccgacgggcccacgtccggtccttcccccgtggtccccg

SEQ ID NO: 251783 - DNA, 251 bp, Homo sapiens
  misc_feature: GYAE6OF02I1W2V.25.28.C06.1.454.CMB.1.raw
  modified_base (249)..(251): a, c, t, g, unknown or other
  misc_feature (249)..(251): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgacccgtggatgttcggccagggaccaaggtggacatcaaacgaactgtggctgcaccatctgtcttcatcttcccgcatctgaactgtacagtctgagcgggctgcaagcgcatagnnn

SEQ ID NO: 251784 - DNA, 610 bp, Homo sapiens
  misc_feature: GYAE6OF02G9HIZ.25.28.C06.1.454.CMB.1.raw
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccgccagtgtccaggcaagggggctggagtggctgggagttacttggtctgacagacaaatgacatatcacgcggagtccgtgaggggccgattcaccatctccagggacaattccaagacgaaccctctatctagacaaatcgaaacaacttgagagtcgaggactacggccgtttattactgtgcgtacctcaggagtggctaggaaaagtcgtagtcgtctacgttcccgtacgtacctcgtcggggaccgacgggccaccgtcggtacctacccgtcctcctcgtacgtccttcccgaccgaacgggccctacgtccggttcccttccccgtcggcccgtccccgtcgtccgtacccgacgggtaccgcccgtacccgtcggtacggggtacccg

SEQ ID NO: 251785 - DNA, 570 bp, Homo sapiens
  misc_feature: GYAE6OF02GPI2T.25.28.C06.1.454.CMB.1.raw
  modified_base (113)..(113): a, c, t, g, unknown or other
  misc_feature (113)..(113): n is a, c, g, or t
  modified_base (151)..(151): a, c, t, g, unknown or other
  misc_feature (151)..(151): n is a, c, g, or t
  modified_base (154)..(154): a, c, t, g, unknown or other
  misc_feature (154)..(154): n is a, c, g, or t
  modified_base (178)..(178): a, c, t, g, unknown or other
  misc_feature (178)..(178): n is a, c, g, or t
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
tcagactgtacagtcacgaccggtgctcgatttagagctcacgtattgggtttggggcagagtctctctcagtcaggacacagcatggacatgagggtccctgctcagctccngggactcctgctgctcgtggcctcccagtctatcagtntgnggccatccgagctgaccctgtccnccatcctcctggtcngcatcgtgtcganacagtctcacatcacggttgccggntacgcaggntattaggaaatttcttggacctgtatcagcaagaacaggaaactttccaactcctagatctntggctnaactntcctaaggttntacgagttttcggggcccctaattcagtttncggcggntaaggtcgggtacggaactgtaacttcacgttcncaacctggtcagcacgttcaacncgcttacaggaactntggttccanaaccttttataactgggttaaataaaactttcgataaggttccaagtcgtccggttaactccgggggaccaacggggtaaccagggttaacggtacaacttaacgaaaaccggtttcgtaggtccgg

SEQ ID NO: 251786 - DNA, 548 bp, Homo sapiens
  misc_feature: GYAE6OF02GUO5X.25.28.C06.1.454.CMB.1.raw
  modified_base (226)..(226): a, c, t, g, unknown or other
  misc_feature (226)..(226): n is a, c, g, or t
  modified_base (410)..(410): a, c, t, g, unknown or other
  misc_feature (410)..(410): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggngagtcagggcattggaaattattggcctggtatcagcaagaaaccgagggtaaacgttccctaaacctcctcatctatgctgcactccactttgctaagttttcggggtcccgtctcgattcagcggcagtgggtctgggacagaattcactctcaccatcagcacgcctgccagcctgaagtnttgttgacctaactttattacgtagttaactaaaatttcgaacgtagtacgtaccgtaggtacgttcggttaccggacccgtagggtacccgtaagggtcggaactaagttacccgaaacggtaccgttaggtaccgg

SEQ ID NO: 251787 - DNA, 596 bp, Homo sapiens
  misc_feature: GYAE6OF02HO39K.25.28.C06.1.454.CMB.1.raw
  modified_base (208)..(208): a, c, t, g, unknown or other
  misc_feature (208)..(208): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctccctgtctgcatctggttggagacagntcaccatcacttggccggcagtcgagggctagttaggaaatttagtttggccttggtatcagcaaacgaaccgaagggtaaacgttacccaaccttcctctatctactgctgcatcctattgactaagtttcgggtcctctacgtattcgagcggtcaggttcgggtctgggactagtaacttcgactcctacaccgtatacacgcgacgtccagccagtcctagaagtgttgtacgacttaacttattaaccgttagttaaacttaaaagtttcgaaacgtagttccggtaccgttaggtaccgtcgggttacccggacccggtaacggggtaacctaaggggtacgtaacgtactaaaccggtaaaacggttacgttaggtaccgg

SEQ ID NO: 251788 - DNA, 500 bp, Homo sapiens
  misc_feature: GYAE6OF02HV2W8.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccaggtaccagctgtgacatccagatgacccagtctccttccttcctgtctgcatctgtgggagacagagtcaccatcacttgccgggcgagtcaggacattaccaaattatttagcctggtatcaacacaaaccagggaaaagtccctaagctcctgatctattctgcatcaccttgcagtcagggtcccatctcgctttcagcggcagtggatctgggacagatttcagtctcaccatcaccggcctgcagcctgacgatcttgcaacttattactgtacaaactatacacagtcgaccccgtacagttttggccgaaggggaccacgaacgtggacctcgaaaggactggtggctgtacc

SEQ ID NO: 251789 - DNA, 221 bp, Homo sapiens
  misc_feature: GYAE6OF02JGU11.25.28.C06.1.454.CMB.1.raw
  modified_base (218)..(221): a, c, t, g, unknown or other
  misc_feature (218)..(221): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcacagcggcctgggctgcctggtcaaggactacttccactgtacagtctgagcgggctggcaaggcgcatagnnnn

SEQ ID NO: 251790 - DNA, 630 bp, Homo sapiens
  misc_feature: GYAE6OF02GVO3I.25.28.C06.1.454.CMB.1.raw
tcagactgtacagtcacgaccggtgctcgatttagagctcacgtattggggtttgggggcagaagtctctctcagtcaggacacagcatggacatgagggtccctgctcagctcctgggactcctgctgctctggctccagctatcagatgtgcatccagatcgaccagtctaccatccctcctgtctgcatctgtgagacagacgtcacatctacgttgccgggtgagtcgaggcattaggtaaatttagttggcctaggtactacgagtcaacgaaaccgaggtaaacgttcctaacctcctacactcgtacgtcgtcgtcgacctactctacgtttgacgtaaggttttccggggtccttacggtacgtactcgtacgtcggtctagggttcggtacgtacgggaactacggtaacttcgaacttccgactacccaatcgagacgtaacgttccgttcgacgtcgacctaagtaagtacttaggttacgtaacgtttaacctttagttaacgttacgtttaaactaaaacggtttcaacgtacgttacgtccggttaagtaccgttacggttaccggaccggtaagggaccgtaaggtacggactactaaccgaacgtacgtgtacg

SEQ ID NO: 251791 - DNA, 522 bp, Homo sapiens
  misc_feature: GYAE6OF02HNAA1.25.28.C06.1.454.CMB.1.raw
  modified_base (272)..(272): a, c, t, g, unknown or other
  misc_feature (272)..(272): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgtcgggcgagtcagggcattggaaattatttggcctggtatcagcagaaaccngggaaacgttcctaacctcctcatctatgctgcatccactttgctaagtttggggtccctctcgattcagcggcagtggtctgggacagattcactctcacatcagcagcctgcagcctagaagatgttagactaacttattactagttaactaaaatttcgaactagtacgacccgtaggtacgttcggttccggacccgaacgggtaccgtaagggtcggaactagtaccgaaacgtacgtggtacgg

SEQ ID NO: 251792 - DNA, 522 bp, Homo sapiens
  misc_feature: GYAE6OF02H79GJ.25.28.C06.1.454.CMB.1.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
  modified_base (342)..(342): a, c, t, g, unknown or other
  misc_feature (342)..(342): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgganacagatcaccatcacttgccgggcgagtcagggcattggaaattatttggcctggtatcagcacgaaaaccagggaaacttccaacctcctcatctatgctgcatccatttnactaagtttcgggcctctcgattcagcgnaggtgggtctgggacagaatcactctacacatcagcagcctgcacgcctagaagattgttagactaactttattactagttaactaaaaatttgaactacgtagaccgttggtagttcggttaccggacccgacgggtaaccgaagggtcggaacaagttaccaaacgtacgtagtacgg

SEQ ID NO: 251793 - DNA, 662 bp, Homo sapiens
  misc_feature: GYAE6OF02GIVWX.25.28.C06.1.454.CMB.1.raw
  modified_base (226)..(226): a, c, t, g, unknown or other
  misc_feature (226)..(226): n is a, c, g, or t
tcagactgtacagtcacgaccggtgctcgatttagagctcacgtattggggtttgggggcagaagtctctctcagtcaggacacagcatggacatgagggtccctgctcagctcctgggactcctgctgctctggctcccagctatcagatgtggcatccagatgacccaatctccatcctcctgtctgcatctgttggagacagagtcaccatcacttgccgggngagtcagggcagttggaaatttatttggccttggtatcgagcaaggaaaccgagggtaaacttcctaacctcctacattctagtcgctgactactcctacttttgactaaggttttcgggggtaccccttcgttcgatttccgaggtccggactagggttcggggtctaggggaactaggtaacttcgaaccttccgtaccaaccgtacttaccgacggtccacgtcccttgaccgtaccgaccgttaggaaagtacgttacggttacgtaacccgttaaacgttttaacttaaccgtttagttaaacctttaaaaagtttcggaacttacggttacgtacccggttaggtaacgttcggttacccgggtacccggtaaacgggtacgtaacgggttcggaacctagtaaccgtaaacggtacgttaggtaccggg

SEQ ID NO: 251794 - DNA, 557 bp, Homo sapiens
  misc_feature: GYAE6OF02HF8D0.25.28.C06.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (399)..(399): a, c, t, g, unknown or other
  misc_feature (399)..(399): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagataccagatgtgacgtccagatgacccagtcctccatccctccctgtctgcatctgttgganacagaatcagcatcacgttggccgggngagtcagggccccattagctaattattagcctggtatcaacgaagaaaccgagggagtagttaccaagtctcctgattctatgctcgcctcctactacactcgacgggtccattcctcggttcacgcgcagtgaagtcgagggactagtacgtcacgtctactactacncagcacgtctagccacgtccgtagaagtagttgtacgtactaactttattacgttataactaaagttacgactagtaccgtaccggtaggtacgttcggttaccggaacccgtacggaaccgtaacggtacgacgtacgtaacgtaacgacgttacgg

SEQ ID NO: 251795 - DNA, 608 bp, Homo sapiens
  misc_feature: GYAE6OF02G8YVY.25.28.C06.1.454.CMB.1.raw
  modified_base (471)..(471): a, c, t, g, unknown or other
  misc_feature (471)..(471): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctccctgtctgcatctgttggagacagagtcaccatcacgttgccgggcgaggtcagggcagttaggtaaattagtttcggccttgggttaatcacgacaaggaaaacccgaaggggtaaaactttcccgtaaaccctcctactatctatgtctgctatcctatttcgacttaacggtttcggggtccctcttacgactttcgacggtccgtcgtacggtggggtcctagggtacgaagtaacttcactcctcaccatcacgacacgtcctcgctacgcctagaatgtgttntactaactttatttaactattaacttaaaatttagaacgtacgtacggtacccgttaggtacgtacggttacccggaccggtaacgggtaaccgaagggtacggaacgtacgtaaccgaaccggtagtcggtaacgg

SEQ ID NO: 251796 - DNA, 254 bp, Homo sapiens; identical to SEQ ID NO: 251477
  misc_feature: GYAE6OF02GQPLB.25.28.C06.1.454.CMB.1.raw
  modified_base (253)..(254): a, c, t, g, unknown or other
  misc_feature (253)..(254): n is a, c, g, or t

SEQ ID NO: 251797 - DNA, 223 bp, Homo sapiens
  misc_feature: GYAE6OF02HLHAA.25.28.C06.1.454.CMB.1.raw
  modified_base (219)..(223): a, c, t, g, unknown or other
  misc_feature (219)..(223): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnnn

SEQ ID NO: 251798 - DNA, 642 bp, Homo sapiens
  misc_feature: GYAE6OF02GJA5I.25.28.C06.1.454.CMB.1.raw
  modified_base (203)..(203): a, c, t, g, unknown or other
  misc_feature (203)..(203): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccatccctcctgtctgcatctggttgganacagtagtcaccatcacgttggccggcgagtcgaggcagttaggaaatttgttggcctggtatcgagcaagaaaccgagggtaaacttccctaaaccgtcctactacttctagtcgtctcgtcactcctacgtttcgacttaaggttttccgggtcccttacgtcgtacgtttcgaggtccggtcgtaggggttcggtacgtacggggaactaggaactttccaccttctacctacctacgacgtacgtctaccgtccttacggacctacggtacctaagtacgtacttggttacgaacctttaacgttttactaccgttagttaaacttaaaagtttcgaacgtacgttaccgtacggttaggtacgttcggtacccggaccggtacgggtaaccgtaaggtcggtaactaccgtaacgaaacggtcgtagtacccgg

SEQ ID NO: 251799 - DNA, 757 bp, Homo sapiens
  misc_feature: GYAE6OF02JVXLS.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccatcctcctgtctgcatctgttggagacagagtcaccatcacgttcggccgggcgagtcgagggctagttaggtaaatttagttcggccgttggttatcgagactaacggaaaccgtaagggtaaaccgttaccctaaaccctcctactaacttactacgtgactcgtactacgtaccttacgtttcgacgttaacggttttccggggtcccgttacgtacgtacgtttacgacggtccggtacgttagggttcgggtcgtagggtaactaagttaacgttcctaacgttccctaccgtaacctacgtacgaaccgtcgtaacccgtccggttacgtaccgtaccggtaccgttaagggtaaacgttacttgggttacctaaaccttaaacgttttaacgttaaccgttaacgtttaaaaccgtttaaaacgtttcggtaaaccgttagggttaacccgggttaaccggtgggtttaaaccggttccggggtttaaacccggaacccgggtaaacggggtaaccggtaagggttaaccggaactaaaccggttaacggtaaaaccgtcggttacggtaccgg

SEQ ID NO: 251800 - DNA, 280 bp, Homo sapiens
  misc_feature: GYAE6OF02GYDOE.25.28.C06.1.454.CMB.1.raw
  modified_base (226)..(226): a, c, t, g, unknown or other
  misc_feature (226)..(226): n is a, c, g, or t
  modified_base (251)..(280): a, c, t, g, unknown or other
  misc_feature (251)..(280): n is a, c, g, or t
tcagactgtacagtcacgaccggtgctcgatttagagctcacgtattgggtttgggacagaattcactctcaccatcagcagcctgccagcctgaagatgttgcaacttattactgtcaaaaatttgacagtcgacccgtggatgttcggcccagggaccaaggtggacatcaaacgactgtcggctgccaccatctgtcttcatccttcccgcatctgactgacngtctgagcggctggcaggcacatgnnnnnnnnnnnnnnnnnnnnnnnnnnnnnn

SEQ ID NO: 251801 - DNA, 540 bp, Homo sapiens
  misc_feature: GYAE6OF02IIA7N.25.28.C06.1.454.CMB.1.raw
  modified_base (247)..(247): a, c, t, g, unknown or other
  misc_feature (247)..(247): n is a, c, g, or t
  modified_base (329)..(329): a, c, t, g, unknown or other
  misc_feature (329)..(329): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattnttggcctggtatcagcaagaaccagggtaacttcctaacctctcatctatgctgcatccatttgctaagtttcgggtccctntcgattcagcgcgtaggtggtctgggacagtacttcacgtctacactatcacgccacgcctcgcacgccgtagaagtatgttctactaacttattacttagtaacttaaaagttcgaacgtacgtacgtacccgtaggtacgttcggttaccggacccggtaacgggaccgtaagggtcggaacgtacgtaacgaaacggtacgtgtacgg

SEQ ID NO: 251802 - DNA, 581 bp, Homo sapiens
  misc_feature: GYAE6OF02IM9H8.25.28.C06.1.454.CMB.1.raw
  modified_base (201)..(201): a, c, t, g, unknown or other
  misc_feature (201)..(201): n is a, c, g, or t
  modified_base (332)..(332): a, c, t, g, unknown or other
  misc_feature (332)..(332): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgganacagagtcaccatcacttgccggcgagtcagggcattggaaattattggcctggtatcagcagaaaccagggtaaacgttcctaacctcctacatctatgctgcatccatttgctaagtttcgggaccctntcgattcgagcggtcaggttcggtcgtgggactagaatttccacgttctacacaatcgaacgtcacgtcctagccacgtacctagaagacgttgtcgtacctaactttattaccttagttaaacctaaaagttttcgaaacgttagtaccggtacccggttagtacggttaccggtttacccggacccgtaagggtaacccgtaaggggtaccgaaccgtagtaaccggaaacgtaccgtggttaccgg

SEQ ID NO: 251803 - DNA, 792 bp, Homo sapiens
  misc_feature: GYAE6OF02HSTMU.25.28.C06.1.454.CMB.1.raw
  modified_base (251)..(251): a, c, t, g, unknown or other
  misc_feature (251)..(251): n is a, c, g, or t
  modified_base (377)..(377): a, c, t, g, unknown or other
  misc_feature (377)..(377): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccnccagtgtccaggcaaggggctggagtggctgggattacttggtctgacagacaaatgacatatcacgcggagtccgtggacggggcattcactatctccgaggactaagttccaagacgaaccctntaactctagacaaaatcgaaactaacgttgaagtacgtacggaaggtaacgttaaccgggtaccgttttaaagttacgttaggtacgtacccggtaacccgttacgaacgggtaacgggttacgggacggtttaaacggggtaaaaaacggttccgggtttaaacgttcccgtttaccgttaaccgttttacccccgggttacccggtaacccgttccgggttaccggggggtaccccgtaacggggtaccccgtaaccccggttacgggttaccccgttaaccccgggttacccgttaccccgttaccgtaaccggtaccccgtttacccccgaacccggtaaacccggggtaccccgttaaccggtttccccgggtttaccccgttttcccccccggtacgggttccccccgg

SEQ ID NO: 251804 - DNA, 172 bp, Homo sapiens
  misc_feature: GYAE6OF02HLQSC.25.28.C06.1.454.CMB.1.raw
  modified_base (171)..(172): a, c, t, g, unknown or other
  misc_feature (171)..(172): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgaccgtggatgttcggcccagggaccaaggtgacatacnn

SEQ ID NO: 251805 - DNA, 467 bp, Homo sapiens
  misc_feature: GYAE6OF02HJG3K.25.28.C06.1.454.CMB.1.raw
  modified_base (202)..(202): a, c, t, g, unknown or other
  misc_feature (202)..(202): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
tcagactgtacagtcacgaccggtgctcgatttagagctcacgtattgggtttgggacgagaattcactctcaccatcagcagcctgcagcctgaagatgttcgcaacttatactgtacaaaatttgacagtgaccgtggatgttcggccctagggaccaaggtggacagttcaaacggactgtggctgcacatctgtcttnactcttccgcatctgaactgtacagtctagacgcggatggacaaggtccnaatagcangactnagcnacgtanactcncgatcgacgtacgcncgtacgngtcgngacganacncnctcgctcgtcgcacganactactacacacacgacgcacgacgacgcncacncncacgagagacgactanatanacgancncacancacncacgcncacagngacgacgcgacganagcgcgcgacncncgacgcgcncacncncacatc

SEQ ID NO: 251806 - DNA, 796 bp, Homo sapiens
  misc_feature: GYAE6OF02J3EVK.25.28.C06.1.454.CMB.1.raw
  modified_base (250)..(250): a, c, t, g, unknown or other
  misc_feature (250)..(250): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaatccctgagactctcctgtgtggcgcctagactcaccttcagtagttatggcttcgtctgggtccnccagtgtccaggcgaaggggtctgggagttggctgggagttacttgggtctgacagacaaatgacatactcacgcggagtccggtggacggggcctattccacctatcccgtaccgaagggtaaccaacgttccgaaaggaccgtaacccctctatcgtacgtacaaaagttcgaaaacctaacgttggaacgtacggtacggtaacggtaacgttaccgggtaccgttttaagttaccgttacggtacgtaccgtaacccgtcgaagggtacgttacgggtacgtaaaggtaaaacgttcgtaacggttccgtacgtaccgtttacccgtaccggtaacccgttccgggttaccgggggaaccctaccggggtaccctaaccccggtttccgggtaccctaccccgggtttacctaccccggttaccgtaaccggttaccccgtttaaccccggaaaccccgggtaaccccggggttaccccttaaccgggtttcccccgggtttacccccggtttacccccccggtagggtttacccccccggg

SEQ ID NO: 251807 - DNA, 270 bp, Homo sapiens
  misc_feature: GYAE6OF02G4HYY.25.28.C06.1.454.CMB.1.raw
  modified_base (264)..(270): a, c, t, g, unknown or other
  misc_feature (264)..(270): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttccactgtacagtctgagcgggctggcaaggcgcatagnnnnnnn

SEQ ID NO: 251808 - DNA, 736 bp, Homo sapiens
  misc_feature: GYAE6OF02HEACQ.25.28.C06.1.454.CMB.1.raw
  modified_base (336)..(336): a, c, t, g, unknown or other
  misc_feature (336)..(336): n is a, c, g, or t
tcagactgtacagtcacgaccggtgctcgatttagagctcacgtattgggtttgggggtcgagaagtctctctcagtcaggacacagcatggacatgagggtccctgctcagctcctgggactcctgctgctctggctcccagctatcagatgtggcatccagatcgacccagtctccatccctccctgtcctcgctactctggttaggagtaccagagttcaccatcctagttcggccgggcgagtcgagggcctagttagggtaatttagttggccgttggtatctaagacgaagaaaccgagggtaaacgttaccctaacctccgctatactntagtacctgaccacttcctacgttacgacttaacggtttccggggtcccgttctacgtacgtttaccgacggtccggtcgtaggggttcgggttcgtagggaaccgtaagtaacttaccgacttcctaccgtaacctacgttcaccggtacacgtccctcggccaacggtcccgttaggaaagtacgttcgttacggtacccttaacgtttaacttaccgttaagtaaactttaaaaagttcgtaaaccgttagggttaccggtaacccggttagggtaccgtttacggttaacccggggtaccccgtaaaacgggggtaccccgtaaaagggggtttaccggaaccgtaaaccgttaaacgggttaaaacccggtaccggtttaccgggttaaccgggg

SEQ ID NO: 251809 - DNA, 520 bp, Homo sapiens
  misc_feature: GYAE6OF02IAJS7.25.28.C06.1.454.CMB.1.raw
  modified_base (226)..(226): a, c, t, g, unknown or other
  misc_feature (226)..(226): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccattcacttgccggngagtcagggcattggaaattattggcctggtatcagcagaaaccagggaaattccaacctcctcatctatgctgcatccactttgctaatttcggggtccctctcgtatcngcgnagtgggtctgggacagattcactcncacatcagcagcctgcagcctgaagacttgttgactaacttattactgttaactaaaagtttgaacgagttcgacccgttggtacttggttccggacccgtacgggtaaccgaagggttcggaactacgtaccgtaaacgtaccgtaggtacgg

SEQ ID NO: 251810 - DNA, 650 bp, Homo sapiens
  misc_feature: GYAE6OF02JJX40.25.28.C06.1.454.CMB.1.raw
  modified_base (273)..(273): a, c, t, g, unknown or other
  misc_feature (273)..(273): n is a, c, g, or t
tcagactgtacagtcacgaccggtgctcgatttagagctcacgtattgggtttgggggcgagaagtctctctcagtcaggacacagcatggacatgagggtccctgctcagctcctgggactcctgctgctctggctcccagctatcagatgtggcatccagatgacccagtctccatcctccctgtctgcatctgttgagacagagtcacctatcacttgccgggcgagtcagggcagttgaaattatttggcctggtatcagtcaagaacnggaaagttccaacctcctacatctatgactgcatccgactttgactaagttttcggggtcccgttctcggtaactttccgaaggtcccgggtctaacggttggggttaccgtttagggggaccctaagggtaaacgttttccgaaccttcgtaccctaaccctagtaccgtaagaccgtaacggcccttaggcctaacggtcctacggtaaagaacgttgttacggacctaaacgttttaacgttaacttacgtacttaaaaaccgtttgtaaacctacggtacgtacccggttggaacctttcgggttaccggacccgtaacggggaccctaaagggtcggtaactaacggttacaaaacggtacttaggtacggg

SEQ ID NO: 251811 - DNA, 608 bp, Homo sapiens
  misc_feature: GYAE6OF02IFU2C.25.28.C06.1.454.CMB.1.raw
  modified_base (378)..(378): a, c, t, g, unknown or other
  misc_feature (378)..(378): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtggagtcgtgggggaggcgtggtccagcctgggaagtccctgagactctcctgtgtggcgcctagactcaccttcagtagttatggcttcgtctgggtccgccagtgtccaggcaaggggctggagtggctggggagttacttggtctgacagacaaatgacatatcacgcgagtccgagagggccattcgaccatcctccaagggacaattccaaagagaaaccctntaactctgacaaatgaaactacttgatagtcgagatacgctttatactgtagcactcgaggagtgactaggaaaaagtcggtaacgtctacactttacccgacgtaccgtacgttcgggccgacggtcctaacccgtggtaccgtaccggtcctccctactacgtaccttacccgacccgtaaccggtaccccacggttcccggtaccctttcccccgtacggtccccgg

SEQ ID NO: 251812 - DNA, 615 bp, Homo sapiens
  misc_feature: GYAE6OF02HJ02A.25.28.C06.1.454.CMB.1.raw
  modified_base (200)..(200): a, c, t, g, unknown or other
  misc_feature (200)..(200): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttgganacagagtcaccatcacttggccggcgagtcgagggctagttaggaaattattggcctggtactcgagtcagaaccagggtaacttcctaacctctcatctatgctgactactcctactttcgacttaggtttcggggtcccttctcgtacttcgacggtcggctaggtgggtacgtgggacagtaacttccacttcctacacctagtcagccgacgcctcgacctacgtccgtaagacgtacgttgttacgtaccttaacgtttactttaacgtacgtttaacttaaaacgtttcggaacctacggttaccggacccggtttaggtacgtttaccgggtacccggacccggtaacgggtaccggtaggtaccggtaacgtacgtaaccggtaaacggtaccgttaggtacccggg

SEQ ID NO: 251813 - DNA, 523 bp, Homo sapiens
  misc_feature: GYAE6OF02G9VQ5.25.28.C06.1.454.CMB.1.raw
  modified_base (248)..(248): a, c, t, g, unknown or other
  misc_feature (248)..(248): n is a, c, g, or t
  modified_base (422)..(422): a, c, t, g, unknown or other
  misc_feature (422)..(422): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttggccgggcgagtcagggcattggaaattnttggcctggtatcagcaagaaaccgagggtaaacttccctaacctcctacatctaatactgcatcctatttgactaagtttcggggtccctctcgtattcaggtcgctaggtgggtctgggactagtaacttcactctcacctatcagcacgcctgcacgcctagaagatgttnacgtaacttatactagtaactaaaatttgactagtcgaccgtgtatcggtcggccgaagggaccaaggtcggaactagtaccgaaacgtacgtggtgtacg

SEQ ID NO: 251814 - DNA, 604 bp, Homo sapiens
  misc_feature: GYAE6OF02H8ED4.25.28.C06.1.454.CMB.1.raw
  modified_base (186)..(186): a, c, t, g, unknown or other
  misc_feature (186)..(186): n is a, c, g, or t
  modified_base (265)..(265): a, c, t, g, unknown or other
  misc_feature (265)..(265): n is a, c, g, or t
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
tcagactgtacagtcacgaccggtgctcgatttagagctcacgtattgggtttgggggcagaagtctccctcagtcaggacacagcatggacatgagggtccctgctcagctcctgggactcctgctgctctggctcccagctatcagatgtggcatccagatcgacccagtctccactcctcccngtctgctatctgtaggagactagagcacatcacgttgccgggcagtcaggcattaggaactttagttcggccttggtancagacgaagaaaccgagggaaactttaccaacctacctcaatctaangctgcatccacttgactaagttcggggtccctntacgtactacgacgtcggacgttaaggtcgggtacgttaggggactaacggtaaacttctactaccgttcaacccgtatacggatccaggtcctcgacacgtccagtaaaggtatagttacgacttaacgttaactttacgtagtaaaccttaaaatttcgaaacgtacgtacgttacccggtacgttgtaccggttaccggacccgaaacgggtacctaaagggttcgaacgtactaacgaaacgtacgtagcgtacg

SEQ ID NO: 251815 - DNA, 261 bp, Homo sapiens
  misc_feature: GYAE6OF02JEFDC.25.28.C06.1.454.CMB.1.raw
  modified_base (258)..(261): a, c, t, g, unknown or other
  misc_feature (258)..(261): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctcgtgggggcacagcggccctgggctgcctggtcaaggactacttccactgtacagtctgagcgggctggcaaggcgcatagnnnn

SEQ ID NO: 251816 - DNA, 660 bp, Homo sapiens
  misc_feature: GYAE6OF02JUJUH.25.28.C06.1.454.CMB.1.raw
  modified_base (154)..(154): a, c, t, g, unknown or other
  misc_feature (154)..(154): n is a, c, g, or t
  modified_base (187)..(187): a, c, t, g, unknown or other
  misc_feature (187)..(187): n is a, c, g, or t
  modified_base (238)..(238): a, c, t, g, unknown or other
  misc_feature (238)..(238): n is a, c, g, or t
  modified_base (395)..(395): a, c, t, g, unknown or other
  misc_feature (395)..(395): n is a, c, g, or t
tcagactgtacagtcacgaccggtgctcgatttagagctcacgtattgggtttggggtcgtaggaagtcgtctctcagtcaggacacagcatggacatgagggtccctgctcagctcctgggactcctgcctgctctggctcccagctatcagntgtgcatccagatcgacccagtctccattcccnccgtgtctgaccatctgttgagacagacgtccacagtcacgttcgccgggngacgtcgacgggtctaagttgggaaatttacgttggtacccgtggttacttccgaggaccaagaaacccgagggtaaaacttcccgttaaacctcctacacgttctaagtacgcttagactacgtcctaactttcgactaacgtttccggtaccgtnttacggactttcgacgtcgtactacggtcggttctacgggactacgtaacgtttccgtaacgtacccttcgaccgtacttcgacgacgtacgccttacgcttacgacccgtgtaagtactttaggtactacctaactttacgttacgtacgttaataaaacgttttcgaacgtagttacgaaccgttggtaattcgggttaacccgacggtaaccggtacgttaaacggtggtaaccgacttaaccggaaagtacctagggtacg

SEQ ID NO: 251817 - DNA, 536 bp, Homo sapiens
  misc_feature: GYAE6OF02HCT3J.25.28.C06.1.454.CMB.1.raw
  modified_base (244)..(244): a, c, t, g, unknown or other
  misc_feature (244)..(244): n is a, c, g, or t
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacttgccggcagtcagggcattggaaattntttggccttggtatcagcaagaaaccgagggtaaacgttcctaaacctcctcaatctancgctgcatccatttgctaagtttgggccctntcgtattcagcgcaggtcggtctagggacagtaacttcactacgtcacatcagcagctgcagcctagatatgtgactaacttacttacgtagttaactaaaagttcgaactagtacgacccggttagtacgttcggttaccggacccgtaacgggtaaccgaagggtacgaccgaacgtaaccgaaacggtacgtgtaccgg

SEQ ID NO: 251818 - DNA, 220 bp, Homo sapiens
  misc_feature: GYAE6OF02HRVOO.25.28.C06.1.454.CMB.1.raw
  modified_base (220)..(220): a, c, t, g, unknown or other
  misc_feature (220)..(220): n is a, c, g, or t
tcagactgtacagtcacgaccggtgctcgatttagagctcacgtattggggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagn

SEQ ID NO: 251819 - DNA, 647 bp, Homo sapiens
  misc_feature: GYAE6OF02F4BUX.25.28.C06.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccatcctcctgtctgcatctgtganacagatcacatcacgttggccggngagtcgagggcagttaggaatttgttcggcctggtatcagcaagaaacgagggtaacttcctaacctcctactatctactgctgctactcctacttgactacggtttcgggtcctcgtacgtacttcgacggtcgtacgtaggttcgggtacgtagggaactaaggtaaacttcgtaaccttccgtactaacccgtagtaccgaacgtcccaacggtcccgttacgccgtaaccgtccgtaacggtaaacgtcgtttacgttaccgtaacttaacgtttacgttaacttagttaaaacgttaaactttacgaaacgtaggttacccgtacggtaggtacgtttccggttaaccggacccggtaacgggtaaccggtagggtaccgtaactaacgtaacccgtaaaggtaccgttaggtacccgg

SEQ ID NO: 251820 - DNA, 803 bp, Homo sapiens
  misc_feature: GYAE6OF02JVVPD.25.28.C06.1.454.CMB.1.raw
  modified_base (208)..(208): a, c, t, g, unknown or other
  misc_feature (208)..(208): n is a, c, g, or t
tcagactgtacagtcacgaccggtgctcgatttagagctcacgtattgggtttgggggcagaagtctctctcagtcaggacacagcatggacatgagggtccctgctcagctcctggactcctgctgctctcggctcccagctatcagatgtggcatccagtatcgacccagtctccactcctccctgtctgcctattcgtgttgganactagacgtcaccctatccacgtttcggacccgggctaaggtaccgacggggtctagtttacgggtaaaattttcggtttcgggcccttgggtaacttcgaaggtacctaaaacgggtaaacccggtaaggggtaaaacctttccccgtaaaaccttcccgttaacaagtttccttaaagtcggtaccttaggaccacctttaccgtaacgttttcgaaccgtttaagttttccgggggtacccccttagttaacccgttaacgtttcgtaaccggtcggtaccgttagggttccggggttactacgggggtaactaacggttaaacgtttccctaaaccgtttcccgtaaccctaccgtaagttacccgtaacgaccgttacgcccgttagacccgtaacgtccctaagggtaactacgtttcggaacttaaccgttacctttaaactttacgacgtttaaacttaaacgtttacgaaccgttagggacccttaggttacgggttaacttccgggttacccggtaacggtaaaccggtacggtaaagggttcgaacctaacggtaacccgtaaacggacgtttacgggtaccgg

SEQ ID NO: 251821 - DNA, 617 bp, Homo sapiens
  misc_feature: GYAE6OF02GAJM8.25.28.C06.1.454.CMB.1.raw
  modified_base (309)..(309): a, c, t, g, unknown or other
  misc_feature (309)..(309): n is a, c, g, or t
tcagactgtacagtcacgaccggtgctcgatttagagctcacgtattgggtttggggggaagtaggaagactgacggtcctcccaggagttcaggtgctgggcaccttgagcactgaacgcagcggactcaccatggagtttgggctgaactgggttttcctcgttgctctttaagaggtgtccagtgtcaggcgcatctggtggagtcgtgggggagcggtggtccagccgtgggaacgtccctgagactctcctgtgtggcgcctagactcaccttcagttagttatggtcttcgtcgtgggtcccnccagtgtccaggcaaggggctgggagtggcgtggggagtttacgttgggtctgacgagaacaaatgaacatatcgacggcggagtccgtggacggggccatttccacctatccgtaccgacgggactaacttaccgaaagacgaaaccctctactctagactaaagtacgaaacctaactttagaagtagtacggaggtaacgtacggtaccgtttaattacgtgtcgacgacctcgaggacggtggtacgtaagggtaaaagttcgtaagtctacgtaccttcccggtccgtaccgtacgtccgggg

SEQ ID NO: 251822 - DNA, 579 bp, Homo sapiens
  misc_feature: GYAE6OF02HLTWP.25.28.C06.1.454.CMB.1.raw
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccattcacatctccgagggacaattccaagacgaaccctctatctgacaaatgaaacacttgagagtcgaggatacggtcgtttattactgtgcgactcaggagtggctaggaaaagtcgtaagtctactacttcccgtcgtacctcgtcggggccagggccacccgttggtacctaccgtccgtcctccacgtccttcccgaccgtaacggccctacgtcccggtccttcccccgtggtccccg

SEQ ID NO: 251823 - DNA, 257 bp, Homo sapiens
  misc_feature: GYAE6OF02GPZ5Q.25.28.C06.1.454.CMB.1.raw
  modified_base (220)..(221): a, c, t, g, unknown or other
  misc_feature (220)..(221): n is a, c, g, or t
  modified_base (223)..(257): a, c, t, g, unknown or other
  misc_feature (223)..(257): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnngnnnnnnnnnnnnnnnnnnnnnnnnnnnnnnnnnnn

SEQ ID NO: 251824 - DNA, 539 bp, Homo sapiens
  misc_feature: GYAE6OF02JEJ7T.25.28.C06.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (339)..(339): a, c, t, g, unknown or other
  misc_feature (339)..(339): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgganacagagtcaccatcacttgccggcgagtcagggcattaggaaattnttggctggtatcagcaagaaaccagggtaaacgttcctaacctcctacatctaatcgctgcatcctactttgactaagttttcggggccctntcgattcagcgcagtgggtctagggacagtacttcactctacaccatcagcacgcctgaccacgcctagagattgtagtactaactttattacttagtaactaaaagtttgaactagtacgtaccgtaggtacgttcggttaccggacccgtaaggtaccgtaaggtcggaacgtacgtaacgaaacgtacgtggtacgg

SEQ ID NO: 251825 - DNA, 628 bp, Homo sapiens
  misc_feature: GYAE6OF02JZ2DK.25.28.C06.1.454.CMB.1.raw
  modified_base (383)..(383): a, c, t, g, unknown or other
  misc_feature (383)..(383): n is a, c, g, or t
  modified_base (461)..(461): a, c, t, g, unknown or other
  misc_feature (461)..(461): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggagcgtggtccagcctgggaagtccctgagactctcctgtgtggcgcctagactcaccttcagtagttatggcttcgtctgggtccgccagtgtccaggcaaggggctggagtggctgggagttacttggtctgacagaacaaagtgacatatcaacgcggagtccggtagacggggccattcaccatcctcgagggacattacccgaagacgaaccctntatcgagacaaagtcgaaactacgttagacgtagtacgaggtagtaccggtcgtttattacgtgtagcgacctgaggngtcgacgtaggaaaagtcgtagtctactacgttccgtacgtaccgtacgtcgggaccgtacgggcctaccgtcgtaccgaccgttccgtccttaccgacgtcccgtacccgaaccggtaaccgggtacccaccggttacccggtcccttccccggtcggtaccccgg

SEQ ID NO: 251826 - DNA, 574 bp, Homo sapiens
  misc_feature: GYAE6OF02JCQIE.25.28.C06.1.454.CMB.1.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (350)..(350): a, c, t, g, unknown or other
  misc_feature (350)..(350): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttgganacagagtcacctatcacttggccgggngagtcgagggctaagttaggaaaatttatttggccttggtaatcagtcaaggaaaaccagggtaaacgttcctaaccgtcctacatctatgctgcatcctatttgactagttttcgggccctntcgacttacgagcggtacacggtgggtactagggacctagtaacttcgactctacacgtatcgagacacgtcctgctacgccgtagaagtacttggttacaccgttaactttacgttacgtacgttaaacttaaaagttcgaacgtagttaccgacggtagtacgttcggttacgaccgaacgggtacaaggttcgaactagaaccgtaaaccgtagtggtacg

SEQ ID NO: 251827 - DNA, 584 bp, Homo sapiens
  misc_feature: GYAE6OF02H9IJ9.25.28.C06.1.454.CMB.1.raw
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (437)..(437): a, c, t, g, unknown or other
  misc_feature (437)..(437): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggattacttggtctgacagacaaatgacatatcacgcggagtccgtgaggggccgattcaccatctccagggacaaattccaaagagaaccctntaatcngcaaaatgaacaacttgaagagtcgaggatacggtccgtttattactgtgcactnaggagtggcaggaaaagtcgtagtctctattcccgtacgacctctggggccagggcctaccgtcggtccacccgtcgtccctactacgtccttacccgaccaacgggtccccaacgttccggtccctttccccccggtgtcccccgg

SEQ ID NO: 251828 - DNA, 866 bp, Homo sapiens
  misc_feature: GYAE6OF02IV02D.25.28.C06.1.454.CMB.1.raw
tcagactgtacagtcacgaccggtgctcgatttagagctcacgtattgggtttgggggtaaggagggaagacgtgacggtcctcccaggagttcaggtgctgggcaccttgagcactgaacgcagcggactcaccatggagtttgggctgaactgggttttcctcgttgctcttttaagaggtgtccagtgtcaggcgcatctggtggagtcgtgggggaggcgtggtccagccgtgggaagtcccgtgacgactctcctgtgtggcgcctagactcacttccagttagtatggtcttcgtcttgggtccgccgtagtcgtcccgagggtccaaacgggggtcgtacgggaggttcgggccgttagggggattttacggttggggtccgttggaccgtaaggtaaccgtaaagtggaacctaagttactcgaaccggtcgggaacgttcccggtagggaacggggtcccggtaacgtttacccgaaccgaaccgttccggtaccccgtaacggggtaaccctaaacggttacccgtaaacggtaaccgtaaaaccccgttcctaaccgttacgttaacggtacctaaaacgttaccgtaaaccaaacccgtttaagaacggtaacggttacgggaaacgggtaaccgttaaccggggtacccgtttttaaacgttaaccgtttcggttaaaccggttaccggttaacccgtaccgaaacggggtttaacgggtacccgggtaacggtttaaacggggtaaaaaaccgggtttaccggtttaaccggttaaccggtttcccgtaaaccccggtttttaccccgggtaccccggtttaaaccccggttcccggttaacccgggggggg

SEQ ID NO: 251829 - DNA, 565 bp, Homo sapiens
  misc_feature: GYAE6OF02HSAZP.25.28.C06.1.454.CMB.1.raw
  modified_base (433)..(433): a, c, t, g, unknown or other
  misc_feature (433)..(433): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctggggagttacttggtctgacagacaaatgacatatcacgcggagtccgtgaggggcagttccacatctccgaggacaattccaagacgaaccctctatctgacaaatgaactacttgagagtcgaggatacggcgtttattactgtgcactnaggagtgactagaaaagtcgtagtctactagttcccgtcgtactcgtcgggccgacggctaccgtgtaccaccgtcgtcctcacgtcctaccgaccgacggccctacgtccggtcccttccccgtcgtcccg

SEQ ID NO: 251830 - DNA, 569 bp, Homo sapiens
  misc_feature: GYAE6OF02IIAD9.25.28.C06.1.454.CMB.1.raw
  modified_base (252)..(252): a, c, t, g, unknown or other
  misc_feature (252)..(252): n is a, c, g, or t
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
  modified_base (480)..(480): a, c, t, g, unknown or other
  misc_feature (480)..(480): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtcccnccagtcgtccaggcaaggggctggagtggctgggagttacttggtctgacngacaaatgacatatcacgcggagtccgtgaggggccattcaccatctccagggacaattccaaagacgaacccctntaatctgacaaatcgaaacaacttgagagtcgaaggtatacggtacgtttaattacttagtgtcgacctcaggagtggcgtaggaaaacgtcgtaagtctntacttcccgtcgacctcgtcgggccaggccacctggtaccaccgtctcctcagtcctccacgacggccacgtccgtctcccctgtcccg

SEQ ID NO: 251831 - DNA, 614 bp, Homo sapiens
  misc_feature: GYAE6OF02HIIG8.25.28.C06.1.454.CMB.1.raw
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctggggggaggcgtggtccagcctggggaagtccctgagactctcctgtgtggcgcctagactcaccttcagtagttatggcttcgtctgggtccgccagtgtccaggcgaaggggctggagtggcgtggggattacgttggtctgacagacaaatgacatatcacgcggagtccgtgacgggccattcacatcctcgaggacaattaccaagacaacctctatctagacaaatagaactactagagtacgtacgagtaacgtacggtccgtttattacgtgtcgaccgactcgaggtacgtggtacgtaaggtaaaacgtcgtacgtctacgtaccgttcccgtacgtaccgtcggtacgggaccgacggtcctaccgtcgtaccgaccgttcctcctcgacgtaccctccgaaccgacggaccctacgttccggtcccgttccccgcggtcccgg

SEQ ID NO: 251832 - DNA, 221 bp, Homo sapiens
  misc_feature: GYAE6OF02FWW3U.25.28.C06.1.454.CMB.1.raw
  modified_base (212)..(212): a, c, t, g, unknown or other
  misc_feature (212)..(212): n is a, c, g, or t
  modified_base (218)..(221): a, c, t, g, unknown or other
  misc_feature (218)..(221): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcacagcggccctgggctgcctggtcaaggctacttccactgtacagtctgagcgggctggcaaggcncatagnnnn

SEQ ID NO: 251833 - DNA, 553 bp, Homo sapiens
  misc_feature: GYAE6OF02GNJS0.25.28.C06.1.454.CMB.1.raw
  modified_base (202)..(202): a, c, t, g, unknown or other
  misc_feature (202)..(202): n is a, c, g, or t
  modified_base (342)..(342): a, c, t, g, unknown or other
  misc_feature (342)..(342): n is a, c, g, or t
  modified_base (397)..(397): a, c, t, g, unknown or other
  misc_feature (397)..(397): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctccctgtctgcatctgttgganacagagtcaccatcacttcgccgggcgagtcagggcattggaaatttattggccttggtatcagcagaaaccagggaagttccaaccgtcctacatctatcgcttgcatcctacttcgctaagttttcggggtacccttntcgtattcgaggccgctaggtgggtctgggacagtaattcactctacacatcgancagcctgccagccgtagaagtagtagttcgtactaactttacttacttagtaacttaaaattcgaacgtagtcgtaccgttggtacgttcgggtaccgacccggaacgggtaaccgtaagggtagtaccgtaagtaccgaaacgtacgtagtacgg

SEQ ID NO: 251834 - DNA, 662 bp, Homo sapiens
  misc_feature: GYAE6OF02H8QVN.25.28.C06.1.454.CMB.1.raw
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggctttcgtctgggttccgccagtgtcccagggcaaggggctggagtggcgtggggagttacttggtctgacagacaaatgacatatcacgcggagtccgtggacgggccattcaccacttccgtaccagggaactaacgttaccaaacggacgaaccccttctacttctagacaaatacgaaacaaacgtttggaagtacgtcggaggtactacgggtaccgttttagttacttcggtacgaccgtaccgtacgaggtagtcggacgtaagggtaaaacgtcgtaacgtcttactacgttcccgtacgtaccgtcggtcgggtccgacggtccgtacccgttcggtacctacccgtcctccgtcctacgtaccgttacccgaccgtaaccggccctaccgttccggttcccttccccgtcggtccccg

SEQ ID NO: 251835 - DNA, 601 bp, Homo sapiens
  misc_feature: GYAE6OF02F7G3A.25.28.C06.1.454.CMB.1.raw
  modified_base (203)..(203): a, c, t, g, unknown or other
  misc_feature (203)..(203): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctccctgtctgcattctgttgganacagagtcacatcacttgccgggcgagtcgagggctagttaggaaatttagtttcggccttggtatcgagtacgaacgaaaaccgtagggtaaacgttaccctaaccctctactatctatcgctcgctactcctatttgacttagtttcgggacccttctacgtattcgaggtcgcgtagggttcggtcgtagggactagtaatttccgacttctaccaacctataccagccagtcctggtaccacggctagaacgtgttagttcgaccttaattttatacttaacgttaattaaagttcgaactagttacggacccgttaggacttcgggtcccggaaccggtaacggaccggtaaggtcgaacgttaagaacccgtaaaggtacgtagggttaccg

SEQ ID NO: 251836 - DNA, 222 bp, Homo sapiens; identical to SEQ ID NO: 251346
  misc_feature: GYAE6OF02FNHN1.25.28.C06.1.454.CMB.1.raw
  modified_base (219)..(222): a, c, t, g, unknown or other
  misc_feature (219)..(222): n is a, c, g, or t

SEQ ID NO: 251837 - DNA, 614 bp, Homo sapiens
  misc_feature: GYAE6OF02GOUQR.25.28.C06.1.454.CMB.1.raw
  modified_base (383)..(383): a, c, t, g, unknown or other
  misc_feature (383)..(383): n is a, c, g, or t
tcagactgtacagtcacgaccggtgctcgatttagagctcacgtattgggtttggggggaagaggaagactgacggtcctcccaggagttcaggtgctgggcaccttgagcactgaacgcagcggactcaccatggagtttgggctgaactgggttttcctcgttgctcttttaagaggtgtccagtgtcaggcgcatctggtggagtctgggggagcgtggtccagcctgggaagtccctgagactctcctgtgtggcgcctagactcaccttcagtagttatggcttcgtctgggtccgccagtcgtccaggcaaggggctgggagtggctggggattacgttggtctgacagaacaaatgacatatcacgcggagtccgnggacggggctatcacactctccgagggactaacttccaagacgaaccctctaactctagacaaatacgaaactaacttagaacgtagtacgaaggtacgttacggtaccgttttaacttacgtacgtacgtaccgtaccgtacgaggtacggtcgggacgtaacgggtaaaacggttcgtaaggttaccgttacgtaccgttacccggtaccgtaccgttcggtaccgggg

SEQ ID NO: 251838 - DNA, 718 bp, Homo sapiens
  misc_feature: GYAE6OF02I651R.25.28.C06.1.454.CMB.1.raw
  modified_base (171)..(171): a, c, t, g, unknown or other
  misc_feature (171)..(171): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgaacccngtctccattccctcctgtctgactattctgttaggagacagacgtcacctatcctacgttcggaccgggcgtacgtccgagggctaaggttaggtaaaatttagtttcggccgttaggttactacgaagaccgaaacggaaaaccgtaagggtaaaaccgtttcctaaacccttcctactaacttctaagtcggctacgtacctacttaccttacgtttacggacgttaaggttttccggggtaccccttagttacggtaacttcggacggacgtcgtacggtgggttcgtagggacgtagtacgttaccacgttacctactaacccgtagtacgaacgaccgtacgaccgtacgtcgaaccgtccgtaagtaacgtgttacgttacgtaccttaaacgtttaacgttacgttaacgtaaacttaaacgttacgtaacgtacgttacggacccgttagtacggttccggttccggaacccggtaaaggtaccgtaacggtacggtaacctaaccggttaacgtaaaccgggttacgtacggtaccgg

SEQ ID NO: 251839 - DNA, 608 bp, Homo sapiens
  misc_feature: GYAE6OF02IL17Q.25.28.C06.1.454.CMB.1.raw
  modified_base (201)..(201): a, c, t, g, unknown or other
  misc_feature (201)..(201): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgganacagagtccaacctatccacttggccggcgagtcagggcagttaggaaattatttggccttaggtatcagtacaaggaaaccaaggggtaaacttcccgtaacctcctacactctatgctgctactcctactttgacctaagttttcgggggtcccttacgtcgtacttcgagtcggctaggtcgggtcgtagggactaggtaactttcgactactcgacctatcagacacgtcctagcacgtccgtagaagtagtgttacgaacttaacgtttattaacgttagttaaaccttaaaatttcgaacgtacgttaccggtaccgtagggtacgttcggttaccggacccggtaacggtaccgtaaagggtcgtaacctaagtaaccggtaaacgtacgtacggtacgg

SEQ ID NO: 251840 - DNA, 498 bp, Homo sapiens
  misc_feature: GYAE6OF02GY1YM.25.28.C06.1.454.CMB.1.raw
  modified_base (201)..(201): a, c, t, g, unknown or other
  misc_feature (201)..(201): n is a, c, g, or t
  modified_base (336)..(336): a, c, t, g, unknown or other
  misc_feature (336)..(336): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgganacagagtcaccatcacttgccgggcgagtcagggcagttggaaattatttggcctggtatcagcagaaaccagggaaagttcctaaacctcctacatctatgctgcatcctatttgactagtttcggggtccctntcgattcagcgcagtggtctggacagtattcgactctcacntcagcagcctgcngctgantgtnactattatactgtaactaaatttgaactagtcgaccgtgtagtcgttcggacccgagggaccgtaaggtacggactacgtacgaaacgacgtgtacgg

SEQ ID NO: 251841 - DNA, 254 bp, Homo sapiens; identical to SEQ ID NO: 251477
  misc_feature: GYAE6OF02HDNAK.25.28.C06.1.454.CMB.1.raw
  modified_base (253)..(254): a, c, t, g, unknown or other
  misc_feature (253)..(254): n is a, c, g, or t

SEQ ID NO: 251842 - DNA, 819 bp, Homo sapiens
  misc_feature: GYAE6OF02JH5M3.25.28.C06.1.454.CMB.1.raw
tcagactgtacagtcacgaccggtgctcgatttagagctcacgtattgggtttggggcagaagtctctctcagtcaggacacagcatggacatgagggtccctgctcagctcctgggactcctgctgctctggctccagctatcagatgtggacatccagatcgaccagtctccattccgtccgtagtctgacagttctggttggagacagtacgtccaccagtcctacgttcgaccgggcaagtccgaaggcctagttaggtaaactttagtttcggccgttaggttactacggaagtaccggaaaagtaaacccggaaggggtaaaaccgttttacccgtaaacccgttccttaacccggatttaaccttaacgttcggtaactttcggacctaacttcccgtaacgtttacgtaccgtaaacgggttttttccgggaccccttgttaaccgtcgtttacgacggtccggtaaccgtagggttcgggttaccgtacgggtaactaagttacctttacaccgttcctacctaaacggtctaacgtcgggaactcccgacgttacgacccgtagtacccgtagtaacgtcggtttacgttaccgaaacgtttaacttttaccggtttaacgtaaccgtttaaacggttaaaactttacggtaaccgttaacgtacccgggtttacccgtaagggttcccgtttaaacggggtccccgtaaacccgggggtacggtttaaacccgggcggtttaaaacccgggggtactttaaacccggaaccggttaaaacccgggttaccggtttaagttacccgggg

SEQ ID NO: 251843 - DNA, 620 bp, Homo sapiens
  misc_feature: GYAE6OF02JCISY.25.28.C06.1.454.CMB.1.raw
  modified_base (153)..(153): a, c, t, g, unknown or other
  misc_feature (153)..(153): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (450)..(450): a, c, t, g, unknown or other
  misc_feature (450)..(450): n is a, c, g, or t
tcagactgtacagtcacgaccggtgctcgatttagagctcacgtattgggtttgggggcagaagtctctctcagtcaggacacagcatggacatggagggtccctgctcagctcctgggactcctgctgctcgtggcctcccagctatcagtntgtggcatccagatcgacccagtcctccactcctcctgtctgctactcgttggttggagacaggtactaccaacctatcctacgttcggcccgggtcgagtcgaagggtctagttaggtaaatttcgtcggtctaggtactcgagtacaacgtaaccgaaggtaaccttaccgaacctcttacncgtactagtcnctactactactactatacgtacgttacggttccggtctagtacgtacgtacgacgtcggtactacgggtcggtacgtacggatacgtactacactctctacncgtacgacgcacgtcgcgacgtacgtacgtagtacgtagtacgtacgtaacttacgttaacttacgttaacgttaacgtaactacgtacgtagtacgtacgtagtacggtccgtacggacgtaacggtacgtaacggtacgtaacgtaaccgacgtaacgtacgtagtcg

SEQ ID NO: 251844 - DNA, 739 bp, Homo sapiens
  misc_feature: GYAE6OF02GUJH1.25.28.C06.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttgganacagagtccaccatcacttcggccggngagtcgagggctagttacggtaaatttagttcggaccgtggttatcgagcgaacgtaaacgagggtaaacgttccctaaaccttcctactaacttctaagtcgctagacctacttaccctacgtttcgtacgttaacggttttcggggtccccttacgttcggttaactttcgaacgggtccggtacgttaacgggttcggggttaccgtaacggggaaccgtaaggttaaaacctttcctaaaccgtttccgtaacctaacccctaagttaccgaacggtacccgtaacgtcccgttacgaccgttaacggcccttaagggtaaacgtacggttacggttaccgtaaaccttaacgttttacctttaacgtaacggtttaaactaaaagttttcgaaaccgttacgtaccggtaacccggttgggtaacgttccgggttaacccggacccggtaaagggtaaccgtacggtacgacgtaaccgtaacgtaaacgtaccggtaggtaccgg

SEQ ID NO: 251845 - DNA, 563 bp, Homo sapiens
  misc_feature: GYAE6OF02GUBNT.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacgttgccgggcgagtcagggcattaggaaattatttggcctggtatcagcaagaaaccgagggaaacgttcctaacctcctactatctatgctgcatccactttcgacgtaacgttttcggggtcccgttctcgtacttcaggcgtcaggtcgggtcgtgggacagtacttcgactctcaccagtcgagcacgccgtgccagcctaggaatagtgtacgtactaactttacttacgtagttaactaaaatttcgaataggtacgtacccggtggtacgtcggttaccggacccgacggggtaaccgaagggtacggacgtaacgtaccaaacggtacgtaggtacgg

SEQ ID NO: 251846 - DNA, 251 bp, Homo sapiens
  misc_feature: GYAE6OF02IZ0VX.25.28.C06.1.454.CMB.1.raw
  modified_base (243)..(243): a, c, t, g, unknown or other
  misc_feature (243)..(243): n is a, c, g, or t
  modified_base (249)..(251): a, c, t, g, unknown or other
  misc_feature (249)..(251): n is a, c, g, or t
tcagactgtacagtcacgaccggtgctcgatttagagctcacgtattgggtttgggacagaattcactctcaccatcagcagcctgcagcctgaagatgttgcaacttattactgtcaaaaatttgacagtgaccgtggatgttcggcccagggaccaaggtggagatcaaacgaactgtggctgcaccatctgtcttcatcttccgcatctgaactgtacagtctgagcgggctggcaggcncatagnnn

SEQ ID NO: 251847 - DNA, 585 bp, Homo sapiens
  misc_feature: GYAE6OF02F1E93.25.28.C06.1.454.CMB.1.raw
  modified_base (252)..(252): a, c, t, g, unknown or other
  misc_feature (252)..(252): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttggtgctctgggcaccgtggagtctgggggaggcgtggtccagcctgggaagtccctgagactctcctgtgtggcgcctagactcaccttcagtagttatggcttcgtctgggtccnccagtgtccaggcaagggggctggagtggctgggagttacttggtctgacagacaaatgacatatcacgcggagtccgtggagggccgattcaccatctccgaggacaattccaagacgaaccctctaatctagacaaatgaaacaacttgagagtacgaggatacggtacgtttattactgtgccgacctacgagagtggactaaggaaaagtcgtagtcctacgtattcccgtcgtacctcgtcgggaccgacgggcctacccgtggtccaccgttcctcctcacgtccttaccgaccacggaccctactccggttacccttccccgtcgg

SEQ ID NO: 251848 - DNA, 645 bp, Homo sapiens
  misc_feature: GYAE6OF02JA928.25.28.C06.1.454.CMB.1.raw
  modified_base (128)..(128): a, c, t, g, unknown or other
  misc_feature (128)..(128): n is a, c, g, or t
  modified_base (348)..(348): a, c, t, g, unknown or other
  misc_feature (348)..(348): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctgggggnggcgtggtccagcctgggaagtccctgagactctcctgtgtggcgcctagactcaccttcagtagttatggcttcgtctgggtccgccagtcgtccaggcaagggggctggagtggctgggagttactggtctgacagacaatgacatatcacgcggagtccgtggaggggccgagttccaccatctccagggacaacttccaagaacgaaccctcttanctgacaaatacgaactaacttacggagtaagtcgaaggtacgtaccggtcgttttaagttactcggtgccgaccgtcgacggtagtggtacgtaacggaaaagtcgtagttctctacgttcccgttcgaccgttcgacggggccgagggaccgacccgtcggtccgtaaccgtccttccgtactacgccgttacccaaccgaccgggccctacgtaccggttcccgttcccccgtacggcccgacccgttcgcccgtaccgtacgggcgacccgtaccgtccggtacgggtacccgg

SEQ ID NO: 251849 - DNA, 797 bp, Homo sapiens
  misc_feature: GYAE6OF02JUSO2.25.28.C06.1.454.CMB.1.raw
  modified_base (210)..(210): a, c, t, g, unknown or other
  misc_feature (210)..(210): n is a, c, g, or t
tcagactgtacagtcacgaccggtgctcgatttagagctcacgtattgggttggggcagaagtctctctcagtcaggacacagcatggacatggaggtccctgctcagctcctgggactcctgctgctctggcctcccagctatcagatgtggcatccagatcgacccagtctccactccctcccgtgtctagccattcgtcgttggaanacagacgtcaccagtccagttcggacccggagtacgtcgaacgggtctaagtttaggtaaaacttttgttacggccgtaggtactcgaacgacctaaaggaaacccggtaaggtaaacctttcccctaaaccgttcccctacacgttaccttaagtcgccgtacgaccttacgtaccttacgtttacggtaccttaacggggtttttccggggaccccctttacgttacgtaccggtttacccgacggtccggtaccggtttaacgggggttcgggttaccgggttaacgggaaacccggtaacggttaaaccgtttacccgtaaccgttccctaccgtaacccgttaccgaccgtacgtacccgtaccggtcccgttaccggaccgtaccgtaacccgtcgtaaacggttacgttacggtttaaccgtaccttaacgtttaaccgttaacgttacgttaaaccgtaaagtttacgaacgttaaccggttaccgtaccgtacggttacgttaccggttacccggtcggtaaccggtaacggtaacggtacgtaacgtaaccgtaacgtaaccgtaggtaacgtccgg

SEQ ID NO: 251850 - DNA, 261 bp, Homo sapiens
  misc_feature: GYAE6OF02GE3SK.25.28.C06.1.454.CMB.1.raw
  modified_base (254)..(261): a, c, t, g, unknown or other
  misc_feature (254)..(261): n is a, c, g, or t
tcagactgtacagtcacgaccggtgctcgatttagagctcacgtattggggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccagtctgtcttcatcttcccgcatctgaactgtacagtctgagcgggctggcaaggcgcatagnnnnnnnn

SEQ ID NO: 251851 - DNA, 255 bp, Homo sapiens; identical to SEQ ID NO: 251648
  misc_feature: GYAE6OF02JBRWC.25.28.C06.1.454.CMB.1.raw
  modified_base (252)..(255): a, c, t, g, unknown or other
  misc_feature (252)..(255): n is a, c, g, or t

SEQ ID NO: 251852 - DNA, 740 bp, Homo sapiens
  misc_feature: GYAE6OF02J2J2P.25.28.C06.1.454.CMB.1.raw
  modified_base (123)..(123): a, c, t, g, unknown or other
  misc_feature (123)..(123): n is a, c, g, or t
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (513)..(513): a, c, t, g, unknown or other
  misc_feature (513)..(513): n is a, c, g, or t
tcagactgtacagtcacgaccggtgctcgatttagagctcacgtattgggtttggggcagaagtctctctcagtcaggacacagcatggacatgaggtccctgctcagctcctgggactcctnctgctctggctccagctatcagatgtggcatccagactgacccagtcctccatcccgtcctgtctgcntctgttgganaccagcgtccacctatccacgtttcggccgggtcaaggtccgagggtacctagtttagggaaaacttttcgtttcggcccgttaggttaacttccgacgtacaaagggtaaaaccccgtagggtaaaaactttccccaaaacgttcccctcgtaaattccggtaattggaccctgtacctaattccctaacgttcgacgttaaacggtttttccggggtaccctcgtacggttactttcgaacgggtacggtcctaagggtttccgggttagcgggtaactaagtacgttaccgtacttcgtacctaacctntaccgacgtcgaaccgtcctaggtacccgacggtcccttaaggacgttacgttacggttacaacctttaacgtttacggtttaactaaccggttaaattaaaacgttttcgaaccgttaaggtcccgtaacggttcgttacgttccgggtacccggtaccggtaccgggttaaacgacgggtttacggaccgtaacgtaaccggtaaacgtaccggttacggtccgg

SEQ ID NO: 251853 - DNA, 581 bp, Homo sapiens
  misc_feature: GYAE6OF02IFHYC.25.28.C06.1.454.CMB.1.raw
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctccctgtctgcatctgttggagacagatcaccatcacttgccgggcagtcagggctagttaggaaatttgttggccttaggtatcagacaagaaaccgtagggtaaacttcccctaacctcctactatctatgctgctatcctatttgacttagtttcgggtccctntcgtattcaggcgganaggttcggtctgggaacagtacttcactctacactatcacgtcgacgcctgaccacgtccgtaggtaactacgttgtacgtaccttaacttttacgtacttacgttaaacttaaaatttcgaaactacggtaccgtacccggtggtacgttacggtcccggaaccggaaccgggtaccgaagggtacgaacacgtaacgaaccggttacgtggtacgg

SEQ ID NO: 251854 - DNA, 816 bp, Homo sapiens
  misc_feature: GYAE6OF02H6TDF.25.28.C06.1.454.CMB.1.raw
  modified_base (203)..(203): a, c, t, g, unknown or other
  misc_feature (203)..(203): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccatccctccctgtctgcatctgttgganacagacgtccacctatcacgttcggccgggcgacgtcgagggtctaagtttaggtaaatttagtttcggccgtttaggtaactcgaacggacaacggaaaaccggaagggtaaacgtttacccctaaacccgttcctacgtaacttacgttattcgtacgtcgtacctacttccgttacgtttcgtacgttaacggttttccggggttcccctcgtttacggtacttaccggacgggtccgtacgttagggttcggggttacgtacggggaactaacggttaactttacccgacttcccgtaaccgtaacctacttaccgaacgtaccgtacgtcccttaggacccgtaacgtacccggtaaaggtaaacggttacgtttcgggtttaacctaaccgtttaaacgtttttaaaccgtttaaccggtttaacgttttaaaacccgtttaaaaacggttttccgaaaccgggttaacggttacccgggttaaccccggttaggggttaaccgtttaccggggttacccgggaacccgggttaacgggtaaccggtaacgggttacgtaaccggttaacctaaacccggtaaaccggttaccgttagggtacccgg

SEQ ID NO: 251855 - DNA, 785 bp, Homo sapiens
  misc_feature: GYAE6OF02IKLJ7.25.28.C06.1.454.CMB.1.raw
  modified_base (150)..(150): a, c, t, g, unknown or other
  misc_feature (150)..(150): n is a, c, g, or t
  modified_base (188)..(188): a, c, t, g, unknown or other
  misc_feature (188)..(188): n is a, c, g, or t
tcagactgtacagtcacgaccggtgctcgatttagagctcacgtattgggtttgggggcagaagtctctctcagtcaggacacagcatggacatgagggtccctgctcagctccgtgggactcctgctgctctggctcccagctatcagntgtgcatccagatgacccagtctccactcctcctgtcngccattccgtgttaggacacagacgtccaaccgtatcctaccgttcggaccgggtcggagtcgacgggcgtactttaggtaactttagtttggcccttaggttacgtaccacgaacgtaaccggaaaccgtaaagggtaaccgttaaccctaaccttcctactacttacgtacttacggcctacggtcctaactttccacctttagtccggttaaaccgtttcgggttacccgttcttccgtaagttccgtacgtccggtcgtaacggttcgggggtacctaggggaacttaccggtaacgttacctacctaccctacctacctacgtaccgtacggtaccgtacggacccgttaggccccttaggacccgtttacggtacttttacgggtaactttttaaccggtacctttaaaccgttaaccgttaacccgttaacggtaaaccttaaccgttaaaattaactttaaagttttaaccgttacctttaaccggttttacccggaaaccgtttttaacggggaaccccgttaagggggtaccgaaggtacggttaccggtaaacggtaccgttaacggtaaccggttaggttaccgg

SEQ ID NO: 251856 - DNA, 739 bp, Homo sapiens
  misc_feature: GYAE6OF02IIR78.25.28.C06.1.454.CMB.1.raw
  modified_base (394)..(394): a, c, t, g, unknown or other
  misc_feature (394)..(394): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctggggggaggcgtggtccagcctgggaagtccctgagactctcctgtgtggcgctagactcaccttcagtattatggcttcgtcgtgggtccgccagtcgtccaggcgaaggggctggagtggctggggtagttacgttggtctgacagaacaaatgaacataatcacggcggagtccgaggcgggccattcacctatacctcgaacgggactaataccaagtacgtaaacccttntaatcgtagactaaaatacgaaactaagttggagtaggtacgaaggtaacgtaccggttaccgtttaattacgtagtacgtccgtaccgtacgtaagggtacggtacgggacggtaaagggtaaaaaacgttacggtaacggttacgttaccgtaccgtttaccccgggtaccgtaaccccgttacgggttccgggggacccggtaaccgggcccctaacccggtccggttaccgacccggttaccctcccgttaccgtaccggtaccctttacccgaaacccggtaaccgggtacccctaacggttccccgggtttaccccgttacccccggtaccggtccccg

SEQ ID NO: 251857 - DNA, 592 bp, Homo sapiens
  misc_feature: GYAE6OF02FMXZN.25.28.C06.1.454.CMB.1.raw
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
  modified_base (355)..(355): a, c, t, g, unknown or other
  misc_feature (355)..(355): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttggagacagagtcaccatcacttggccgggngagtcagggcattggaaatttattggcctggtatcagcaagaaaccagggaagtttacctaacctcctactatctatnctgcatcctatttgactaacgtttcgggtccctctcgtatttcgagcggnaggtcggtctgggacagtactcactctcgaccatcagcagtcctgcacgtcccgtagaacgtattcgttagacttaacctttatttaccgttacgttaaacttaaaaagtttcgaaacgttaggttaccggtacccggttaggtacgtttacgggttacccggacccggtaacgggtacccgtaaagggttcggtaactaacggttaaccggaaaccgttaccgttaggtaacccgg

SEQ ID NO: 251858 - DNA, 724 bp, Homo sapiens
  misc_feature: GYAE6OF02JB21E.25.28.C06.1.454.CMB.1.raw
  modified_base (255)..(255): a, c, t, g, unknown or other
  misc_feature (255)..(255): n is a, c, g, or t
  modified_base (398)..(398): a, c, t, g, unknown or other
  misc_feature (398)..(398): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtgggtccagcctgggaagtccctgagactctcctgtgtggcgcctagactcacctttcagttagttatggctttcgtctgggtccncagtgtccagggcaaggggctgggagtggctggggagtttacgttggtctggacagacaaatgaacatatcgaacgcggagtccggtggacggggcctattccgacatcctcgaagggacaacttaccaaagtacgaaccctntactctagacaaatcgaaacaacgttgaaggtacgtacggaaggtaacgttaccgggtaccgttttaacttaacgttggtacgtaccgtacgttaccgaagggtacggttaggacgttaaagggtaaaacgttcggtaacttacgttacgtaccgtttcccggacgtaacccggttcgtacgggggaccctacgggtcccgtacccggttacggtacccgtaacccggtccttccccgtacgtacccggtacctaccccgtaaccggtaaacccggtcccctaacggttcccccgggttaccccttacccccggttggtcccccgg

SEQ ID NO: 251859 - DNA, 702 bp, Homo sapiens
  misc_feature: GYAE6OF02GFETV.25.28.C06.1.454.CMB.1.raw
tcagactgtacagtcacgaccggtgctcgatttagagctcacgtattgggtttgggggtcgagaagtctctctcagtcaggacacagcatggacatgagggtccctgctcagctcctgggactcctgctgctctggctcccagctatcagatgtggcatccagatgacccagtctccatcctccctgtctgcatcgtgttggagacagagtccaccatcgactttggcccgggtacgacgtcaaggggtcatttagggaaaatttagtttcgggcccttgggttaactcgaagaccaaggtaaaacccgaggggaaaagtttcccctaaaaccctccttcaattcgttaatcggtcttagcctattccctacgttttgactaagttttcgggggtccccttctccggtaatttccgaagtccggggtactagggttcggggttctggggaacctaggtaaactttctaaaccgttcctaccctaacccggtatacccgagccgtaacggccttacggccaaggaccccgttagaaagtacgtttaggttcgaaccttaacttttaactttacgtaacgtttaacgtaaaattttacgacgtagttacgacccgttaggattcgggttccggaccctaacggggtaaccgtaacgggtacgggtaaccaagttaaccctaaaacggtaaccggttggtaacgg

SEQ ID NO: 251860 - DNA, 340 bp, Homo sapiens
  misc_feature: GYAE6OF02JB5K8.25.28.C06.1.454.CMB.1.raw
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (270)..(340): a, c, t, g, unknown or other
  misc_feature (270)..(340): n is a, c, g, or t
tcagactgtacagtcacgaccggtgctcgatttagagctcacgtattgggtttgggggggaagaggaagactgacggtcctccaggagttcaggtgctgggcaccctggtcaccgtctcctcagcttccaccaagggcccatcggtcttccccctggcgccctgcttccaggagcaccttctgggggcacagtcggccctgggctgcctggtcaaggactacttccgactgtacagtctgaggcggactggacaagggcncagtagncgnnnnnnnnnnnnnnnnnnnnnnnnnnnnnnnnnnnnnnnnnnnnnnnnnnnnnnnnnnnnnnnnnnnnnnn

SEQ ID NO: 251861 - DNA, 654 bp, Homo sapiens
  misc_feature: GYAE6OF02HRSSZ.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcctccatccctccctgtcctgcatctgttggagacagagtcaccatcacttggcccgggagagtcgagggcagttggtaaatttagtttggcctggtatcagcagaaaccgaggaagttcctaactcctacatctatgctgcactcctactttgacctaagtttcggggttcccgttcgtcgtactttccgagtccggcgtaggttcgggtacgtcgggactaggtaacttctaaccgtcctacctaacctacttcacgaccgtacgtcccttacggcctacgcccgtagaacggtagttcgttacggaaccttaactttacgtttaaccgtagtttaaaccgttaaaaagttttacgaaccgtacggttaccgtacccggttacggttacggttaccggtttcccgggacccggtaaccgggtaaccgttaacgggtacggaaccgtacgttaacccaaaccgggttaccgtggttaacggg

SEQ ID NO: 251862 - DNA, 931 bp, Homo sapiens
  misc_feature: GYAE6OF02HE5NU.25.28.C06.1.454.CMB.1.raw
tcagactgtacagtcacgaccggtgctcgatttagagctcacgtattggggtttgggggcagaagtctctctcagtcaggacacagcatggacatgagggtccctgctcagctcctgggactcctgctgctctggctcccagctatcagatgtggcatccagatcgacccagtctccatcctccctgtctgcatctgttggagacagatcacatcacgttggccgggcagtcgagggctagttaggtaaatttagtttcggccttaggtactcgagtacgaacggtaaaacccggaaggggtaaaccgtttcccctaaacccgttccctaccgtaactttaccgttaacgtcggtaccgttacggtaccctaaccgtttacccgttaacgttttacggacccggtttaaacggggttttttcccggggggtcccccctttacgttaccggttaacttttaccggaacgggttcccggggtacgttagggggttcgggggttaccggttaggggggtaacctaacgggttaaaccttttcccgtaaacccgtttaccccttaacccgtaaacccgtaagtttacccggaacgggtacccctaacgggtccccttacgggaccccgtaacgggtaccccgttaagggtaaacggttaccgtttacgggtttaacccggtaaaccttttaaaccgtttttaacgttttaaacccgtttaaacggtttaaaaacccgttaaaaaagtttttaccggaaaccgttaacgggttaacccgggttacccggttacggggtttaaccggtttacccggggttaacccccgggttaaacccgggtaacccgggggttaaacccggttaacggggttaccgggtaaacccttaacggttaaacccggtaaaacccgggttaccgttacggggttaaccggg

SEQ ID NO: 251863 - DNA, 778 bp, Homo sapiens
  misc_feature: GYAE6OF02IY9AZ.25.28.C06.1.454.CMB.1.raw
  modified_base (146)..(146): a, c, t, g, unknown or other
  misc_feature (146)..(146): n is a, c, g, or t
tcagactgtacagtcacgaccggtgctcgatttagagctcacgtattgggtttgggggcagaagtctctctcagtcaggacacagcatggacatgagggtccctgctcagctccgtgggctcctgctgctctggcctcccagctancagatgtggcatccagatcgacccagtcctccactccctcccgttgtcctgcctatcgttggttaggacgacagactacacctatccgtacgttcgggcccgggtacggacgtacggacggcgtaaggttaggtaaatttacggttcggtccgtaggtactacgtacgacgtaaacgaaacgggaaacggttaaccgttaacccgtaacctaccgtacctacttacgtactacgtcctagtcccaactttccgaccttaagtttcgggtaacccgtttcgggttccccggtatttccggaagttccggacgtacggtcggtacgtgggggtacctgggaactacgaacttcctacctacctactaccagtccgaacgccgtacgaccgtagaccctaggacctagtacgtagtacgttaacgttacttaacgttacgtttacaaaaactttttcggtaaaaaccttacgttagtaaacccggttttggggaacccctttaggggtttaacccggggttaaccccggtttaacggggggaaccccttaaagggggtacccggtaaaccgggttaacgggttacccgtaaacgggttaaccgtaaccgggtaaccgggttaccggttaacgggg

SEQ ID NO: 251864 - DNA, 618 bp, Homo sapiens
  misc_feature: GYAE6OF02JLKOW.25.28.C06.1.454.CMB.1.raw
  modified_base (145)..(145): a, c, t, g, unknown or other
  misc_feature (145)..(145): n is a, c, g, or t
  modified_base (149)..(149): a, c, t, g, unknown or other
  misc_feature (149)..(149): n is a, c, g, or t
  modified_base (465)..(465): a, c, t, g, unknown or other
  misc_feature (465)..(465): n is a, c, g, or t
tcagactgtacagtcacgaccggtgctcgatttagagctcacgtattgggtttgggggcagaagtctctctcagtcaggacacagcatggacatggagggtccctgctcagctcctgggactcctgctgctctggctccagctancagntcgtggcatccagactcgacccagtcctccactcccgtcctgtctgctatcgtgttggagtacagtacgtcaccatctacgttggccggacgtacgtcgagggctagttaggtaaatttagttcggctaggtactacgagacaacggaaacgacggtaaaacgttccctaaccgtcctacgaaccttacgtagtacgctcgtactactacctcgttcgacgttaacggtttcgggtaccctcgtacgcttcgacgtcggacgtaggtcgtcgtaggacgtagtacgttcacgtcaacctcgtatcgcacgacgtcngacctgaccgtgaacgtatcgtacgacttacttagttaaccgtattaaccgtaaacgtgaacgtacgtaaccgtccgttaggacgtttccgggtaccgaccggtaacggtacgaacgttacgaacctagtaaccgtaagtaccggtgtaccgg

SEQ ID NO: 251865 - DNA, 581 bp, Homo sapiens
  misc_feature: GYAE6OF02HY7KY.25.28.C06.1.454.CMB.1.raw
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (524)..(524): a, c, t, g, unknown or other
  misc_feature (524)..(524): n is a, c, g, or t
tcagactgtacagtcacgaccggtgctcgatttagagctcacgtattgggtttgggggaagaggaagactgacggtcctcccaggagttcaggtgctgggcaccttgagcactgaacgcagcggactcaccatggagtttgggctgaactgggttttcctcgttgctcttttaagaggtgtccagtgtcaggcgcatctggtggagtcgtgggggagcgtggtccagcctgggaactccctgagactctcctgtgtggcgcctagactcaccttcagtgttanggcttcgtctgggtccnccagtcgtccaggcaaggggctgggagtggctgggagttacgttggtctggacagaacaaagtgacatatcacggcggtagtccgtaggacggggcctatttccaccatccgtccgacgggacaacttaccgaagacgaaccctctatctagacaaatacgaaactaactagagagtacgaggtacgtacggtaccgtttattacgtgtacgcgacctcgaggngtaggacctagggtaaacgtcgtagtctcgtacttcccgtacgtaccgtcgtccggg

SEQ ID NO: 251866 - DNA, 604 bp, Homo sapiens
  misc_feature: GYAE6OF02GEE1U.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacttggccgggcagtcgagggctagttaggtaaatttgttggccgtggtatcagcaagaaaccgagggtaaacgttcctaacctcctactatctatgctgctactcctactttgactaagttttcggggtccctctacgtatttcgaggtccggcgtacgggttcggggtctaggggaactaaggtaacttccgtacgttacctactaacccgtagtacacgaccgacgtcctgaccgacgtcctaggaactagttggttacgtacttaactttacttacgtacgttaaactaaagtttgaacgtagtcgtaccggtggtacgttcgggtaccggaccggtaacgggaaccgtaagggtcgaactaacgtaacgaacgtacgtggtacgg

SEQ ID NO: 251867 - DNA, 655 bp, Homo sapiens
  misc_feature: GYAE6OF02GL2A9.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccatccctccctgtctgcattctggtggagacagacgtccacctattcctacgttcggccggggcgaacgtcgaggggctagttaggtaaattttagtttcggaccgttgggttatccgaagcaaacggaaaccgagggtaaacgttcccctaaacctccctatattctatgtctgccacttacctacgtttagaccttaagttttccggggtccctctcggtactttcgagtccgtgtagggtcggtcgtacgggactagtactctactctaccacctatcgaacgccgacgtccgtcgtacccgacgtccgtagtaacgttcgtacggttcgtacctttaacgtttactttaaccgttacgtaaactttaaagtttaccgaagtacgtacggtaccggtagtacggtcggttacccggaaccggtaaccggacggtaagggtaccgtactaacgtaccggaaacgttcggtacgtacgg

SEQ ID NO: 251868 - DNA, 571 bp, Homo sapiens
  misc_feature: GYAE6OF02IU7MI.25.28.C06.1.454.CMB.1.raw
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (326)..(326): a, c, t, g, unknown or other
  misc_feature (326)..(326): n is a, c, g, or t
  modified_base (397)..(397): a, c, t, g, unknown or other
  misc_feature (397)..(397): n is a, c, g, or t
tcagactgtacagtcacgaccggtgctcgatttagagctcacgtattgggtttggggggaagaggaagactgacggtcctcccaggagttcaggtgctgggcaccttgagcactgaacgcagcggactcaccatggagtttgggctgaactgggttttcctcgttgctcttttaagaggtgtccagtgtcaggcgcatctggtggagtctgggggaggcgtggtccagcctgggaagtccctgagacctctcctgtgtggcgcctagactcaccttcagttagttatggcttcgtntgggtccncagtgtccaggcaagggctggngtggcgtgggattcgttggtctgacagacaaagtgacatatcacgcggagtccgaggacggggcatcaccntcctacgacgggacaacttaccgaagacgtacctactactctcgacaactacgaactactagagagtacgaggagtacgacgtttactagtagtcgcgtacgtcgagaggtggtacgtaggtaaacgtcgtagttaccgtcgtaccgttcccgtacgtaccgtacggtaccggg

SEQ ID NO: 251869 - DNA, 679 bp, Homo sapiens
  misc_feature: GYAE6OF02HKH3Z.25.28.C06.1.454.CMB.1.raw
  modified_base (201)..(201): a, c, t, g, unknown or other
  misc_feature (201)..(201): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttgganacagagtcaccatcacttggccggcgagtcgagggcagttaggaaattagttggccttggtatcagcaagaaaccgaggtaacgttccaacctcctacatctatgctgcatacctatttgactaagtttcgggtccctcttacggtaacttcgagtcggcgacgggtgggtacgtcgggaacaaggtaacgttcaaccttctaccgacctactacgagaccgtaagtcccgtacgaccgtacggtaccctagaaaaggtcgttaagttaccgtaaacttaaaactttaactttaaccgttaacgttaaaacgtttaaaaaactttacgaaccgttaacggttaccggtacccgggtacggttaacggtttccgggttaacccgggaacccggtaaaccgggggtaaccgtaaaaggggttccgggaaacgttaaccgtaaacccgtaaaaacgggttacccggttaggttaacccggg

SEQ ID NO: 251870 - DNA, 640 bp, Homo sapiens
  misc_feature: GYAE6OF02GN368.25.28.C06.1.454.CMB.1.raw
  modified_base (264)..(264): a, c, t, g, unknown or other
  misc_feature (264)..(264): n is a, c, g, or t
tcagactgtacagtcacgaccggtgctcgatttagagctcacgtattgggtttgggggggaagaggaagactgacggtcctcccaggagttcaggtgctgggcaccttgagcactgaacgcagcggactcaccatggagtttgggctgaactgggttttcctcgttgcttcttttaagaggtgtccagtgtcaggcgcatctggtggagtcgtggggggagcgtggtccagcctgggaactccctgagactctcctgtgtggcncctagactcaccttcagtagttatggtcttcggtcgtgggtcccgccagtcgtccgaggtcgaagggggctgggagtggacgtgggtacgtttacgttggtctgacagaactaaatgacatactcgacggcggagtccgtggacggggcctattcaccactctacgagggactaataccaagacgtaaccctactactctagactaaatacgaaactaagttaggaagtacggacggtaggtagttaaccggtacgtttttaacttacgttcgtcgtaccgtaccgtacgaggtacggtaggtaaccgtaagggtaaaacgttcggttaagtaccttacgtaaccgtttcccggtacgtaccgttccggtacgggg

SEQ ID NO: 251871 - DNA, 729 bp, Homo sapiens
  misc_feature: GYAE6OF02FVY9F.25.28.C06.1.454.CMB.1.raw
  modified_base (149)..(149): a, c, t, g, unknown or other
  misc_feature (149)..(149): n is a, c, g, or t
  modified_base (245)..(245): a, c, t, g, unknown or other
  misc_feature (245)..(245): n is a, c, g, or t
  modified_base (564)..(564): a, c, t, g, unknown or other
  misc_feature (564)..(564): n is a, c, g, or t
tcagactgtacagtcacgaccggtgctcgatttagagctcacgtattgggtttgggggcagaagtctctctcagtcaggacacagcatggacatgaggtccctgctcagctcctgggactcctgctgctctggcctcccagctatcagntgtgcatccagatcgacccctagtctccactccctcctgtctgctatccgttggttggacgacaggtactccaccacttctaccgttcggcccggngacggtcgaagggtctagttaggaaatttagtttcggcctaggtatacctagacgaacggaaaccgaagggtaaacttccgtaaccctctactattccgtaattcgcctgtacctaattcctacgtttgacgtttaaacggttttccggggttacccccgttcggtacgttacgttaccgtacgggtccgggaccgttagggttcgggtttcggttaacggggaacttaaggtaaacctttaccctaccgttccgaaccgtacctacgttacgaaccgccgtaaccgtccgttacgaccgtacgtacccgagtaacgtntttacgggttactaaccttaacgtttaactttagttaccgttaaactaaactttaaacggtttacgttaaccctttacctaccgttccttaccggttcggtaaccggtacggtaacggtaaggtacgggacttacgtaaccgtaaacgtacgtacggtgtacccg

SEQ ID NO: 251872 - DNA, 541 bp, Homo sapiens
  misc_feature: GYAE6OF02I1KWT.25.28.C06.1.454.CMB.1.raw
  modified_base (253)..(253): a, c, t, g, unknown or other
  misc_feature (253)..(253): n is a, c, g, or t
  modified_base (405)..(405): a, c, t, g, unknown or other
  misc_feature (405)..(405): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttggagacagagtcaccatcacttggccggcgagtcgagggacagttaggaaaatttnttggcctggtatcagcaagaaacagggtaacttcctaacctcctacatctatgctgcatcctactttgactaggttttcgggtccctctcgtacttcgagtcggctaggtgggtcgtgggacagtaactcactctcacatcagcagcctgcncgtaccgtagaagtacgtgttagactaactttagttacttacgtaacttaaaatttgacgtagtcgtaccgtggtacgtcggtccggaccgaggtaaccgaagtacggaactagtaaccgaacgtacgtggtacgg

SEQ ID NO: 251873 - DNA, 727 bp, Homo sapiens
  misc_feature: GYAE6OF02I4OLI.25.28.C06.1.454.CMB.1.raw
  modified_base (377)..(377): a, c, t, g, unknown or other
  misc_feature (377)..(377): n is a, c, g, or t
tcagactgtacagtcacgaccggtgctcgatttagagctcacgtattgggtttggggcagaagtctctctcagtcaggacacagcatggacatgaggtccctgctcagctcctgggactcctgctgctctggctccagctatcagatgtggcatccagatcgaccctagtctccatcctcccgtgtctgactatcgtgttggagacagtacgtcaaccatactacgttcggccgggtcgagtacgaacgggtctagttagttaaagtttatttcggcccgttggttaatacgacgtacgaaacggtaaaaccggtaaggggttaaaacgtttaccctaaacccgttccttactaacttaccgtaagtcgtcgttacnctaccttacctacgtttacgtaccgttaacggttttccgggtaaccccgttgtaccgttacgttcgaacggcggtacgtagggttcgggttcgtacgggactaaggtaactttaccgtacttaccgtactacctacgtacgacgtaccgtaaccgtcgttacgctacgtaccgtagtacgtacgttacgtacgtacttacgttaattacgtacgttaaactttaaacgtacgtaacgtacgtaacgtaccggtacggttaccgttacggtttacccggacccggtaacggtaaccggtaacgggtacgtaccgttaaccgtaacgtaaaccgttacggtcggttaaccgg

SEQ ID NO: 251874 - DNA, 582 bp, Homo sapiens
  misc_feature: GYAE6OF02GK7DZ.25.28.C06.1.454.CMB.1.raw
  modified_base (345)..(345): a, c, t, g, unknown or other
  misc_feature (345)..(345): n is a, c, g, or t
  modified_base (461)..(461): a, c, t, g, unknown or other
  misc_feature (461)..(461): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctggggggaggcgtggtccagcctgggaagtccctgagactctcctgtgtggcgcctagactcaccttcagtagttatggcttcgtctgggtccgccagtgtccaggcaaggggctgggagtggctggggagttactggtctgacagacaaatgacatatcacgcggagtccgtgaggggccgattcaccgatctccgagggacaattccaagacgaaacccctntaatctgacaaatgaacaacttgagagtcgaggatacggccgtttatactgtcgcgacctcgaggaggtggcgtaggaaaagtcgtagtctcacttccgtcaccgtcgtcgggccngggccaccgtcggtccaccgtctcctcagtccttaccacgacggacccacgtccggtccgttccccgcggtcccgcccgttcgccgtccgacggaccgccgtacccgtccgttggggaccg

SEQ ID NO: 251875 - DNA, 694 bp, Homo sapiens
  misc_feature: GYAE6OF02ISIVJ.25.28.C06.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctccagctatcagatgtggcatccagatcgacccagtctccatccctcctgtctgcatctgtggaanacagagtccaccatctacgttcgccgggngagtcgaggctattacgactaattagttagtccgtaggtactacgaaacaacgtaaaaccgagggaacgtacgttaaccctaaacggtccttaccgtagacttacgtaagttcggaaccttcggtaaccccttaccgtaaaccggtttactaacccggttccggtaaccgggttcccgtaacttccgtacggtttaccacggtaccggtacaggttagtaacttcgggtaacggaacgtaaggtacgttacctaactccgtactaactagaacacgtactacgtacgtcacgacgtacgtagtaacgtagttacgttacgtaactaacgtttaacttaacgttaacgtaaactaaaaagtttacgtaactaccttaccgtacccttaacgtccgtttaacggtaccggaacgggaaccggttaacgaagggtcgtaaacggtaaccgtaacgtaacggtaacgg

SEQ ID NO: 251876 - DNA, 656 bp, Homo sapiens
  misc_feature: GYAE6OF02JNX2J.25.28.C06.1.454.CMB.1.raw
  modified_base (390)..(390): a, c, t, g, unknown or other
  misc_feature (390)..(390): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcacttcagtagttatggcttcgtctgggtccgccagtcgtccaggcgaaggggctagggagttggctgggattacgtggtctgactagactaaatgacatagtcaacggcggagtccgtaggacggggccattcaccatctaccgaagggacaattccaaagacgaacccttntatctagacaaatcgaaactacgttgaagacgtacgaaggtacgtaccggtaccgtttaagtacgtgtcgtaccgtacctacgtaaggagtacggacgttaaggaaaacgtcgtagttactacgtaccgttcccgtacgtaccgttacggcgggtaccagggaccctaccgtcggtacctaccgttccgtacccgttcgtaccgtaccttacccgaacgacccgggtcctaccgtcccggttaccccttccccggtacggtccccg

SEQ ID NO: 251877 - DNA, 621 bp, Homo sapiens
  misc_feature: GYAE6OF02FSAEX.25.28.C06.1.454.CMB.1.raw
  modified_base (298)..(298): a, c, t, g, unknown or other
  misc_feature (298)..(298): n is a, c, g, or t
tcagactgtacagtcacgaccggtgctcgatttagagctcacgtattgggtttggggggaagaggaagactgacggtcctccccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcggtctgggtccgccagtgtccaggcaaggggctggagtggctgggagttacttggtntgacagacaaatgacatatcacgcggagtccgtgaggggccgattcaccatctccagggacaattccaagagaaccctctatctgacaaatgaaaccaacttgaagagtacgaggtatacggccgttttattacgtgtgacgacctcgaggagtcggcgtaggaaaagtcggtaagtctaccacgttcccgtcgtaccgtcgtcggggaccacgggtccacccgttcggtacctacccggttcctcccgtccgaccgtccttaccccgaaccgaacgggtcccctacggttccccggtccgtttccccccgtacggtccccgg

SEQ ID NO: 251878 - DNA, 710 bp, Homo sapiens
  misc_feature: GYAE6OF02HH54J.25.28.C06.1.454.CMB.1.raw
  modified_base (195)..(195): a, c, t, g, unknown or other
  misc_feature (195)..(195): n is a, c, g, or t
  modified_base (211)..(211): a, c, t, g, unknown or other
  misc_feature (211)..(211): n is a, c, g, or t
tcagactgtacagtcacgaccggtgctcgatttagagctcacgtattggggtttgggggcagaagtctctctcagtcaggacacagcatggacatgagggtccctgctcagctccgtgggactcctgctgctctggcctccagctatcagatggtggcatccgagactcgacccagtctccactccctcctgtcngctattcgtgtagganacagactcactatctacgtcggaccgggcgagtcgaggactagttaaggtaaactttgttcggtacgttggtatacgagtacaaacggtaaccggaaagggttaaaccttacccttaaccgtcctactacttacgtatcgtcttagactactaccgttcttacgacgtttaacgggtttcccgggtacccttcgttacgtacttacggacgggtccggacgttgggttcggtaccggtagggaactaaggtaacctttaccgaccttaccgtacccgaactacgtaccgacgaccgtactcccggtaggacgtaaccgccgtaagtactagggttcacgtaacttaatttacgttctaaacggtaacgtaaagttactaaacgttccttacccgtaccctttattacccgggtttccggtaaccgggtaccggggtaaccgtaaccggtaggggtacgtaacggtaacgtaacccggttaaaggtccgaggttacccgg

SEQ ID NO: 251879 - DNA, 634 bp, Homo sapiens
  misc_feature: GYAE6OF02FY5CC.25.28.C06.1.454.CMB.1.raw
  modified_base (240)..(240): a, c, t, g, unknown or other
  misc_feature (240)..(240): n is a, c, g, or t
  modified_base (318)..(318): a, c, t, g, unknown or other
  misc_feature (318)..(318): n is a, c, g, or t
  modified_base (474)..(474): a, c, t, g, unknown or other
  misc_feature (474)..(474): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctccagctatcagatgtgcatccagatcgacccagtcctccactccctcctgtctgaccattcgttggtggacgactagagtccactatctacgttcggccggganagtcgaggctagttaggtaaatttgtttaggccttggtatcagacaacgaaacgaaggtaactaccctaacctcctanaattctatgtctacgctactccgttattaggtactacgggttttcgggtacccgtagttacgtagttacgacggtcggtgtacgggtttcgggtcgacgggtataacgtaacgttcctaactccctacactacgtcgacgtccgacgtcgtcgacncgtacgtagaatcgttagtactaactttacttaacttacgtactttaaacgtaaattccgtaagtacgtaccggtacggagtacggttcggtaacccgggacccgtaaggtacccgtaagggtacaaccgtaacgtaaccgaacggtacgtggtaaccgg

SEQ ID NO: 251880 - DNA, 709 bp, Homo sapiens
  misc_feature: GYAE6OF02I3RCN.25.28.C06.1.454.CMB.1.raw
  modified_base (173)..(173): a, c, t, g, unknown or other
  misc_feature (173)..(173): n is a, c, g, or t
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
tcagactgtacagtcacgaccggtgctcgatttagagctcacgtattgggtttggggtcagaagtctctctcagtcaggacacagcatggacatgagggtccctgctcagctcctgggacctcctgctgctctggcctcccagctatcagatggtggcatccagatcgacccngtcctccactccctcctgtcngctatcgtgtacgganacagactccactatactacgtcggccgggcgtagtcgagggactagttaggtaatttgttcggctgtactcgagacaacggaaccgaaggtaaccgttaccctaacctcctatacgtactagtcgtacctgactacttaccgttacgttgtacccgttaacggggtttcccgggtcccttacggtacttagtacggacgggtaccggtcggtacggggttcgggttaccggaaggtaacgtaacgttaccttaccgtacctaccgttaccgtaaacctcgtaccgtacgccgtacgtccgtacgaccgacgtccgtaataacggtcgttacgttaccgttaacgttaactttaccgttaacgttacgttaaacttaaaacgttcgaacgttacgtaccggtacgtacggttacggtccggttacccggaacgggtacggtaaaccggtacggtaacggtaagtaaccggtaacggtaacccggttacgtcgggtaccgg

SEQ ID NO: 251881 - DNA, 679 bp, Homo sapiens
  misc_feature: GYAE6OF02JEO68.25.28.C06.1.454.CMB.1.raw
  modified_base (402)..(402): a, c, t, g, unknown or other
  misc_feature (402)..(402): n is a, c, g, or t
tcagactgtacagtcacgaccggtgctcgatttagagctcacgtattgggtttggggggaagaggaagactgacggtcctcccatgagttcaggtgctgggcaccttgggcacgggggaggtgtgtcacaagatttgggctctgggcaccgtggagtctggggggaggcgtggtccagcctgggaagtccctgagactctcctgtgtggcgcctagactcaccttcagtagttatgcttcgtctgggtaccgccagtcgtccaggcaaggggctggagtgctgggatttacttggtctgactagacaaaatcgacatatcgacgcggtacgtccggtggaacggggccgtaattccaacctatcctaccgagggactaacgttccgaaagtacgaacccttntaactctacgacaaatgaaacctacgttaggacgacgtcgaacggtataaccgggtccttttaagttactacggtacgccgtacctcgaaggtacggttcggagtaacgggtaaagtcgtaacgttcgtccttacgtaccgtcgaaccttcggtacgggcccgtagggaccgtacccggttaggtccacccgggttccttaccttaccgtcgtacccgtttacccaaccggtaaccggtcccgtaaccggttcccggtcccgtttaccccctacggg

SEQ ID NO: 251882 - DNA, 707 bp, Homo sapiens
  misc_feature: GYAE6OF02H5H73.25.28.C06.1.454.CMB.1.raw
  modified_base (171)..(171): a, c, t, g, unknown or other
  misc_feature (171)..(171): n is a, c, g, or t
  modified_base (192)..(192): a, c, t, g, unknown or other
  misc_feature (192)..(192): n is a, c, g, or t
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtcgcatccagctcgacccngtctccacttccctcctgtcngctatctggtcgagacngagtcaacctnctactcggccggacgacgcggtacggacgtaagttagggtaaattcgttcggtccgttaggttactacgagaacggaaacgaaaaccggagggtaaaccgttaaccttaacccggtacctactactacgttactacggtctcgtaccacttcctacgtttcgaacgttaacgtttcggggtcccttacgtccgttaagtcgtacggcgtcggtaacggtcggtacgtacgggtactagtaacgttcctactacgtacctacttacggaatcggacctcggaccctggtaccacggtacccgttaaggagtaccggttacgttacggaaccctttaagtttaacccgttaattaacgtttaaaccttaaaagtcgttaacgtacgttaacggtccggttacggttacgttcccggttacccgggacggaaccgggtttaacggacggtagggtacccaacgtaacggaacccggttagtcggtaccgg

SEQ ID NO: 251883 - DNA, 654 bp, Homo sapiens
  misc_feature: GYAE6OF02GH3LD.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttggagacagagtcaccatcacttgccgggcgagtcaggcagttaggaaatttagtttggccttggtatctagacgaagaaaccagggtaaacgttcctaacctcctacatctatgtctgcactcctactttagcgtaagttttcggggtcccttcgttcgactttcgacggtcgggtactagggttcgggtccgtaggggaacctaacggtaactttccgaaccttacgtacccgtaacctacttaccgaacgaccgtacggtacccttcggacctacgtcccgtaagaacggttaacgttgtttaacggaccttaaactttaagtttaaccgttaagtttaacgtaaaaagttttcgaaacttacgtacgtacccggttaggacgttcggttaccggacccggtaacgggtaccgtaagggtacgtacaaccgttaacgaaccgttacgttgtacgg

SEQ ID NO: 251884 - DNA, 262 bp, Homo sapiens
  misc_feature: GYAE6OF02IJBZG.25.28.C06.1.454.CMB.1.raw
  modified_base (257)..(262): a, c, t, g, unknown or other
  misc_feature (257)..(262): n is a, c, g, or t
tcagactgtacagtcacgaccggtgctcgatttagagctcacgtattgggtttgggggaagaggaagactgacggtcctcccaggagttcaggtgctgggcaccctggtcaccgtctcctcagcttccaccaagggcccatcggtcttcccctggcgccctgctccaggagcacctctgggggcacagcggccctgggctgcctggtcaaggactacttccactgtacagtctgagcgggctggcaaggcgcatagnnnnnn

SEQ ID NO: 251885 - DNA, 752 bp, Homo sapiens
  misc_feature: GYAE6OF02F7ZLM.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccatccctcctgtctgcatctgttggagacagacgtccaccatccacgttcggccgggacgagtcgagggcagttaggaaatttagtttgccttggtatcagacaaggaaaacccgagggtaaactttccccgtaaccttccgtactaacgttccttagttcgctgacctacgttccctactttcgtaccttaagggttttccggggtccccttacgttacgtacgtttccgaggtccgggtaccgtaaggttcgggggttaccgtaggggaacgtacggtaaactttaccaccgttaccctacctaacccgtaagttaccaaccggtccaaccggttcccgtaggaccctacgggttaccctaggaaacgttacgttcggtttaacaacccgtttaacttttaacgtttaccgtttaacgttaaaccttaaaaaacgttttcggaaaccgttacgggttaccgttacccgggtttaggttaaccggttccgggttaacccggaacccgggtaacgggtaacccggtaagggtacggaaccgtaacgttaaccgaaaccgggttagtcggttaaccgg

SEQ ID NO: 251886 - DNA, 696 bp, Homo sapiens
  misc_feature: GYAE6OF02HH1B5.25.28.C06.1.454.CMB.1.raw
  modified_base (231)..(231): a, c, t, g, unknown or other
  misc_feature (231)..(231): n is a, c, g, or t
tcagactgtacagtcacgaccggtgctcgatttagagctcacgtattgggtttgggggcagaagtctctctcagtcaggacacagcatggacatgaggtccctgctcagctcctgggactcctgctgctctggctcccagctatcagatgtggcatccagatgacccagtctccatccctcctgtctgcatctgttggagacagagtccaaccatccacgttggcccgggngagtcgagggctagttaggaaatttgtttacggccttaggtacttccgacgcaaacggaaaaccgtagggtaaactttcccaaacccgttcctactaactacgtatcgtctcgactacttacctactttagacttaaggttttccgggtccccgttcgtacgtactttacgacggtccggtactagggtcgggttacgtcgggaactaagttaacgttccaaccgttcctacccgtacctacgtacgacgtacgacgtccgttcgaccgaccggtcctaaggaacgttacgttacgttacgtaccttaacctttaacgttaccgttaacgttaaactttaaaacgttgaaccttaggttaccgtacccgtaggtaccgttcgggtacccggtaccggtaaccgggtaaccgaacgggttaccgtaacgtaaccgttaaccgaaacccggttacgtggtaaccggg

SEQ ID NO: 251887 - DNA, 829 bp, Homo sapiens
  misc_feature: GYAE6OF02HQ7QL.25.28.C06.1.454.CMB.1.raw
  modified_base (188)..(188): a, c, t, g, unknown or other
  misc_feature (188)..(188): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctgggggagcgtggtccaggcctgggaatccctgagactctcctgtgtggcgcctagacctctacctnagtagttagtggtcttcgtcgtcggtccacgtgtcgtaccgaggacggaagggtctgggaggtggcgtagggtacttcgttgtctacgaacgtagaactaaagtcgaactatactacgacggacgggtacgttccggtagggacggggtacctaagttcccacctactccgtaccggaacggaactaacgtaccgaaagtaacccgtaacccttgtaacgtctagtaacaaagtacgaacctaacgttaggaacggtaggtacggaaagtaacggttacccggttaacgttttaacgtaacggtgtacggtaccgtaaccgttacgggaacgggtacgtcggggtaacgtaaaagggttaaaacggttcggtaagttccttaccgttacccggttacccgtaccgttacccgggtcgggtaacccggggacccgggaccggtaaccccgtcccggttaccggtaccccgtcccgttccgttcccgtaaccgtccgttacccctaccgaaacccgggtccgtacccgtaccgggtttcccgtacccccgtttccccgggtaccggcccccttacccggtccggttacccgtaccggtaccgggtaccctaccggtaccccggtcggggtacccgggacccgg

SEQ ID NO: 251888 - DNA, 584 bp, Homo sapiens
  misc_feature: GYAE6OF02GDHAU.25.28.C06.1.454.CMB.1.raw
  modified_base (456)..(456): a, c, t, g, unknown or other
  misc_feature (456)..(456): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagttagttatggcttcgtctgggtccgccagtcgtccaggcaaggggctggagtggctgggagttacttggtctgacagacaaatgacatatcacgcggatccgtggaggggccattcaccatctaccgagggacaacttccaaagacgtaaccctctatctgacaaatgaaactacttagagagtcgaggtactacggtccgtttaattctgtgcgacctcaggagtggntaggaaaatgtagtctctattccgtcgaccgtcgtgggccaggcctaccgtcgtcgaccgtcgtcctctacgtccttaccgacccgtaacgggtccctacgtcccggtaccttccccgtcggtccccg

SEQ ID NO: 251889 - DNA, 810 bp, Homo sapiens
  misc_feature: GYAE6OF02H21CI.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctccagctatcagatgtggcatccagatcgacccagtcctccactccctccctgtctgcacttcgttgttggacacaggtacgtccacctatccacgttcggccgggtgagtcgagggtactaagttacggtaaatttagttcgggcccttaggtactacgacgaccgaacggtaaaacccggaaggggttaaaacctttaccccgtaaacccttcccgtaatactttaccttaacgtcgtcgtacgtacctaacttaccctaacgttttcgtacgttaacgggttttccggggttaccccttaggttaccgttacgttaccgacgggtccggtacgttacggggttacgggttacgtaccgggtaacgtaacgttaaccgttactaacccgtttaccgtaacctacccgtaagtccaacggtcccgtaaacgttcccgtacggtaccgtaacggtacccgttaacggtaagttacgtttacggtaccgttaaccgttaaacccttttagtttaaaccctttaagggttaaacctttaaaaagggtttcgtaaaccgtacgggttaacgtacccgggttgggtttaaccgtcgggtttaaccggaacccggtaacgggtaaccgtaaacggtcgtaaccgtaacgtaacggtaaaccgttacggtacggttaccgg

SEQ ID NO: 251890 - DNA, 612 bp, Homo sapiens
  misc_feature: GYAE6OF02JY1NB.25.28.C06.1.454.CMB.1.raw
  modified_base (149)..(149): a, c, t, g, unknown or other
  misc_feature (149)..(149): n is a, c, g, or t
  modified_base (163)..(163): a, c, t, g, unknown or other
  misc_feature (163)..(163): n is a, c, g, or t
  modified_base (170)..(170): a, c, t, g, unknown or other
  misc_feature (170)..(170): n is a, c, g, or t
  modified_base (184)..(184): a, c, t, g, unknown or other
  misc_feature (184)..(184): n is a, c, g, or t
  modified_base (190)..(190): a, c, t, g, unknown or other
  misc_feature (190)..(190): n is a, c, g, or t
  modified_base (274)..(274): a, c, t, g, unknown or other
  misc_feature (274)..(274): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (363)..(363): a, c, t, g, unknown or other
  misc_feature (363)..(363): n is a, c, g, or t
  modified_base (456)..(456): a, c, t, g, unknown or other
  misc_feature (456)..(456): n is a, c, g, or t
tcagactgtacagtcacgaccggtgctcgatttagagctcacgtattgggtttggggtcgagaagtctctctcagtcaggacacagcatggacatgaggtcctgctcaagctcctgggactcctgctgctctggctcccagctatcagntgtggcagtccagntcgaccngtctcactcctccngtactncgacttctgttgacgactagtcgtcactattcgacttgccggtgacgtcgaggcagttggtaattagttcggcctggtaatcgngacgtaagaaccgaggtacgtacctaacgtacctcagttcctatcggtctcggancgtacctnttacgtacaacgtttggaccccgttntacgacttcgcgtacgcgttaggtcggtaccgtagggtacaaggttacctcgttacgccttacgacctacttacgacgtcaacgtcgttaacnccgtaacgcgtaacgactaagtcctagtacctaacttagttacctacgtaaaacttaacgttacgacgtataccgtcgtaagttacgtaggtttaccgacccggttaggaaccgtagggttaccacgtaacgtacgtaacgtccggttagtaccgg

SEQ ID NO: 251891 - DNA, 592 bp, Homo sapiens
  misc_feature: GYAE6OF02FF9QP.25.28.C06.1.454.CMB.1.raw
  modified_base (384)..(384): a, c, t, g, unknown or other
  misc_feature (384)..(384): n is a, c, g, or t
  modified_base (544)..(544): a, c, t, g, unknown or other
  misc_feature (544)..(544): n is a, c, g, or t
tcagactgtacagtcacgaccggtgctcgatttagagctcacgtattgggtttgggggaagaggaagactgacggtcctcccaggagttcaggtgctgggcaccttgggcacggggaggtgtgtcacaagatttgggctctgggcaccgtggagtctggggagcgtggtccagcctgggaagtccctgagactctcctgtgtggcgcctagactcaccttcagtagttatggcttcgcttgggtccgccagtgtcccaggccaaggggcctggagtggctgggagttactggtctgacagacaaatgacatatcacgtcggatccgtgaggggccattcaacccatcctaccaggggtaccaacttcccaagacgaaccccttntaatctagcaaaattcgaaaccaactttgagagtacgaggatacggccgtttatacttgtcgaccgacctcgtaggagtgactggaaaagtcgtagtcgtacacttcccgtacgtacctacgtcggggcctagggccacccgtggtacaccgtctcctcncgtcctaccaccaacggtcccacgttccggtaccttccccgtgtcccg

SEQ ID NO: 251892 - DNA, 619 bp, Homo sapiens
  misc_feature: GYAE6OF02FYUIT.25.28.C06.1.454.CMB.1.raw
  modified_base (333)..(333): a, c, t, g, unknown or other
  misc_feature (333)..(333): n is a, c, g, or t
  modified_base (381)..(381): a, c, t, g, unknown or other
  misc_feature (381)..(381): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctggggcaccgtggagtctgggggaggcgtggtccagcctgggaagtccctgagactctcctgtgtggcgcctagactcaccttcagtagttatggctttcgtctgggtccgccagtgtccaggcgaaggggctggagtggctgggagttacttggtctgacagaacaaatgacatatcacgcggatccggngaggggccattcaccatctccagggacaattaccaagaacgaaccctntatctgacaaatacgaactaacttgaacgtagtcgaaggataacgggtaccgtttattacgtgttcgacgtacctacgaggtagtggtacgtaaggtaaaacgttcgtaagtctactacgttcccgtcgacctcgtcgggccgaggccgtaccgtcgtccgaccgtcgtcctccgtacgtcccttacccgaccgaaccggtccctaacgtccggttcccgttcccccgtacggtcccg

SEQ ID NO: 251893 - DNA, 270 bp, Homo sapiens
  misc_feature: GYAE6OF02H023C.25.28.C06.1.454.CMB.1.raw
  modified_base (259)..(270): a, c, t, g, unknown or other
  misc_feature (259)..(270): n is a, c, g, or t
tcagactgtacagtcacgaccggtgctcgatttagagctcacgtattgggtttggggggaagaggaagactgacggtcctcccaggagttcaggtgctgggcaccctggtcacccgtctcctcagcttccaccaagggcccatcggtcttcccctggcgccctgctccaggagcacctctgggggcacagcggccctgggctgcctggtcaaggactacttccactgtacagtctgagcgggctggcaaggcgcatagnnnnnnnnnnnn

SEQ ID NO: 251894 - DNA, 258 bp, Homo sapiens
  misc_feature: GYAE6OF02HB7FO.25.28.C06.1.454.CMB.1.raw
  modified_base (235)..(235): a, c, t, g, unknown or other
  misc_feature (235)..(235): n is a, c, g, or t
  modified_base (251)..(258): a, c, t, g, unknown or other
  misc_feature (251)..(258): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggcccagggaccaaggtggacatcaaaacgaactgtggctgcaccatctgtcttcatctccgcatctgaactgtacagtctgagcggntggacaggcgcatagnnnnnnnn

SEQ ID NO: 251895 - DNA, 264 bp, Homo sapiens
  misc_feature: GYAE6OF02JKJ22.25.28.C06.1.454.CMB.1.raw
  modified_base (255)..(264): a, c, t, g, unknown or other
  misc_feature (255)..(264): n is a, c, g, or t
tcagactgtacagtcacgaccggtgctcgatttagagctcacgtattgggtttgggggtaagaggaagactgacggtcctcccaggagttcaggtgctgggcaccctggtcaccgtctcctcagcttccaccaagggcccatcggtcttccccctggcgccctcgctccaggagcacctctgggcacagcggccctggctgcctggtcaggactacttccactgtacagtctgagcgggctggcaggcgcatagnnnnnnnnnn

SEQ ID NO: 251896 - DNA, 624 bp, Homo sapiens
  misc_feature: GYAE6OF02JCNS4.25.28.C06.1.454.CMB.1.raw
  modified_base (340)..(340): a, c, t, g, unknown or other
  misc_feature (340)..(340): n is a, c, g, or t
  modified_base (395)..(395): a, c, t, g, unknown or other
  misc_feature (395)..(395): n is a, c, g, or t
  modified_base (463)..(463): a, c, t, g, unknown or other
  misc_feature (463)..(463): n is a, c, g, or t
  modified_base (616)..(616): a, c, t, g, unknown or other
  misc_feature (616)..(616): n is a, c, g, or t
tcagactgtacagtcacgaccggtgctcgatttagagctcacgtattgggtttggggggaagaggaagactgacggtcctcccgaggagttcaggtgctgggcaccttgggcacgggggaggtgtgtcacaagatttgggctctgggcaccgtggagtcgtgggggaggcgtgggtccagcctgggaagtccctgagactctcctgtgtggcgcctagactcaccttcagtagttatggcttcgtctgggtccgcagtcgtccaggccgaaggggctgggagtggcgtggggagttacgttggtctgacaggacaatgacatatcgacggcggagtccgnggacgggggccagttccacatcctcgagggaacaattaccgaagtacgaaccctntacttctgacaaatgaaactaacgttagacgagtcggaaggacgtacggtaccgtttattactgttanccgactacgaggtagtaggcgttaagggaaaacgttcggtagtcctacgtacgttcccgtacgtaccgtcgtcgggacgacggcctaccgtgtccgaccgtctcctcacgtccttaccgacctacgggccctacgtcccggtcccttccccgnggtccccg

SEQ ID NO: 251897 - DNA, 868 bp, Homo sapiens
  misc_feature: GYAE6OF02HMHNI.25.28.C06.1.454.CMB.1.raw
  modified_base (205)..(205): a, c, t, g, unknown or other
  misc_feature (205)..(205): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctaccatcctccctgtctgccatctgttcgganacagatccaccatccgtacttcgccggcgaggtcgaagggtctagttaacggtaaatttacgtttcggtccgttagggttactaccgaggaccgaaacggaaaacccggaaagggtaaaacgtttaccccttaaacccttcccgtactaacgttccttaaagttcgtaccgttcgacctacttacccttaacttttcggaaccgttaaacgggttttccggggttccccgtttagtacccggttacgttaccgtaacgggtcccggggtacggttacggggtttcgggttaccgggttaccggggtaaacgtaaccggtaaacgtttacccgtaaaccttacccgttacccgtaaaccctaactttaccggaacgtaccggtacccgtacccgttacggaaccgaccggttaccggtaaggtaaaacggttacgttacggttacggtaaccttaaactttttacccgttaaaggttaacctttaaaaccggttaaaagtttccgtaaaacgttaccgggtttacccgggtaccgttacgggttaccggttaccgggtttaccccgggaaaccggtaacgggttaaacccccggttaaagggttaccgggtaaacttaaccggtaaaacccggtaaaccggtttaacggtacgggtttaaccgg

SEQ ID NO: 251898 - DNA, 260 bp, Homo sapiens
  misc_feature: GYAE6OF02IWOCC.25.28.C06.1.454.CMB.1.raw
  modified_base (256)..(260): a, c, t, g, unknown or other
  misc_feature (256)..(260): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggcccagggaccaaggtggacatacaaacgaactgtggctgcaccatctgtcttcatcttcccgcatctgaactgtacagtctgacgcgggctggcaaggcgcagtagnnnnn

SEQ ID NO: 251899 - DNA, 819 bp, Homo sapiens
  misc_feature: GYAE6OF02HL3QH.25.28.C06.1.454.CMB.1.raw
tcagactgtacagtcacgaccggtgctcgatttagagctcacgtattgggtttgggggaagaggaagacgtgacggtcctcccaggagttcaggtgctgggcaccttgagcactgaacgcagcggactcaccatggagtttgggctgaactgggttttcctcgttgctctttaagaggtgtccagtgtcaggcgcatctggtggagtcgtgggggagcggtggtccagccgtgggaacgtccctggacgactctccgtggttcggtaggccgtacctaggacctaccgaccctttaccgagtacgtttagtcggtcctttcggtcttacgggggttccccgccgtaagttccggttaccaggggaccgtaagggggtccttggggacgttcggggcccttaggggggtaacgttttaccggtttgggtcccgttaggaaccgttaaggaaacccgtaaagttacggaaacctagtttaaccgtcccggtaacggacggggtaaaccgttcccggttacggggaacggggggtaccctaagttttaccccgaacgtacgtacccgtaccggaaacggggtacctaaacgtttacccgaaacggtaacccgtaaaccccggttactaacgttccgttaaccggtactaaaacgttacggaaacctaacgttaggaacgtacggttaacgacggtaacgtacggttcccgtttaagttcgtagtcgacgtaccgtagaaggcggtacggcttaaacgggaaacgttcgtacgttacgtaccttaacgtttccccggtacgttacccgtacggttacccgggg

SEQ ID NO: 251900 - DNA, 796 bp, Homo sapiens
  misc_feature: GYAE6OF02I8U9N.25.28.C06.1.454.CMB.1.raw
  modified_base (344)..(344): a, c, t, g, unknown or other
  misc_feature (344)..(344): n is a, c, g, or t
tcagactgtacagtcacgaccggtgctcgatttagagctcacgtattgggtttgggggaagaggaagactgacggtcctcccaggagttcaggtgctgggcaccttgagcactgaacgcagcggactcaccatgggagtttgggctgaacttgggttttcctcgttgctcttttaagaggtgtccagtgtcaggcgcatcgtgggtggagtcgtggggggacggtcggtcgggtccaaggcccgtaggggaaacgtcccctaggaccgaccttccgtcctggtaggtcggccgcctagacctcaccttcagttagttactggcctttcggtacgttcgggtccncctaggtcgtacccgagggccgaaagggggccttaggggagtagggtccgttaggggtagttttacgttcgggttactggacctaaggaaactaaagttgaacctaacgtagtccaacggcggtacggtccggtagggacgggggacctcgtttacccgaccgtaactccgtaccggaacgggtaacctaacgttaccgaacggaaccgtaacccttaccgttactaccgagtaacaaacgtacgtaaaccgaacgttagaacgttacggtaacggtacgggtaacgttaccgggttaccgttttaacgttacggtagtaccgtaccgttacccgtacgtaggggtaacggtccgggttaacgtaaacgggttaaaacggtttacggttaccgttaccgttaaccgtacccgtttcccggtaccggttacccggttccgggtaacccggggg

SEQ ID NO: 251901 - DNA, 652 bp, Homo sapiens
  misc_feature: GYAE6OF02FQQOC.25.28.C06.1.454.CMB.1.raw
  modified_base (209)..(209): a, c, t, g, unknown or other
  misc_feature (209)..(209): n is a, c, g, or t
  modified_base (388)..(388): a, c, t, g, unknown or other
  misc_feature (388)..(388): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggagcgtggtccagcctgggaagtccctgagactctcctgtgtggcncctagactcaccttcagtagttatggcttcgtctgggtccgccagtgtccaggcaaggggctggagtggctgggagttactggtctgacagacaatgacatatcacgcggagtccggtggacggggtccattccaccgtactccgtccgagggactaacgttaccaagacgaacccctntactcgtagacaaatcgaacctacgttagacgagtacgaaggtacgtaccggtcgttttaagttacgttgtcgaccgtaacctacggaggtacggtcggacgtaaggtaaaacgtcggtagtcctacgtacttcccggtaccgtaccgttcggtaccggggaccgacgggtcccacccgtcgtaccgtacccgtccgtcccgtcacgtcccgttaccgaccgtacggtcccgtacgtcccggtcccgttccccgtcggtccccg

SEQ ID NO: 251902 - DNA, 818 bp, Homo sapiens
  misc_feature: GYAE6OF02GMEKV.25.28.C06.1.454.CMB.1.raw
  modified_base (258)..(258): a, c, t, g, unknown or other
  misc_feature (258)..(258): n is a, c, g, or t
tcagactgtacagtcacgaccggtgctcgatttagagctcacgtattgggtttggggggaagaggaagactgacggtcctcccaggagttcaggtgctgggcaccttgagcactgaacgcagcggactcaccatggagtttgggctgaactgggttttcctcgttgcttcttttaagaggtgtccagtgtcaggcgcatctggtggagtcgtgggggagcgtggtccagcctgggagtcctgagctctctgtgtggcnctagactcaccttcagtagttatggtcttcgtcgtgggtcccgcagtgtccgaggcgaaggggctgggagtggcgtgggtagtttacttggtctgacagaacaaatgaactatactacgacggtcggaacgtccggtaggacgggggcctaagtttaccaccgtactacccgtacccggtaacggggtaacctaaacgttaacccgaaaacggtaaccgtaaaccccgtttaccgttaacgttccgttaaccggtaaacctaaaacgttaacgtaaaaccgttaaacgtttagggaaacggtaaacgggtacgggtaaacggggtaaacgtttaacccggggttacccgtttttttaaacgtttaaccggtttacgggtaaccggtacccggtaaccccgtttacgggtaacggggttaaccgggttacggggtaaccggtttaaaacgggggtaaaaacgggtttacccggtttaacggtttacccgttacccggtttaacccggtttaacccccgggttaccgggttaacccccggtttccggggtaaccccgggggg

SEQ ID NO: 251903 - DNA, 346 bp, Homo sapiens
  misc_feature: GYAE6OF02F5324.25.28.C06.1.454.CMB.1.raw
  modified_base (261)..(263): a, c, t, g, unknown or other
  misc_feature (261)..(263): n is a, c, g, or t
  modified_base (265)..(265): a, c, t, g, unknown or other
  misc_feature (265)..(265): n is a, c, g, or t
  modified_base (267)..(268): a, c, t, g, unknown or other
  misc_feature (267)..(268): n is a, c, g, or t
  modified_base (273)..(274): a, c, t, g, unknown or other
  misc_feature (273)..(274): n is a, c, g, or t
  modified_base (276)..(346): a, c, t, g, unknown or other
  misc_feature (276)..(346): n is a, c, g, or t
tcagactgtacagtcacgaccggtgctcgatttagagctcacgtattggggtttgggggaagaggaagactgacggtcctcccaggagttcaggtgctgggcaccctggtcaccgtctccctcagcttccaccaagggcccatcggtcttccccctggcgccctgctccaggagcacctctgggggcacagcggccctgggctgccctggtcaaggctacttccactgtacagtctgagcgggtctggcaaggcgcatagnnnancnngagcnngnnnnnnnnnnnnnnnnnnnnnnnnnnnnnnnnnnnnnnnnnnnnnnnnnnnnnnnnnnnnnnnnnnnnnnn

SEQ ID NO: 251904 - DNA, 568 bp, Homo sapiens
  misc_feature: GYAE6OF02JXJD0.25.28.C06.1.454.CMB.1.raw
  modified_base (235)..(235): a, c, t, g, unknown or other
  misc_feature (235)..(235): n is a, c, g, or t
  modified_base (385)..(385): a, c, t, g, unknown or other
  misc_feature (385)..(385): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
tcagactgtacagtcacgaccggtgctcgatttagagctcacgtattggtttggggcagaagtctctctcagtcaggacacagcatggacatgaggtccctgctcagctcctggactcctgctgctctggcctcccagctatcagatgtggcatccagatcgacccagtcctccattccctcctgtctgctatcgtgttaggaactacagacgtcaccatcacgtgcccgggtanacgtcgacggactagttaacggtaaattcgttcggccttaggtactcgaagtcaacggaaaaccgtgggtaaactttcccgaaacccttcctagtacttacgtatcgctacgctaacgtccttaacttgaacgtagttttcgggaccctntgacttgacgtcgactggtggtactagggactagtactcagtcctacactcacgtatcgacgtcctgcgacncctagaancgttagttnacttacttactgtacaattaaatcgtaactagtccgacgttgtattccggtacgaccgaggtacaggtgactagacctaaggtacgttgaacgg

SEQ ID NO: 251905 - DNA, 613 bp, Homo sapiens
  misc_feature: GYAE6OF02G0KXC.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtccaccatcacttcggccgggcgagtcgagggcattaggaaattatttggcctggtatcagtcaagaaaccgagggtaaagttacctaacctcctcatctatgctgcactcctactttgacttaacgttttcgggggttccccttctcgtaactttcgaaggcggtacgtaggttcgggtcgtaggggactagtaacttcactctccacctatcagcacgtcctagcacgaccgtgaacgtattgttcgaccttaaactttactttactagttaaaccttaaaaagtttcgaaacgtagtaccggtaccgtaggttagttacgggttcccggtacccggtaacgggtaacccgtaagggttacgggtaacgtaaccgtaaacgtaaaccggtacgtaggtaccggg

SEQ ID NO: 251906 - DNA, 761 bp, Homo sapiens
  misc_feature: GYAE6OF02JG7LK.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgaaccctagtcctccacttccctccctgtctgctactctggttggagacagagtccacctagtctacgttcggccgggtcgacggtcgaggggactaagtttaggtaaatttagttttcgggtaccgttagggttactacgtacgaccgtaaacggtaaaacccgtaaggggttaaaaccgtttaccccttaacccgttacccgtacctaatttaccgttaacgtcggtccttacggtacctaccttacccttaacgttttcgtaaccgttacgggttttcccgggggttccccttacttacggttactttacggcggtaccgtcggtaaggggtttcgggtcggtaacgggactaagtaaacctttacgtactacccgtacaacccgtataccgacgcctaaccggtccgtcgacctacggtaccgtagttaaaggtacgttcggttaacgtaccttaaaacgttttagttaaacccgttaggttaaaacttaaaacgtttcggaaacgttacggtaccgttacccgtgggtactcgggttaccggacgtaacgggactagggtacactaacgtaacggaaccgtattgtaccggg

SEQ ID NO: 251907 - DNA, 584 bp, Homo sapiens
  misc_feature: GYAE6OF02HSWCW.25.28.C06.1.454.CMB.1.raw
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggcattcaccatctcaggacaattccgaagagaaccctctatctgacaaatgaactacttagacgagtcgaggatacggtaccgtttattactgtgacgtactacaggagtggacgtaggaaaagtcgtaagtctactacgttcccgtacgtaccgtcgtcgggccgaggccacccgtgacctaccgtactccgtacacgtccttaccaccgtaacggcccagttcccggtaccttcccccgtcggtcccg

SEQ ID NO: 251908 - DNA, 765 bp, Homo sapiens
  misc_feature: GYAE6OF02IK1MF.25.28.C06.1.454.CMB.1.raw
  modified_base (163)..(163): a, c, t, g, unknown or other
  misc_feature (163)..(163): n is a, c, g, or t
  modified_base (182)..(182): a, c, t, g, unknown or other
  misc_feature (182)..(182): n is a, c, g, or t
tcagactgtacagtcacgaccggtgctcgatttagagctcacgtattgggtttgggggaagaggaagactgacggtcctcccaggagttcaggtgctgggcaccttgagcactgaacgcagcggactcaccatggagtttcgggctagaacttgggttttccncgttgcttcgtttaagggngtctcgtagtcgacgcgcgactcgtggtggagtacggttggggaggggcgtcggtcgacgcgtcggaggtaccgtcgagacgttctccgtcgtggtcggtacgtcctacgtactacctacctcgtacgtagttagttcgcgttcgttacgtcggtcggtccagtgtccgacggagtacgggaggtcgtaggtcgtcggacggttaggttacgttacgttgcgtaacgaacgtaacgaaattagaccaacttaacgcgtacgacggtacggttccggtcgaacggggtaccggtactacccttaaccgaacgtacgttacccgtaaacgggtaacgtaaacgtaaccgtaaacgaacgtaaacccgttaccgtagtaaccgtacgtaaaccggaaaacttaacggtaaaccgtaaacgttaacggacgggtaaacttcgggaaacggttacgtaaaccgtttcgtttaaaccgttttaagacgttcgtaaccggacctaccggtagaaggttccgaaaggtaacgtaaacggtaacgtttcgacttcgtaacccgtctacccggtcgtacccggttaggaccgg

SEQ ID NO: 251909 - DNA, 578 bp, Homo sapiens
  misc_feature: GYAE6OF02IIRWU.25.28.C06.1.454.CMB.1.raw
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (570)..(570): a, c, t, g, unknown or other
  misc_feature (570)..(570): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccgcagtgtccaggcaaggggctggagtggctgggattacttggtctgacagacaaatgacatatcacgcggatccgtgagggccattcacatctacgaggacattccaagacgaacctnatcngacaaatgaacactgagtagtacgagatacgtcttatactgtcgcgactacgaggtacgtgtacttagaaaacgtgtagtctacgtacttcccgccgtacctacgtcgggccgacggccgaccgtcggtccgtaccgtaccgtcctccgtacgtccttacccgaaccgtacggccctacgtccggtcccgttccccgnggtccccg

SEQ ID NO: 251910 - DNA, 627 bp, Homo sapiens
  misc_feature: GYAE6OF02H9MEO.25.28.C06.1.454.CMB.1.raw
  modified_base (487)..(487): a, c, t, g, unknown or other
  misc_feature (487)..(487): n is a, c, g, or t
tcagactgtacagtcacgaccggtgctcgatttagagctcacgtattgggtttgggctgaactgggttttcctcgttgctcttttaagaggtgtccagtgtcaggcgcatctggtggagtctgggggaggcgtggtccagcctgggaatccctgagactctcctgtgtggcgcctagactcaccttcagtagttatggcttcggtctgggtccgccagtgtccaggccaaggggctgggagtggctggggagttaccgttggtctgacgagacaaatgacatatcacgcggagtccgaggacggggcctatcaccattctccgagggacattaccaagacgaaccctctatctagaccaatacgaactaacttgacgtagtcggagacgtacggtaccgtttatcgtgtcgcgacctgaggtaggtgcgtaagggaaacttcggtacgtcgtacctacgttcccgtacgccgtcggtacgggtaccnggggtacccacccggtggtaccctaccgtcctcctcgaccgttcctacccgaaccggacgtcccgtacgtccggtcccttccccgtaggcccgtcccgttgcccgtaccgacgtaccgactacccggtcggaccgggtcc

SEQ ID NO: 251911 - DNA, 694 bp, Homo sapiens
  misc_feature: GYAE6OF02IOB8C.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctccgtgggactcctgctgctctggctccagctatcagatgtgcatccagatcgacccagtctccactcctccctgtctcgcatctgttggagacagacgtccacctatcacgttcggcccgggtagacgttcgaaggggtcaagtttaggaaaatttcgtttacgggccttagggtactacgaagtcaaaggaaaccgaggggtaaaacttaccctaacctcctacgtacttctaagtcgccttagcctacgttcctactttcggaacgttacgggttttccggggtaccccttaggttaccgtacgtttaccggacggtccggacgtacggggttcgggtcgtacgggtaacgtaacggtaactttccgaaccttctaacctaacctagtaccgaagccacgccgttacgcgacgtccgtagtacgtgttacgttacgtacttaactttagttaacttaacgttaaacgttaaaacgtttcggaacgtaacgttaccggtacggtaggtacgttcggtacccggaccggtacggggaaccgtaagggtacgacgtaacggaccgtaaacgtacggtgtacgg

SEQ ID NO: 251912 - DNA, 722 bp, Homo sapiens
  misc_feature: GYAE6OF02ITI34.25.28.C06.1.454.CMB.1.raw
  modified_base (370)..(370): a, c, t, g, unknown or other
  misc_feature (370)..(370): n is a, c, g, or t
  modified_base (520)..(520): a, c, t, g, unknown or other
  misc_feature (520)..(520): n is a, c, g, or t
  modified_base (570)..(570): a, c, t, g, unknown or other
  misc_feature (570)..(570): n is a, c, g, or t
  modified_base (615)..(615): a, c, t, g, unknown or other
  misc_feature (615)..(615): n is a, c, g, or t
tcagactgtacagtcacgaccggtgctcgatttagagctcacgtattggggtttgggggcagaagtctctctcagtcaggacacagcatggacatgacgggtccctgctcagctccgtgggactcctgctgctctgctccagctatcagtactgtggacatccagatcaccatcctccactccctccctgtctacgactactcgttggtaggacgacacggtaactaccaaccgtatccacgttcgggccgggacgtagtcgaagggtacagttaagggttaaacttaggttcggtcctaggtactacacgaacgtaaacggaaccggaacgggttaacttaccccctaacttacgacctataccttaancggtactcgtaactaccgttactacgttacggtacggttaacgttttccgggggtaccctacgtttaggacttacggacggtcggtaccggtaggggttcggtaccggggttacgggaactttaagaacttaccctaaactccttaaccncgtaacctagccgtaccacgtcgtcgaaccgtccgtaaacgtataacggnttacggtaactacttaacttacgtaattaaggaaaactttaaacncggtaacgtaccgggttaccgtacggtacggttactttcggggtaacccgaggttaaccggtaccgtaaacggtacgtacaaacggtaacaaaccggttgtacgtcg

SEQ ID NO: 251913 - DNA, 754 bp, Homo sapiens
  misc_feature: GYAE6OF02G8XWD.25.28.C06.1.454.CMB.1.raw
  modified_base (139)..(139): a, c, t, g, unknown or other
  misc_feature (139)..(139): n is a, c, g, or t
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
  modified_base (371)..(371): a, c, t, g, unknown or other
  misc_feature (371)..(371): n is a, c, g, or t
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggntctgggcaccgtggagtctgggggagcgtggtccagcctgggaagtccctgagactctcctgtgtggcgcctagactcacttcagtagttatggcttcgtctgggtccncagtgtccaggcaaggggctggagtggctgggagttacttggtctgacagacaaatgacatanacgacgcggagtccgtgaggggccattcgacatctaccaggacaacttcaagacgacctntactctagacaaagtcgaaactacgtagacgtacgtacgaacggtacgtacgggtacgtttaacgttacgtacggtacgtaccgtacccgtacgtaacgggtaacggttacgggtacgtaaagggtaaaaacggttcggtttaacggttacgttaccgttaaccgtttaccccggttaccgtaacccggtttaccggtaccgggggtacccggtaaaccgggtacccgtaacccccgggttacggtaccccgttaacccggtttacccgttacccgttacccggttaccggttacccgtttaacccccgaaccggtaacccgggtaccccgttaaccgtttacccgggttacccgttttccccccgtacccggttacccccgg

SEQ ID NO: 251914 - DNA, 708 bp, Homo sapiens
  misc_feature: GYAE6OF02HSKMW.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtggcatccagatcgacccagtcctccactccctccctgtctgctatctggttggagacagactaccaccatcacgttcggccgggcgagtcgaggctaagttaggtaaactttgttcggcgttgtacgtacacggacaacgaaaccgaagggtaacttaccctaacctcctactactctagtcgctacgcctacgtaccctacgttttgaccgttaacgggttttccggggtccccgttaccgttacgtacgtttccgaacggtccggggtctacgggttcggggtccggtggggtaacctaacgttacttaccgtaaccctcgtacctaaccctacgtacgtacggacctaccgtccgtacggtacctaacggtacgtacgtaacgtacggttaggttcgtaaaccttaccgttttaactttaacgttaacgttaaactttaaaaggttcgaaccttacggtaccgttaccgggtacgttacgttcgggttacccgaccggtaacgggtacccgaagggtaccgactaacggtaaccaacgtacgttcggtacgg

SEQ ID NO: 251915 - DNA, 792 bp, Homo sapiens
  misc_feature: GYAE6OF02H8DB0.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccactccctccctgtctgctatcgtgttggagacagacgtcacatcacttcggccgggcgagtcgagggctagttaggtaaatttgttaggtccttaggtatcgaagacaacggaaaacccgtaaggggttaaaccttaccctaaacccgttcctacaactttcttaaacgtcgtaccttcgactacctaccttaacgtttggaaccctttaaggggttttcccggggtccctacgtttcggtacgtttacgacgggtcgacggtaagggttcgggtccgtaacggggtaactaaggtaacctttacctaccgttaccgtacccgtaaccctagtaccgacggtaccgtaaccggtacccgttaaccgacgtaaccggaccgttaacgggaacgtaacgtttacggtttaacggtaaccctttaaacgttttaaccgtttaaaccgttaacgtttaaaacctttaaaaacgtttaccggtaaacgtacgggttacccgttaacccgggtaggttacggttacggtaccccggggtaacccggaaacggggtaaccgtaacggggtaacggtaacccgtaacgttaaaccggtaaaaccggttacgtacgggtaaccgg

SEQ ID NO: 251916 - DNA, 720 bp, Homo sapiens
  misc_feature: GYAE6OF02IGLL2.25.28.C06.1.454.CMB.1.raw
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
  modified_base (374)..(374): a, c, t, g, unknown or other
  misc_feature (374)..(374): n is a, c, g, or t
tcagactgtacagtcacgaccggtgctcgatttagagctcacgtattgggtttgggggaagaggaagactgacggtcctcccaggagttcaggtgctgggcaccttgagcactgaacgcagcggactcaccatggagtttgggctgaactgggttttcctcgttgctcttttaagaggtgtccagtgtcaggcgcatctggtggagttcgtgggggaggcgtggtccaggcctgggaacgtccctgagactctcctgngtgcgctagctcacttcagtntatgcttcgtctgggtccnctagtcgtcccagggccgaagggggcttgggagttggcgtggggagtttacgttggtctgacagacaatgacatancgacgcggtagtccgtaggacggggcctagtttccaacctacgtctaccgagggtaacaacgttaccgaaacggtaacgaaccccttcgtaattccgttaacgaactaaaacgtacgtaaaccgtaaccgtttagaacggtaacggtacggtaacggtaaccggtaacggttaccggtttttaaccttaccgttcggttacggaccgttaaccgtcgtaaacggggtacggttacgggtaaccgttaaacgggggtaaaaacggtttacggttaacggtttacccgttacgttaacccggtttaccccggttacccggtaaccccgttccgggttaaccccggggg

SEQ ID NO: 251917 - DNA, 724 bp, Homo sapiens
  misc_feature: GYAE6OF02IRC99.25.28.C06.1.454.CMB.1.raw
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtcgtgggggagcgtggtccagccgtgggaagtccctgagactctcctgtgtggcgcctagactcacttcagtagttatggtcttcgtctcgggtccgccagtcgtaccaggcgaaggggctgggagtggcgtggggagttacgttggtctgacgagaactaatcggacattaagcctacggcggagtcccggtggaacggggcctagttcaacctgtcctaccgaagggtaacctaacgttaccgaaaggtacgaaacccccgtttgtaacttaccgtagaaacctaaagttacggaaaccctaaaggttgggaaccgtaggttaccgaagggttaactacgggttaaccgttttacgttaaccgtgggtacgtacggggaacgggtacgtaacgttacgttacggtttagtttacgttacgttatttaccgttacttttaccgacgttcgggaccttcggttcccgtgtcgacttcgttccgctccgacgtcccttaccgaccgtaacggtccctacgttcccggttcccttcccgtcgggacccgtccccgttggtaccctaccgg

SEQ ID NO: 251918 - DNA, 680 bp, Homo sapiens
  misc_feature: GYAE6OF02HZ0JD.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtgcatccagatcgacccagtcctccactccctccctgtctgcattctgttggagacagacgtaccacctatccacgttcggccgggcgtagtcgagggtactagttaggtaaatttagtttcggccttaggtactcgagaccaacggaaaccgtaaggggtaaactttcccctaaccgtcctacctacttcgtatcgtctcgactacttcctacgttttagaccgttaaggttttccggggtaccctcttacgtacttacggacggtcggacggtacgggttcgggtacgtcgggaactaggttaactctaccgtctaccactacgtcacgaccgtacgtcctacgaccgtacgtacccgtagtaacgtgttacggttaacgtacctttaaacgtttagtttaacccgtaagttaaaccttaaagttcggaaaccttcgggtaaccgttacccgggttagtacgttccgggttacccggaacggtaacggaccgtaggtacgacaaccgtaacggaacctggtggtacg

SEQ ID NO: 251919 - DNA, 704 bp, Homo sapiens
  misc_feature: GYAE6OF02GV6EQ.25.28.C06.1.454.CMB.1.raw
  modified_base (251)..(251): a, c, t, g, unknown or other
  misc_feature (251)..(251): n is a, c, g, or t
  modified_base (328)..(328): a, c, t, g, unknown or other
  misc_feature (328)..(328): n is a, c, g, or t
  modified_base (375)..(375): a, c, t, g, unknown or other
  misc_feature (375)..(375): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgcctagactcaccttcagtagttatggcttcgtctgggtccnccagtgtccaggcaaggggctggagtggctgggagttactggtctgacagacaaatgacatatcacgcggagtccgnggacgggccattccacatcctcgaggacaattccaaagacgaacctntactcgtagactaaagtcgaaactacgttgaagtacggtacgaagggtaacgttaaccgggttaccgttttaagttaaccgttggttacgaccggtaaccctacggtaagggtaggtacgggtacgtaagggtaaaacgttcggtaacgtcgttactaccgtttccccgtccgtacccgttcggtaccggggtccgtacgggccctacccggtcggtcccgtaccggttcccgttcccgtaccgtacggtcccgtttacccgaacccggtaaccgggtccccgtaaccggttacccggttccccgtttaccccccggtcgggtcccccg

SEQ ID NO: 251920 - DNA, 290 bp, Homo sapiens
  misc_feature: GYAE6OF02IHZNG.25.28.C06.1.454.CMB.1.raw
  modified_base (268)..(290): a, c, t, g, unknown or other
  misc_feature (268)..(290): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgtccggccagggaccaaggtgacatacaaacgactgtggctgcaccatctgtcttcactccttcccgctatctgaacttgtacagtctggaggccgggtatcgggacgaaggtccgacaatggannnnnnnnnnnnnnnnnnnnnnn

SEQ ID NO: 251921 - DNA, 668 bp, Homo sapiens
  misc_feature: GYAE6OF02FYXM8.25.28.C06.1.454.CMB.1.raw
  modified_base (236)..(236): a, c, t, g, unknown or other
  misc_feature (236)..(236): n is a, c, g, or t
  modified_base (348)..(348): a, c, t, g, unknown or other
  misc_feature (348)..(348): n is a, c, g, or t
  modified_base (405)..(405): a, c, t, g, unknown or other
  misc_feature (405)..(405): n is a, c, g, or t
tcagactgtacagtcacgaccggtgctcgatttagagctcacgtattggggtttggggggaagaggaagactgacggtcctcccaggagttcaggtgctgggcaccttgggcacgggggaggtgtgtcacaagatttgggctctggggcaccgtggagtctgggggaggcgtggtccagcctgggaagtccctgagactctcctgtgtggcgcctagactcaccttcagtagttanggtcttcgtcgtcgggtcccgccagttgtccagggccgaaagggggctgggagtggctggggtagttacttggtctgacaggacaaatgacatatcgacggcggagtccggnggacgggtccattccaccatccaccgagggacctaattaccgaagacgtaacccctntaactcgtacgaacaaagtacgaaactaaacgttgaacgtaggtacggaacggtacgtaacggtccgtttaattacgtagtcgaccgtactcgaaggtgtggtacgtaaggaaacgtcgtacgtctacgtacttacccggtacgaccgttcggtcggggaccacgggtccacccgttacggtccgtaacccgttccgtccgtcgaccgtccttacccgaaccgtaacggccctacgttccggtcccttcccggtcggtccccg

SEQ ID NO: 251922 - DNA, 585 bp, Homo sapiens
  misc_feature: GYAE6OF02IRRPC.25.28.C06.1.454.CMB.1.raw
  modified_base (205)..(205): a, c, t, g, unknown or other
  misc_feature (205)..(205): n is a, c, g, or t
  modified_base (443)..(443): a, c, t, g, unknown or other
  misc_feature (443)..(443): n is a, c, g, or t
  modified_base (512)..(512): a, c, t, g, unknown or other
  misc_feature (512)..(512): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccatcctccctgtctagctatctgttgganacagagtccacatcacttggccggcgtagacgagggactagttaggaaaatttagttcgaccgttggtatcgagacaacggaaaccggaagggttaacgttcctaaaccctcctacacttacttatgctcgctactcctactttgtacttaacggtttccggggtcccttctacgtacttacgagtcggactaggtcggtacgtaggactaagtaacttacgactacctacacactancgacacgctacgcacggcacgtagacttaggtcacttaaagttcttacgtagttaaaccttaaaagttnaaccgtacgtacgtaccggtgtacgtcggttaccgacggtaacggcgaaggtcgactagacgaagtcgtgacg

SEQ ID NO: 251923 - DNA, 776 bp, Homo sapiens
  misc_feature: GYAE6OF02JVE0H.25.28.C06.1.454.CMB.1.raw
tcagactgtacagtcacgaccggtgctcgatttagagctcacgtattgggtttgggggcagaagtctctctcagtcaggacacagcatggacatggacgggtccctgctcagctccgtgggactcctgctgctcgtggcctccagctatcagatgtgcactccagactcgaccctagtcctcctactccctcctgtcctagctattcgtggttaggaacgactagacgtccaacctactcctacggttcggccggagacgtcgaggctaagtagttaaagttgttcggtaccgtaggttactacgaacgtacgaaacggtaaacggtaacgggtaaaccgtttacccctaaaccgttcccgtaacctaacgttccgttaaacgtcggttacctacggtaccttaacccttaccgttaacgtttacggtaacccgtttaacggggtttcccggggtaccccttaccgttaacgtacgttaccggacggtcggtacgtacggggtttacggtacggtagggaacgtaacgttaccgttactaccttacccgtactaaaccgtacgtacgacggtaacctcggtcccaggccctacggtacgactaagtctacgttactaaccgtttagttaccgtaacgtaagtaaaccgtttaaagtacccgaagttacggttacccgtacggttagttacccgttcgggtaaccccggtacggtaaacggtccggttaaaggtaccgaaacgttaccgaaaaccgggtaacgttcggtggtaaccg

SEQ ID NO: 251924 - DNA, 614 bp, Homo sapiens
  misc_feature: GYAE6OF02IQIC9.25.28.C06.1.454.CMB.1.raw
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (500)..(500): a, c, t, g, unknown or other
  misc_feature (500)..(500): n is a, c, g, or t
tcagactgtacagtcacgaccggtgctcgatttagagctcacgtattggggtttgggggcagaagtctctctcacgtcaggacacagcatggacatgagggtccctgctcagctcctgggactcctgctgctctggctcccagctatcagatggtggcatccagatgacccagtctccactcctcctgtctgctatcgtggttgacgacaagagtaccaccgattcacgttcggccggcgagtcgaggcagttacgaattacgttgctgatcacgcagaaacaggtaactcctaactcanactactagcnctgctatacctattcgacgtaggttccgggtacctctacgtactcgacgacggctaggttcggtacgtcgggaactaacgtacttacctacgtcgtaccacgtacgtaggactacggactccgtaggctaacgccgttaagagtacgttgttacgaacttacgttattaactacgtaaacttaacgttanacgtacgtaccggtaccgtacgttacccggtaccggttaccgaacccgggtaacgtaaaccggttacggtaacgtaacgtaaccgtaacgtaaaccggtatacgggttaaccgg

SEQ ID NO: 251925 - DNA, 762 bp, Homo sapiens
  misc_feature: GYAE6OF02GXBW9.25.28.C06.1.454.CMB.1.raw
  modified_base (366)..(366): a, c, t, g, unknown or other
  misc_feature (366)..(366): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatggtgcatccagatcgacccagtcctaccacttcccgtccctgtctcgacattctggttaggacgacagacgtccaccctatccgacgttcggacccggcgacgtcgagggctaagttacggtaaatttagtttcggtaccgttggtactcctaacgacgaaacgaaaccggaacgggttaaacgttacccttaaccctctactatcgtaatcgtntcgtactaccttcctacgtttcgacgttaacggttttccggggttaccccttacgttaccgtagttaccgacggtacggacggttggttcgggttcgttacgggacgtaacgttaacttaccctaccgttcctaccctaacccgtacgtaccgaccgtaccggtaccgtacccgttacgaccgtaaccgtcccggtaagggtaaacggttaccgtttaggtttacccgttaaacctttaaccgtttactttaaaccggtttactttaaaacgttaaacgtttaacgtaaacgttaccggttaaccgtacggtacgttcggtaccggttaccggaaccggtaacggtaccggaacggtacgtaactacgtaaccgaacggtaccgtaggtaacccgg

SEQ ID NO: 251926 - DNA, 660 bp, Homo sapiens
  misc_feature: GYAE6OF02FTEHX.25.28.C06.1.454.CMB.1.raw
  modified_base (201)..(201): a, c, t, g, unknown or other
  misc_feature (201)..(201): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttgganacagacgtcaccatctacgtggccggagagtcgaggctagttaggtaaattttgttggccttaggtactcgaagcgaaacgaaaaccggtaagggtaaacttacccctaaaccgttcctacaacgttactacgtcgctgacctacgttacctacgtttgaccgttaggttttccggggtcccttacgtacgtacgttcgacggtcggtacgtggttcgggtacgtagggaactagtaacttcgactaccgtaccacgtactaccgacaccgacgccttcggactacgtaccgtaggaacgttagttacgttacgtaactttaaacgtttacttaaccgtaacgtttaaacttaaaacgtttcgaacgttacccgtacggttaccgtagtaccggttcggtacccgtaccggaacgggtacgtaggtacgtaactaacgtaaccgaacgtacgtgtacgg

SEQ ID NO: 251927 - DNA, 806 bp, Homo sapiens
  misc_feature: GYAE6OF02I0W8R.25.28.C06.1.454.CMB.1.raw
  modified_base (197)..(197): a, c, t, g, unknown or other
  misc_feature (197)..(197): n is a, c, g, or t
tcagactgtacagtcacgaccggtgctcgatttagagctcacgtattgggtttgggggcagaagtctctctcagtcaggacacagcatggacatgaggtccctgctcagctcctgggactcctgctgctctggctccagctatcagatgtgcatccagatgacccagtctccatcctcctgtctgctatctgttganacgagagtcacatcacgttgccggacagtcgagggctagttaggaaatttagttcggccttagggtatcgaagtacgaacgtaaaccgtagggtaaacttcctaaacctcctacacttctatcgctagactactcctacgtttcgtacgttacggtttcgggtcccttacgtacgtacgtttcgaacgtcggtacgtacggttcgggttacgtacggggaactaacggtaactttaccgtaaccttacccttacccgaaaccgtacgttaccgaacggtcccgtaaaccgggtccgttacgggacccctaaccggggttacccgtaacgggtaaacgttaaccggttcggtttaaccggtaaaccttttaaaccggttttaaccgttttaaaccggttaacgttttaaaaaccgttttaaaaacgttttccgtaaaccggtaaccggggtttaacccggtacccgggtttacgggttacggtttaaccccgggtttaacccgggaaccccggtaaccggggttaaacccggtaaacggggttttaaccgaaaccggttaaccgttaaaaacccggtaaaccgggttaaccggttcgggtttaacccggg

SEQ ID NO: 251928 - DNA, 884 bp, Homo sapiens
  misc_feature: GYAE6OF02G9ZSW.25.28.C06.1.454.CMB.1.raw
  modified_base (251)..(251): a, c, t, g, unknown or other
  misc_feature (251)..(251): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggagtccctgagactctcctgtgtggcgctagactcaccttcagtagttatggtcttcgtcgtgggtccncagtcgtccaggcgaaggggctggagtggcgtgggtacgttacgttggtctagactagaactaatgaacatatccgacggcgggtacgtccggtagggacggggcctacttccgacctacgtcctacccggagggtaacctaacttaccgaaacggaccgtaacccttactaacgtaccgtacggtaacctaaaacgttacggtaaaaccttaacgttaggaacggtaacggtacgggtaacgggtaaccggtttacccggggttaaccgttttttaaacgtttaccggtcgggtttaccggaacccggttaacccgttcgggtaaagggttacgggtttaccgggtaaaccggttaaaacgggtaaaaaccggggttttccgttaaccggttaccgtttaacccggttaccggttttccccccggaacggtttaacccggtccggggtaaccgggggttccccggaaacgggtccccctaccgggtttaccgggtaccccttaacccggggttccccttacccggtaccggttacccgttacccggtttaaccccccgaaccgggttaacccgggttccccctaacgggtttcccccgggttaccccgtttcccccgggtaggtccccccgg

SEQ ID NO: 251929 - DNA, 947 bp, Homo sapiens
  misc_feature: GYAE6OF02GWULD.25.28.C06.1.454.CMB.1.raw
  modified_base (196)..(196): a, c, t, g, unknown or other
  misc_feature (196)..(196): n is a, c, g, or t
  modified_base (333)..(333): a, c, t, g, unknown or other
  misc_feature (333)..(333): n is a, c, g, or t
tcagactgtacagtcacgaccggtgctcgatttagagctcacgtattgggtttggggggaagaggaagactgacggtcctcccaggagttcaggtgctgggcaccttgagcactgaacgcagcggactcaccatggagtttgggctgaacttgggttttcctcgttgctcttttaagaggtgtccagtgtcaggcncatcgtgggtggagtcggtgggggagcgtcggtccagccgtagggaacgtcccgtgacgtactcctccgtgtgtggccgcctagacctcctaccttacgaagttagttagtcggtctttccgtcgttcggggtcccnccgtaggttccggtaccgagggtaccggtaacggggggtccgtaggggtacgggtcggggtacggttagggggttaacgttttccggtttggggttaccctagggtaaaccgtaaagggtaaacctaaaagtcgaaaccttaaagttaaccttaccgggaaaccggtccgggggtaacgttcccggggtaaggggaaccgggggtacccgttaactttacccgaaccgttaccgtcccgtaaccggaacgggtaaacctaaccgttaaccgaaacggtaaacccgtaaccccgttctaaaccgttaccgtacgtaaaacgttaaaacgtaccgtaaaaaccgttaaccggtttacggaacgggttaacggttaaccggtaaacggggttaaccggttttaaacccgggttaccgttttttaaaagttacccggttacggttaaccggtaaccccggttacccgtaccgggtaagggttccgggttaacgggtaacggtttaaaaccgggggtaaaacgtttcccgggttaacgtttaacccggttaccggttaacccccggttttacccccgggtaccggttacccccgggttacggggtaacccccggggggg

SEQ ID NO: 251930 - DNA, 847 bp, Homo sapiens
  misc_feature: GYAE6OF02FNP4J.25.28.C06.1.454.CMB.1.raw
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
tcagactgtacagtcacgaccggtgctcgatttagagctcacgtattggggtttggggggaagaggaagactgacggtcctcccaggagttcaggtgctgggcaccttgggcacgggggaggtgtgtcacaagatttgggctctgggcaccgtggagtcgtgggggaggcgtggtccagcctggggaacgtccctgagactctcctgtgtggcncctagctcaccttnagttagttatggcttcgtctgggtccnccagtgtccaggcgaaggggctgggagtggcgtgggagtttacgtggtctgacagacaaatgaactatatcgacggcggtacgtccggtggacggggtccctattccgacctactccgtaccgaagggtactaaacgttaccgaaacggtactaaccccttcgtaatccgttaacgaaaccgtaaaagttaacggaaaccgtaacgtttacggaagggtaaccggttacgggtaaacgggtaaacggtttaaccgggttaaccgtttttaaacgtttaaccgttacggttaacggtccggtaaccccgtacggtaacggggtacggttacggggttaacggttaaaggggtaaaaacgttccgggttaacggttacccttaccggttaacccgtttaccccggttaccgttaacccgttccgggttaccggggtaccggaccgggtacccgttacccggttaccgggttacccgtacccgttacccggttacccgttaccgtaaccgggtacccgttaccccggtaaccggaacccgggtacccgttaacccggttcccggttacccccgtttccccggtccgggtaccccg

SEQ ID NO: 251931 - DNA, 622 bp, Homo sapiens
  misc_feature: GYAE6OF02ILU1E.25.28.C06.1.454.CMB.1.raw
  modified_base (205)..(205): a, c, t, g, unknown or other
  misc_feature (205)..(205): n is a, c, g, or t
  modified_base (310)..(310): a, c, t, g, unknown or other
  misc_feature (310)..(310): n is a, c, g, or t
  modified_base (403)..(403): a, c, t, g, unknown or other
  misc_feature (403)..(403): n is a, c, g, or t
tcagactgtacagtcacgaccggtgctcgatttagagctcacgtattgggtttggggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccnccagtgtaccaggcaaggggctgggagtggctgggtattacgttggctgacagaacaaatgacatatcacgacggagtccgtagaggggcatcacatctcgaggnaattccaagacgaaccctctatctagacaaatgaactaacttgacgacgtcgaagtactacggtactttagtactgtacgcgtacctcgaagngtaggactaaggtaaagtcgtagtactctaccgttccgtacgccgttcgtcgggccgtacgggctaacccgtgtacccgtaccgtcctcctcacgtctaccgaccgacggtcctacgtccgttacccgtcccgtcggtcccgtccctaggtccctaccgtaacggcgtccctaaccgtcggtaccggggcaccggaccggtccggcccgttgggtaccg

SEQ ID NO: 251932 - DNA, 784 bp, Homo sapiens
  misc_feature: GYAE6OF02IH367.25.28.C06.1.454.CMB.1.raw
tcagactgtacagtcacgaccggtgctcgatttagagctcacgtattggggtttggggggaagaggaagactgacggtcctcccaggagttcaggtgctgggcaccttggggcacgggggaggtgtgtcacaagatttgggctctgggcacttggagtcgtgggggaggcgtggtccagcctgggaagtccctgagactctcctgtgtggcgcctagactcaccttcagttagttatggctttcgtcgtcgggtccgcctagtcgtaccgaggcgaagggggctaggaggtcgggcgtggggtagttacgttggtctggacagacaaagtgactatactcgacgcggagtccggtaggacggggcctagttccgacctacgtcgtaccgaagggacctaacgttaccgaaggaacgaacccgtctactacgtacgaactaaaagtacgtaaacgtaactacggaagtacggtacggaagggtaacgttaaccgggttaccgttttaacgttacgttaggtacggacccgttacccgtagtaacgggttaacgggttgggaacggttaagggtaaaaaacggttcggttaaagttccgttacgttaaccgtttcccggttaaccggtacccgtttacgggtacggggacccggtacggggtccgaccccggttcggttacccggacccgttaccgtcccgtaccgtacgtacccttacccggaaccgtacccggggtaccctccgggttacccggttccccgtttaccccggtcggtacccccgg

SEQ ID NO: 251933 - DNA, 717 bp, Homo sapiens
  misc_feature: GYAE6OF02JGI48.25.28.C06.1.454.CMB.1.raw
  modified_base (230)..(230): a, c, t, g, unknown or other
  misc_feature (230)..(230): n is a, c, g, or t
tcagactgtacagtcacgaccggtgctcgatttagagctcacgtattggggtttggggggaagaggaagactgacggtcctcccaggagttcaggtgcgtgggcaccttgggcacggggggaggtgtgtcacaagtagtttgggctctgggcaccgtggagtcgtgggggaggcgtggtccagccgtgggaatccctgagacctctctgtgtggcacctagctcaccttnagtagttatggtcttcgtcgtgggtcccgctagtgtccagggcgaggggtctgggagtggcgtgggtagttacttcggtctggacaggaacaaatgactagtctacgacggcggtacggtcggaggacggggtctattccgaacctatcctaccgagggactaacgttaaccgaacgtaacgaccccttatagtcctagaactaaagcgaaactacgtagaggtacggtacgagggtaacttaacgggttaccgtttaattacggtgtacggacctaccggtacgagggtacgttcgggaacgtaaagggtaaaacgttcggtacgttctacgtaccgtttcccggtaccgtaccgttcgggtaccgggtaccgaacggtaccctaccggtcggtaccgttcccggtacgtcccgagccgttaccctaccggaacccggtacggcccgttaccggtcccgtttaccccgttcccgtccggtacccgg

SEQ ID NO: 251934 - DNA, 857 bp, Homo sapiens
  misc_feature: GYAE6OF02F1S32.25.28.C06.1.454.CMB.1.raw
tcagactgtacagtcacgaccggtgctcgatttagagctcacgtattggggtttgggggcagaagtctctctcagtcaggacacagcatggacatgagggtccctgctcagctcctgggactcctgctgctctggctcccagctatcagatggtgcactccagatcgaccctagtctccatcctccctgtctgcatctgttggagtacagacgtcacctatccgacgttggacccgggtgagtcgagggctagttaggtaaaactttgtttcggccgttggtatacgagacgaacgaaaccgagggtaaacgttaccctaaaccgttccctaccgtacttacgtacttcggtactacgtacgtaccttccgtaacttttacggtaccgttaaacggttttcccggggggttccccttacggtttccgttaacgttccggtaacggtcgggtacgttaacgggttcggggttaccgtaacgggggaaccttaaaggttaacttcccgtaaacctttccccgtaccgttaaccgtaaccgttacgaaaccggtaaccgtaccgtccgttaggggaccctaacggtaaccggttaacggtaaggtaaacggtttcgtttaaaccgggtaacctttaaacgttttacctttaacgttaaaccgttttaaaacttaaaaacggtttttccgaaaaccggttacgggttaacccggtaccgggtttacgggttaacgggttaccgggttaaccccggttaacccggggtaaaccgggttaacccggttaaacgggggttaccggaaacgtttaaacccgggaaacccggtaaaacccggttaacggttagggttaacccgggg

SEQ ID NO: 251935 - DNA, 626 bp, Homo sapiens
  misc_feature: GYAE6OF02GW2HN.25.28.C06.1.454.CMB.1.raw
  modified_base (236)..(236): a, c, t, g, unknown or other
  misc_feature (236)..(236): n is a, c, g, or t
  modified_base (514)..(514): a, c, t, g, unknown or other
  misc_feature (514)..(514): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgccgctctggctcccagctatcagatgtggcatccgagatcgacccagtcctccactccctccctgtctgctatctggttaggagacagactccaccatcacgttggccggngagtcagggctagttaggaaatttacgttggccttaggtactcgagtaccaaacgaaaacccggtaaggggtaaaacgtttcccctaaacccgttcccgtactaacgttcctaatcgtcgttacgacctaactcctacttttggaccttaacgttttccgggggtccccttctacggtattcgaacggtcggtacctagggttcgggtctcggggaactaggtaacttcgacctctacacctatccgagcacgtctgcgacgcctaagacgtatcgtnacgtattacttctagtactaaattcacgtacgtacgcgttggtactcgggtccgaccgtaacgggaccgtaagggttcgaacgtacgtaaccgaacgtgtcggtaggtaccg

SEQ ID NO: 251936 - DNA, 820 bp, Homo sapiens
  misc_feature: GYAE6OF02HU9BP.25.28.C06.1.454.CMB.1.raw
  modified_base (157)..(157): a, c, t, g, unknown or other
  misc_feature (157)..(157): n is a, c, g, or t
  modified_base (160)..(160): a, c, t, g, unknown or other
  misc_feature (160)..(160): n is a, c, g, or t
  modified_base (193)..(193): a, c, t, g, unknown or other
  misc_feature (193)..(193): n is a, c, g, or t
  modified_base (406)..(406): a, c, t, g, unknown or other
  misc_feature (406)..(406): n is a, c, g, or t
tcagactgtacagtcacgaccggtgctcgatttagagctcacgtattggggtttgggggcagaagtctctctcagtcaggacacagccatggacatggacgggtccctggctcacgctccgtgggactcctgctgctcgtggcctccagctatcagntgngaccatccgagcttacgacccctagtcctaccncgttccctcccgttgtacctgacctagttgttacggtagggaactccgaaggtactaccaacctaagtcgttacggtcgggaccgggagtagtacggacggctaaagtaacgttaaagtttacgttcggtaccgtagttactacaggtaaccgaaacggtaaaaccgaagggttaaaccgtttaccctaaccctaccttagtaactcttaacncgaccgttcgactaaccggtcctttaacgttcgtaacgtttaacgtttccgggggccctttactacggtacgttacggacggttaccggagttacggggtcgggttaaggtacgggaaccttaaggtaacttcctaacctaccgtactaaccggtactaacaccggtaacgtacgtccgttaacggaccgttaacgacgtaaacgtacgtttacggtttacgtacttaaaacgtttaccttaagttaaacgtttaacgttaaaacgtttaaaaccgggtattaaacccggagggttacccgttaaccggtacggttaaccggggtttcggtaacccgggtaacgggtaaacccggggtaacgtaacggttacgaacgttaaaccgaaccggtaaccggtaggttcggtaaccgg

SEQ ID NO: 251937 - DNA, 843 bp, Homo sapiens
  misc_feature: GYAE6OF02H3PS9.25.28.C06.1.454.CMB.1.raw
  modified_base (196)..(196): a, c, t, g, unknown or other
  misc_feature (196)..(196): n is a, c, g, or t
  modified_base (214)..(214): a, c, t, g, unknown or other
  misc_feature (214)..(214): n is a, c, g, or t
  modified_base (243)..(243): a, c, t, g, unknown or other
  misc_feature (243)..(243): n is a, c, g, or t
tcagactgtacagtcacgaccggtgctcgatttagagctcacgtattgggtttgggggcagaagtctctctcagtcaggacacagcatggacatgagggtccctgctcagctccgtgggactcctgctgctctggctccagctatcagtatgtggcatccaagactcgacccagtcctaccactccgttcctgtcngcattcgtgttaggacanagacgtaccactatcgacgttcggccggngtaacgtcgagggactagttaggtaatttggttcgacgttggtatacgacgacgaaagtaaccgtaacgggttaaaccttccctaacccgttcctaacgacttacgttaacgtcggtaccttagtcctaacgttacccgttacgttttaggaaccgttaaggttttcccggggtacccttacgttaccgtacgtttacggacggtaccggttacgttacggggtaccgggttcggtaacgggtaaccgtaaagttacgttaccgtacccgttaaccgtaccgaaccgtactaccggacgtccgtaaccgtaccgtacgaaccgtacgttaacccggtaagtaacgtacggtttacggttaaccgtaaaccgttttaaacgtttaacgtttaacggtaaacgttttaaaaccgtttaaaaaggttccggtaaaccggttaaccgtttaccggggtaacccgtttaagggttaacccggttcccgggtttaaacccggggaacccggtaacggggttaaaacccggtaacggggttaaccggttaacccggtttaaacctaaacccgggttaaaccggttaccgggtttacgggttaaccgg

SEQ ID NO: 251938 - DNA, 263 bp, Homo sapiens
  misc_feature: GYAE6OF02I2ZPV.25.28.C06.1.454.CMB.1.raw
  modified_base (252)..(263): a, c, t, g, unknown or other
  misc_feature (252)..(263): n is a, c, g, or t
tcagactgtacagtcacgaccggtgctcgatttagagctcacgtattgggtttgggacagaattcactctcaccatcagcagcctgcagcctgaagatgttgcaacttattactgtactaaaaattgacagtgacccgtgatgttcggccaggaccaaggtggacatacaaacgactgtggctgcacatctgtcttcatccttcccgcatctagactgtacagtctggagcggctggacaaggcgcaatagnnnnnnnnnnnn

SEQ ID NO: 251939 - DNA, 304 bp, Homo sapiens
  misc_feature: GYAE6OF02GTYRH.25.28.C06.1.454.CMB.1.raw
  modified_base (215)..(215): a, c, t, g, unknown or other
  misc_feature (215)..(215): n is a, c, g, or t
  modified_base (259)..(260): a, c, t, g, unknown or other
  misc_feature (259)..(260): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (267)..(304): a, c, t, g, unknown or other
  misc_feature (267)..(304): n is a, c, g, or t
tcagactgtacagtcacgaccggtgctcgatttagagctcacgtattgggtttgggacagaattcactctcaccatcagcagcctgcagcctgaagatgttgcaacttattactgtacaaaaatttgacagtgacccgtggatgttcggcccagggaccaaggtggacatcaaacgaactgtggctgcaccatctgtcttcatcttcccgcatcngaactgtacagtctagagcgggctggacaaaggcgacataaggnngntgngnnnnnnnnnnnnnnnnnnnnnnnnnnnnnnnnnnnnnn

SEQ ID NO: 251940 - DNA, 882 bp, Homo sapiens
  misc_feature: GYAE6OF02FPR97.25.28.C06.1.454.CMB.1.raw
  modified_base (173)..(173): a, c, t, g, unknown or other
  misc_feature (173)..(173): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcnccatcctcctgtctgccatctgttggacgacagagtccaccatcacttcgccgggcgagtcgaggtctagttaggtaaatttagtttcggtccttaggtatacgagacaaaggaaaccgtaagggtaaaacgtttcccgtaaacccttaccctactagtaccttaagtcggtaccttcgtacctacgttacccttaacgtttacggtaaccttaacggttttccgggggttccccgttaccgttaccgtaacgttttaccgaacgggtccggtaccggttaacggggttcggggttaccgtacggggtaacgtaacggttaaacgtttccccgtaaacctttccctaaccgtaacccttaacgtaccaacgtccgtaacgtcccgtacggaccgtaaccgggtcccttaacgggtaaacgtacggtttacgggttacccggtaaaccttttaaaacccgttttaaacgtttttaaacccggttaaacggttttaaaacccgtttaaaaaaagtttttaccgggaacctttaaaccgggggtttaaccccggtaaccgggtttacgggtaacccggttttaacgggggttacccccggggtaaacccggggttaaaccggggttaaacccgttaaacggggggtaccggttaacccgtaaaaccgttaaaacccggtaaaaccgggttaaccgttaggggtttaacccgg

SEQ ID NO: 251941 - DNA, 774 bp, Homo sapiens
  misc_feature: GYAE6OF02II2FY.25.28.C06.1.454.CMB.1.raw
  modified_base (656)..(656): a, c, t, g, unknown or other
  misc_feature (656)..(656): n is a, c, g, or t
  modified_base (707)..(707): a, c, t, g, unknown or other
  misc_feature (707)..(707): n is a, c, g, or t
tcagactgtacagtcacgaccggtgctcgatttagagctcacgtattgggtttgggggcagaagtctctctcagtcaggacacagcatggacatgacgggtccctgctcagctcctgggactcctgctgctctggctccagctatcagatgtggctatccagatcgaccctagtctccacttccctaccctgtctgtccattcgttggttaggacgacacggtacgtaccaaccgacttccgtacgttcgggcccggggaacgtacggtaccgaggggtacctaagtttagggttaaaacgttttagttttaccggggacccgtttaggggttaacttacccggaacgggtaacccgtaaaaccggaaaaaccccgggtaaaacggggggttaaaaccctttttaaccccccgtaaaccctttcccgttaaccttaacgttacctttaacggttacggtacccttacgaacccgttacgttaccccttaacgtttggttaacccgtttaaggggttttccccgggggttccccttagttcccgtttaacttacccgggagggtacccgggtcgttacggggtcgggttcggtacggggtaacctaggttaacttcctaccgtctaccgactaccacgacgcgtacgcccgttgccngtacccgagtacgtgtacgtgtacttaacgtacttatactaataaacgttnagtacgtcgtacgtcgtacgtggtcccgaggaccgacgtacgtcgacacgtaacgaagtcgtagtcg

SEQ ID NO: 251942 - DNA, 852 bp, Homo sapiens
  misc_feature: GYAE6OF02GSYLD.25.28.C06.1.454.CMB.1.raw
  modified_base (224)..(224): a, c, t, g, unknown or other
  misc_feature (224)..(224): n is a, c, g, or t
tcagactgtacagtcacgaccggtgctcgatttagagctcacgtattgggttgggggcagaagtctctctcagtcaggacacagcatggacatgagggtccctgctccagcctctgggactcctgctgctctggcctcccagctatcagtatgtggacactccaagctacgacccctatcctaccacgttcctccctggtctgactagtctggtacgagaaccngtaacgtctaccaatcggtaaccgttcgggccggtacggtacggtaccgtacggggccgtaagttaacggttaaaacgttttaaagtttcgggttaccgtaacgggttcttaccgtacggtaaccgtaaaccggaaaccggtaaaacggggttaaaacgttttaaccccaaccccgtttaacccggttaacctaaccggttacgttaaccttcgtaaccggttacgtaacctccgttaccgttaaacttttcggtaacttaaacgggttttccgggggtcccgttacgtaccggtaactttacgaacccggggtcggtcggtagggttaacccggggttcgtacggggtaactaacggttaccgttaacgtccttacctaccgtaacccgtacgtaccctaaacggtcccggactaccgttacgcccgtaagttccccgtaggtaaaccggtcgtttacggttaaccgaacctttaacgtttaccttaacgtttaaaccgtaaatttaaaacgttacgacgttacgtaaaccgttcggtaaccgggtgttaacgggttaccggtaccgtaacgggtaacccggttagtaaccgggcttaaaccggacttaacggtacgttaggtaccg

SEQ ID NO: 251943 - DNA, 586 bp, Homo sapiens
  misc_feature: GYAE6OF02GBGZY.25.28.C06.1.454.CMB.1.raw
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtgacgtccagatgacccagtctccatcctcctgtctgcatctgttgagacagancagcatcacttgccgggngagtcaggcattagctaattattagcctggtatacaacaagaaaccgagggagtacgtcctaagcctactgatctatgtctgccctacctacgttacacgtcgtacgggtcccagttcgttcggttcgacgcggactaggtactaagtcgtagggaacaggtacgttacactactctacttacgtcaacgcgacgtccgtgacgacgtccgtagaagtattacggttactacttaaacgtttacttacctaagttaaacgtaaaattaacttaactacgttccgtccccttacgtaccttaaccggttccgggacggggtaaccggacgtacgggtaggtacggtaactaccgaaacgtacgg

SEQ ID NO: 251944 - DNA, 758 bp, Homo sapiens
  misc_feature: GYAE6OF02G81YS.25.28.C06.1.454.CMB.1.raw
  modified_base (259)..(259): a, c, t, g, unknown or other
  misc_feature (259)..(259): n is a, c, g, or t
  modified_base (330)..(330): a, c, t, g, unknown or other
  misc_feature (330)..(330): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctggggaactccctgacgactctccgtgtgtggcgcctagactcaccttcagttagttatggcctttcgtcgtcgggtccncctagtgtccaggcaaggggctggagtggcgtggggagtttacgttggtctgacgagaacaaatgacatancgacgcggagtccgtaggaggggcctagttccaacgtatccgtaccgaacgggtactaaacgttaccgaaacggacgtaaaccccctgttaacttccgttacgaacgtaaaactacggtaaaacctaacgtttaacgggaagtacggttacgggtaaaggtaacggttaaaccgggttaccgtttttaaacgttaccgttaggttacgacccgttaaccgttacggaacgggttacggtacggtacggtaaagggtaaaaacgttcggttaccgtacttacgttaccgttaccccggtacgtaccgtaccggtcggggaacccgtacggccctacccggtcgtccctacggttccgtacctaccgtacgtccgttacccgaacgtacccgggtcctacggtcccggttaccttcccccgtggtccccg

SEQ ID NO: 251945 - DNA, 868 bp, Homo sapiens
  misc_feature: GYAE6OF02G6MUQ.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactccttctgctctggctcccagctatcagatgtggcatccagatcgacccagtcctaccactccctccctgtctgctactctgttggagaccagtagtccaccatctacgttcggccgggcgagtcggagggctaagttacggtaaattttacgtttcggaccgttaggtacttccgaacggaaccaaacggtaaaaacccggtaacggggggttaaaaaccgttttacccccgttaaaaaccccgttcccttaccttaaaccgttttacgtaacccgtttaggtcccggttacgtaaccttaaaccttacccccgttaacgtttttaccggtaaccgttttaaaaccggggtttttccccgggggggttaaccccctttccgttaacccgggtttaaacgtttcccggaaacggggtcccggggtaccggtttaaacgggggttcgggggttaccggtttaacggggggtaaaccttaaaacggggtttaaccctttcccggtaaacctttacccccgttaccctaaacccgtacgtaaccgtaaccggacccgtaaccggtccccgtcggtaaccgacggttaccgtaagtacggtattcgttaccgtaaccttaaagttttacttaacgttacttaaagttaaacttcggaaatacggtcgttaaccggtagtacgttccggtcccggaaccggaacgggtaacaacggtagaactagtaacccgaaaggttcgtaggtcgtaccg

SEQ ID NO: 251946 - DNA, 950 bp, Homo sapiens
  misc_feature: GYAE6OF02INWLZ.25.28.C06.1.454.CMB.1.raw
tcagactgtacagtcacgaccggtgctcgatttagagctcacgtattgggtttgggggaagaggaagactgacggtcctcccaggagttcaggtgcgtgggaaccttgagcactgaacgcagcggactcacatggagtttgggctgaacttgggttttcctcgttgcttacgttttaagaggtgtccagtgtcgaggccgctattccgtgggtggtaggtcggtaggggggaggtcggtcgggtacccagcccgtgggaaaccgttcccgtaggaacgtacctccttcccgtggttggtacgggccgtaccgttagacccttcgtaaccctttcgagttagtttaactcgggtcctttcggtcgtacgggtcccacctaggttcgtcccgaaggaaccggtaaggggtcctggtaagtcgggcgttaggggtaacttacgttggtactacgactacgaaacaaagttcgacttaactagtcccgacggtacggtacggttaccggtacggggaacgggtacctacgtttacccgaaccgttagttacccgtaccggaaacgggtaaacctaaacgttaacccgaaaacgtaaccgtaaaaccccgttctaaacccgtacgttaaccgaaaccgtaaaaagttaccgtaaaaaccgttaaccgtttacgggaaacggtacgggttaacccgggaaaagggttttacccggtaaacccggggtttttaacccttttaaacgtttcccggtttaaagggttacccggtaaacccgttaacccgggtaaggtacggggtttaaccgggttaccgggttaaccgggttaaaaaaacgggtttaacggttttaaccggtaaaccggttttacccgttaacggtttaaccccccgttttaccccggggttaaacgaaccccggtttttaccgggggaaccccggggtaaaccccggg

SEQ ID NO: 251947 - DNA, 282 bp, Homo sapiens
  misc_feature: GYAE6OF02FKSXC.25.28.C06.1.454.CMB.1.raw
  modified_base (264)..(282): a, c, t, g, unknown or other
  misc_feature (264)..(282): n is a, c, g, or t
tcagactgtacagtcacgaccggtgctcgatttagagctcacgtattgggtttgggggggaagaggaagactgacggtcctcccagggagttcaggtgctgggcaccctggtcaccgtctcctcagcttccaccaagggcccatcggtcttcccctggcgccctgctccaggagcacctcgtgggggcacagcggccctgggctgcctggtcaaggactacttccactgtacagtctggagcgggctgggcaagggcgcatagnnnnnnnnnnnnnnnnnnn

SEQ ID NO: 251948 - DNA, 667 bp, Homo sapiens
  misc_feature: GYAE6OF02FOF8G.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatcgtgttggagacagagtccaccatcacgttcggccgggcgaggtcgaggggtctagttaggtaaatttagttggaccttggtatcagcaagaaaccgaggtaacgttcctaacctcctactatcgtatcgtctcgactactacctactttgacgttaacggtttcggggtcccttactacgtcttacgcggtaccggtgtacgggtcgggttcgtacgggactaacggtaacttaccgtaccttcgtacctacctaactacgagacctacggtccctagccgacgtaccgtaggtaaagtacgttggttaccgtactttaacgtttaacttacgttaacgttaaacgtaaaagtttcgtaacgttaaggttaccgtaccggttggtagtttccggtaaccggtcccggtaaacgggtacccggttaaggttaccggaacgttaaacgtaccggaaacgttacggttacgtacggg

SEQ ID NO: 251949 - DNA, 657 bp, Homo sapiens
  misc_feature: GYAE6OF02FR8XP.25.28.C06.1.454.CMB.1.raw
  modified_base (215)..(215): a, c, t, g, unknown or other
  misc_feature (215)..(215): n is a, c, g, or t
tcagactgtacagtcacgaccggtgctcgatttagagctcacgtattgggtttggctgaactgggtttcctcgttgctcttttaagaggtgtccagtgtcaggcgcatctggtggagtctggggggagcgtggtccaagcctggggaatccctgagactctcctgtgtggcgcctagacttcaccttcagtagttatggcttcgtctggggtccnccagtgtccaaggtccgaagggggctagggacttgggcctgggggatttacttgggctgacagacaaatgacatatcacgtcggagtccgtgaggggccattcaccatctcagggacaattccaaagacgaaccctctaatccttaggcctaaaatcgaaacaacgtttgacgtagtccgaaggactaccgggtccgtttaattacgtagttcgacgtaccctgaggtagtggctagggaaaaagtcgtagtctacgactttcccggtacgaccttcgtcggggaccgtaacgggcctaacccgtgggtacctaccgtctacccgtcgacgtaccttacccggaacgacgggtccctagtcccgggtaccttccccggtacggtcccgcccgttcggtccctccgtacgggtccgtacctacccgttccggtacgggacccg

SEQ ID NO: 251950 - DNA, 788 bp, Homo sapiens
  misc_feature: GYAE6OF02GLWW2.25.28.C06.1.454.CMB.1.raw
  modified_base (327)..(327): a, c, t, g, unknown or other
  misc_feature (327)..(327): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggaggcgtggtccagcctgggaagtccctgagactctcctgtgtggcgtcctagactcaccttcagttagttagtgggtcttcggtctgggtcccgccgagtcgtccaggcgaaggggctggagtggacgtggggtagttacgttggtctgacagaacaatcganatacgtcacggcggtacgtccggtaggacggggtcctattccgaaccgtattacctaccgaggggaacctaacgttaccaaaggtaaccgtaaccccgtctttacgtacttacggaaacttaaaaagtacgtaaaaccgttaaacgtttaggaaacgggttaacggtaccgggaaacgggttacgttaaaccccgggtttacgtttttaaacgttaacggtttcggtacggtacccgttaccgtcggtaaaggtaggtacggtacggtaacgggtaaaacgtcgttaacggttctacgttaccgtttcccggtacctacccgttcgggtacgggacccgtacgggtaccctccggttcggtaccctaccggttaccggtcccgttaccgccgttaccgttacccgacccgtaacccggttccccgtacgttcccggttaccctttcccccgggagtccccg

SEQ ID NO: 251951 - DNA, 748 bp, Homo sapiens
  misc_feature: GYAE6OF02JZEWC.25.28.C06.1.454.CMB.1.raw
  modified_base (256)..(256): a, c, t, g, unknown or other
  misc_feature (256)..(256): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctcgtgggcaccgtggagtcgtgggggaggcgtggtccagcctgggaatccctgagactctctgtgtggcgcctagactcaccttcagttagttatgggccttggtctcggggtccnccgagtcgtccagggccgaaggggcttgggagtcggcgtaggggagtttaccttgggtccgtggaactagaacctaaaatggaacctatactcgtaacggcggaacggttccggtgggagggggccctaagttccgaaccattccgtaccggaagggactaaactttccgaaagtaacgtaaccctctaatctagactaaaatcgaaaactacggtagaggtagtacggaggacttaaccgggttctttaatacgttgtacgtacgacctacgaggtacgttgacgtaagggtaaaacgttcgtaacggtctacggttacttccccggtacgtacctacgggtcgggaccgacggtaccctaccggttacggtaccgtaacccgtccgtacccgttaactaccggtacccgtttaacccgaacccgggtaaaccgggttccccgaccggtttccccgggttacccccttttccccggggaccgtccccccgg

SEQ ID NO: 251952 - DNA, 626 bp, Homo sapiens
  misc_feature: GYAE6OF02GF13G.25.28.C06.1.454.CMB.1.raw
  modified_base (251)..(251): a, c, t, g, unknown or other
  misc_feature (251)..(251): n is a, c, g, or t
  modified_base (364)..(364): a, c, t, g, unknown or other
  misc_feature (364)..(364): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggagcgtggtccagcctggggaatccctgagactctcctgtgtggcgcctagactcaccttcagttagttatggcttcgtctgggtccnccagtgtccaggcaaggggctggagtggctgggattacttggtctgacagacaaatgacatatcagcggatccgtgaggggcatcacatctcaggacaattcaagacaacctntatctgacaaatcgaaacaacttgaagtagacgagtagtacggtccgtttattacgtgtcgcgtaacctgaggtagtcgacgtaaggaaaacgtcgtagtcgttactacgttcccgtacgtaccgttacggtcgggacccgacgggtaccgtacccgtacggtccgtacccgttccgtcccgtaccgtacggtcccttaacccgaaccgtaaccgggtccccttaacggttcccggttaccccgttccccgtcggtccccgg

SEQ ID NO: 251953 - DNA, 645 bp, Homo sapiens
  misc_feature: GYAE6OF02FF9IL.25.28.C06.1.454.CMB.1.raw
  modified_base (262)..(262): a, c, t, g, unknown or other
  misc_feature (262)..(262): n is a, c, g, or t
  modified_base (411)..(411): a, c, t, g, unknown or other
  misc_feature (411)..(411): n is a, c, g, or t
  modified_base (583)..(583): a, c, t, g, unknown or other
  misc_feature (583)..(583): n is a, c, g, or t
  modified_base (637)..(637): a, c, t, g, unknown or other
  misc_feature (637)..(637): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccggtggagtctgggggagcgtggtccagcctgggaagtccctgagactctcctgtgtggcgcctagactcacctttcagttagttatgggtcctttcggtcgttcgggtcccnccaggttcgtacccagggccaagggggctagggagttggctggggagtttactgggtctggacagaacaatgacatatcacgcggtatccggtggaggggccgattcgaacctatcctacgagggacaactttccaaggacaacccctntatctagactaaaatcgaaactaacttggaagacgtacggaaggacgtacggtccgttttaattacgtgtacgccgtacctcgaggtacgtggacgtaaggaaaagtcgtagtctacacttccgtacgtaccgtcgtcgggaccacggcaccgtgtaccaccgtccgttccncgtaccgtccttaccgacccgtaacggaccctacgttccgtcccgttaccccgnggtccccg

SEQ ID NO: 251954 - DNA, 773 bp, Homo sapiens
  misc_feature: GYAE6OF02FHX3Y.25.28.C06.1.454.CMB.1.raw
  modified_base (207)..(207): a, c, t, g, unknown or other
  misc_feature (207)..(207): n is a, c, g, or t
  modified_base (463)..(463): a, c, t, g, unknown or other
  misc_feature (463)..(463): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgctatctggttggagacagngtcaccatcaccttggccgggcgagtccgagggctagtttaggaacttttagttcggccgttggtacttcgagtccgaaacggaaaccgaagggtaaacctttacccgttaaacctccctactacttcctaattcgaccttggacctaacttccccgttactttacggtacgttaaacggtttttcgggggttcccccttacttcccgggttactttaccggaacggtccgggtcgtacgggttcggggttaccgngggtaacctaacgtactttaccgtaccttacctacccgtaccctactaccgtaacgccgtaacgtccctggacctacgtccgtagacgtagttcgtttacggtacttaacgtttaacttaccgttaacgttaaacgttaaaactttcggtaaactacgggttaacccgttaccggggtaaggttaccggtttaaccgggttaccgggtacccccggtaaacggggtaacccggtaaaccggggttaccggtaacccgttaaaccggttaacccggtaaaaacccgttaccgggtttacgggtaacccggg

SEQ ID NO: 251955 - DNA, 830 bp, Homo sapiens
  misc_feature: GYAE6OF02FOFIU.25.28.C06.1.454.CMB.1.raw
tcagactgtacagtcacgaccggtgctcgatttagagctcacgtattgggtttgggggaagaggaagactgacggtcctcccaggagttcaggtgctgggcaccttgggcacgggggaggtgtgtcaacaagagtttgggctctgggcaccgtggagtctgggggagcgtggtccagcctgggaagtccctgagactctcctgtgtcggcgcctagactcaccttcagtagtttatggtcttcgtcgttcgggtcccgccagttcgtaccgagggtaccaagggggtcctaggggagttcgggaccgttgggggtaagttttaccgttgggttacctaggaaccgtaacggtaacctaaaagttcggaaccgtaagttacgttacccgaaccgggtaccgggtaacggttcccgggtagggaaacggggggtccccgtaaagtttacccgaacctaacgttcccgtaccggtaaaggggtaaccctaaagtttccccgaaaagtccggtaaaccccttcgtaacttccgtacggaactaaaagttccgaaaacgtacgtttacgaagtacggtacggtaacggtaacgttacgggtaccgtttaacttcgtacgtacggtaccgtaccgtacgtaaggtacgtaggtacgtaacggtaaaacggttcgttacgtacgttacgtacgttacccgtacgtcgtccggtacgggtacccgacgggtaccgtacccgttacggtaccgtacccggttaccgtccgtacgtacgtcccgttaccgtaccgtaccggtccgtaccggttccggtcccttccccggtcggtaccccg

SEQ ID NO: 251956 - DNA, 925 bp, Homo sapiens
  misc_feature: GYAE6OF02IJ4SL.25.28.C06.1.454.CMB.1.raw
tcagactgtacagtcacgaccggtgctcgatttagagctcacgtattgggtttgggggcagaagtctctctcagtcaggacacagcatggacatgaggtccctgctcagctctgggactcctgctgctcgtggcctccagtctatcagtatgtagctactcccgagatcgaccctagtcctcctactcctccctgtactgctatcgttggtaggacgtacgaggtactaccaacctactaccgtacggttccgggacccgggggtacgttacggtaccggtacgggggtcttaaacgggtttacggtttaaaacgttttacgtttccggggtaccgtttaaggttacgttaccgaacgttaaccggaaaccggtaaaaacccgggttaaacgggggttaaaccccttttaccccccgtaaaccccgttttacccgtaaccgtttaaccgttttaacttacggtttaacccggctttacggtacccttaaccgttttaccgttacgttttaaccggtacggttttaaacccggggtttttccccgggtacccttaccgttacggttacgttacggaccggttcgggtaacggttcgggttaccgggttaccggagggtaacctaacggttacttcccgtaccgttacctaccgacccgttacgaaccgaccgtaccgtaccgggtccttaaccgggacccgtcgttaccccggttaagacgttaccgtttacgggtaaccgtttaaccgttaacgttttaactaacggtttaaccgttaaacgttaaacggttcctaacccgttaacgggttaccgttaccggttcgttaccgggttaccgggtaaccccggtaccggtaaccggtacgtaacgggtacccggtaactaaaccgggttaaaccgaacgttccggttaacggtccgg

SEQ ID NO: 251957 - DNA, 743 bp, Homo sapiens
  misc_feature: GYAE6OF02G39DW.25.28.C06.1.454.CMB.1.raw
  modified_base (403)..(403): a, c, t, g, unknown or other
  misc_feature (403)..(403): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtcgtgggggaggcgtggtccagcctgggaacgtccctgagactctcctgtgtggcgcctagactcaccttcagtagttatggcttcgtctgggtccgccagtgtccaggcaaggggctggagtggctgggagttacttggtctgacagacaaatgacatatcacggcggagtccggtgacggggccgattccaccattcctaccgaagggacctaaagttacccgaaacggtaacgaaaccccgttntactcgtacgacaaaagtcgtaaaccaaacgtttcggaacgtacggtacggaacgggtaacgtaaccgggttacccggttttaattaaccgttggtacgaccggtacccttacgtagggtaggtcgggtacgtaagggtaaaacggttcggtaacgttcgttaccgtaccgtttaccccgtaccggtaaccgttccggtacggggacccgaacgggtcccgtacccggttaccggtacccgtacccgtacccgttcccgtcccgtaccgtccgttacccgtacccggaaccggtcccgtaaccgttcccggttacccgtttcccccgtccggtaccccgg

SEQ ID NO: 251958 - DNA, 684 bp, Homo sapiens
  misc_feature: GYAE6OF02GFLOX.25.28.C06.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccactccctcctgtctgctattctgttgganacagtagtccacatctacgtcggccggcgagtcgagggntaccgttaggtaaattttagttcggtcccgttaggtactacgtagaccaaacggtaaaaccggaagggttaaaacgttccctaaacccttccgtactaacgtctaagtgtcctgtacctactaccttacgtttagtacgttaaggtttccgggtcccttcgtcgtacttacgcgtcggacgtagggttcgggtacgacggtacgtaagtacttaccgtacctcctacgtaacctacgtacacgtaccgacgtaccgtcgcctacgtacgtaagaacgtgttcgtacgtacttaaactttacttaacgttacttaaacgttaaaattcgtaaacgttacgttaccggtacgtacggtacgttccggtacccggaccggttaaccgggaaccgtaacggtccgaacgtaaccgtaaccgtaaaccggtaggttcgtaccgg

SEQ ID NO: 251959 - DNA, 878 bp, Homo sapiens
  misc_feature: GYAE6OF02IG8C2.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccatccctcctgtctgctatctgttgagacagagtcaccatcacgttggccgggcgacgtcgacggggtcagtttaggtaaatttatttcgggccttggtatcgacgtacaaggaaaaccgtagggtaaactttacccgtaacctcctacagttacctaagttcgcttacggacctaacttacccgtaacgttttcgaccgttaaacggtttttccgggggtaccccttccgtttaccggttaaactttcccggacgggtaccgggtacgttaacggggttccgggggttaaccgtttggggggtaaaccgtaacgggttaaacttttacccgtaaacccgtttccccgtaaccctaaacccgttaacgtacccggtaacggtacccgtaaccggtcccgttaccggtacccgtaaccgggtacccggttaacggtaaacggttaaccgttgggtttaaccggttaacctttaaaccgttttaaacgttttaaccgttacggtttaaaaccgtttaaaaacgttttaccgaaaccggtttaacggttacccgttacccggggtttaaggtttaaccggtttaccgggttaacccggaacccgggttaaaccggggttaaaccccgtaaacgggggttaccggaaaccggtttaaaccggttaaaccggtaaaaacccggttacggtttaccgggttaacccggg

SEQ ID NO: 251960 - DNA, 782 bp, Homo sapiens
  misc_feature: GYAE6OF02GIJ0X.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctcgtggctcccagctatcagatgtggcatccagatcgacccagtctccactccctccgtgtctgctatcgtgttggagacagtacgtacaccactcacgtggccgggcgagtcgaggactagttaggtaatttagttcggccgttaggtactacgacgtacgaacgaaaccggtagggtaaacgttaccctaaccgtcctacgtacttactagtcgtcgtacgactacctacctacgtttacgtacgttaacggttttccggggtacccttacgttacgtacgttaccggacggtacggtacgttaggggttcgggtaccgtaggggtacgtaacgttaactttaccgtaccttaccgtaccctaacccgtataccggaacgtaccgtaccgtccgttaccgacgtacgtaccgttagttaacgtttacggtttacgtttacgtaaccgttttaacgttttaacttaaccgtacgtaaacccttaaaagttaaaacgttttaaagttaaacttttaacgtttaccgttaacccgtttaacccgttttaacggtttaaccgggaacccgggtaaaccggggttaacccgtaaaggggttacggtaacggttaaacccgttaaacggaaaccggtttaccgtagggttaacccgg

SEQ ID NO: 251961 - DNA, 721 bp, Homo sapiens
  misc_feature: GYAE6OF02I937Z.25.28.C06.1.454.CMB.1.raw
  modified_base (559)..(559): a, c, t, g, unknown or other
  misc_feature (559)..(559): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccactcctccctgtctcgcattctgttggagacaggagtccacctatcctaccgttggccgggcgagtcgagggctagttaggtaaattttagtttcggccgttaggttactaccgagaccgaaacggaaaacccggtaaggggttaaaaccgtttacccgtaaaccccttccgttactaacttaccgttagtcgtctcgtacctaccttaccttactttacgtacgttaacggttttccggggtcccttcgtttacgtacttacggacggtccggtacggtcgggttacggggtccgtagggtaacgtacggtaacttcccgtaactccgtaccaccgtagtaccgacgactccgtaccgtgccgacgtaccgtaagtaacgngtttcgtacgtacctttaacttaacgtttaattaaccgttaaactttaaagtttcgaacgttacgtacgtacccggttagtacggttacggttacccggaccggtaagggaacccgtaagggtacgaccgtaattaaacccggaacgttacggtcgtaccgg

SEQ ID NO: 251962 - DNA, 822 bp, Homo sapiens
  misc_feature: GYAE6OF02GHNKZ.25.28.C06.1.454.CMB.1.raw
  modified_base (83)..(83): a, c, t, g, unknown or other
  misc_feature (83)..(83): n is a, c, g, or t
tcagactgtacagtcacgaccggtgctcgatttagagctcacgtattgggtttgggggcagaagtctctctcagtcaggacanagcatggacatgagggtccctgctcagctcctgggactcctgctgctctggcctcccagctatcagatgtggcatccagatcgacccagtctccactccctcctgtctgctatctgttaggacgacagacgtacaccatacctacgttcggcccgggagaggtcggagggactagttaaggtaaactttagtttcggtaccgttggttactacgtaagacaaacggaaaccggtaacggggtaaaaccgttaaccccgttaaacccttacccgtactaacttacccgttagtacgtccgttcgtacctaccttcccttaaccgtttcgtaaccggttaaccggttttaccggggtccccgttacttacggttacttaccgacggtcggtacgtacgggtttcggggtaccggtacgggtaacccgtaggttaaaccttccgtaaccgtttccgtaaccccgtaactaaccggttaccgacgtacccgtaaccggtccgttaacgtaccgacggttacccgtaagtaacggtttagttaccggtaagtaacccgtttaaacgttttacttaacgtttaacgttaaaaacttttaaacgttaccggtaacgttaccgggttaccggtaccggttaggttaaccggttcggtaaccccggtaccggggtaaccggaaccgggttaaccgggttacgaaccggttaaccgtaaaccggtaacggttaacggtccggttaacgg

SEQ ID NO: 251963 - DNA, 721 bp, Homo sapiens
  misc_feature: GYAE6OF02IIMB7.25.28.C06.1.454.CMB.1.raw
  modified_base (381)..(381): a, c, t, g, unknown or other
  misc_feature (381)..(381): n is a, c, g, or t
tcagactgtacagtcacgaccggtgctcgatttagagctcacgtattggggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttagagacagagtcaccatacacgttggccgggacgagtcgagggcagttaggaaatttgtttggccttgggtaactcaggtaccaaggaaaaccgtaaggggtaaaacgtttccctaaaccgtcctacaacttctaatcgactacgcacgttcctagtttgacttaaggtttcggggtcccctntacgtaacttcgaacgcgggtacaagggttcgggtacgttacggggaacttaacggtaaactttacgaaccgtttaccttaccaaacccgtaaccgtactaacgggtaccaacgggtcccgttacggaccctacggtacccgttaagggaaaccgtaagttacggttagaaccgtttaaacgtttaacctttaacgttaacggtaaactttaaaaaacgttcggtaaacgtaggttaaccggacccggttaggtacgttcggttaccgggaccccggtaaagggtaacccgtaagggtacggaacgtaacgttaccggaaaaccggtagtacgggtacgg

SEQ ID NO: 251964 - DNA, 677 bp, Homo sapiens
  misc_feature: GYAE6OF02FLKO9.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctactgggactcctgctgctctggctcccagctatcagatgtggcatcccagatgacacagtctccatcctccctgtctgcatctgttggacgacagagtccaccatcacgttcggccggggcagtcgagggctagttaggtaaattacgtttggacccgttggttactcaggaccaacggaaaccgtaggggtaaaacctttccgaaacctccttacactccgttaatcgtcctacgctacttcctacgttttacgacttaacggtttccgggggttacccgtcgttacgtacttcgtaacggtccggtacgtacggttgggtcccgtggggactaagaactttccgaccttcgtacccaaccgtacgtccgacgacgccggtcctacggacacgtaccgtaagtacgtaacgttgttacgtaacctaaacgtttataaccgttagtaaaccttaaacgtttgaccgtacgtacgtacccgtaggtacgttccggtacccggtacccgtaagggtaccctaaggggtacgtaaccgtaaccgtaaccgtaaccggtagttcccggg

SEQ ID NO: 251965 - DNA, 813 bp, Homo sapiens
  misc_feature: GYAE6OF02HS3I5.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtggcatccagatcgacccagtcctccatccctccctgtctgcattcgtggttggagacagactccaacctatccgacgttcggcccggggacgtaaggttccgaacggggtacctaaagtttaggggtaaaaacttttaggtttttcgggaccccgtttggggttaacttaccgaacggaccgaaaacgggaaaaacccggaaaggggttaaaaaccggttttacccccttaaaaccccgttacccttacctaactttccttaacgttacggtccttcggacctaacttaccccttaacgtttttcgaaccgtttaacggtttttcccggggggtcccctttacgtttaccggtaactttccgaacggggtcccgggtacgtaacggggtttcggggttaccgtaacggggaaccgtaaggttaaactttacccgtaacttccgttaacccaaccgtacgttaccacggacctaacgtccgttaacggccgtacgaccgtagtaaacggtagtttgttaccgacttaaactttacttaacgtacgttaaacttaaaagtttcgaacgttaggtaccgtaccggtggtacgtcggttacccggaacgtacggtaaaccgtaggtaacgtaactacggtaacgtaaaccgtagttcgggtacg

SEQ ID NO: 251966 - DNA, 700 bp, Homo sapiens
  misc_feature: GYAE6OF02HYD9R.25.28.C06.1.454.CMB.1.raw
  modified_base (396)..(396): a, c, t, g, unknown or other
  misc_feature (396)..(396): n is a, c, g, or t
tcagactgtacagtcacgaccggtgctcgatttagagctcacgtattgggtttgggggcagaagtctctctcagtcaggacacagcatggacatgacgggtccctgctcagctccgtgggactcctgctgcctcgtcggcctccagctatcagatgtggcagtccagatcgacccagttcctcacttccctcctgtacctcgactacttccgttggttacgggaacgacgaggtacgtacctaacctacgttacctacggttccggtaccggggtcgacggttacgaggggtcctaagttaggtaaatttacggttacggtcgttacggtataccgtagcgaaacggaaacgtacggtaacgtacctaacgttccagtactactacgcgtacttanccgtaacttccttaacgttacgtacgtagtttccccgggtacctcgtacgtacgtacgtaccgtggaccttacggtgggtcgtacgggtaactacgtacgtccttaacgtcctacgtactagtcgaacgttcgaacgccgtacgtaccgcgtaccgttagacgtagttacgtcgtaccttaactttacggattaccgtaataaactgtaaccgtagtcgtacgtcggttacgtccggttacggaccgtaacgtaaccggacggtacgtacggtaacctacggtaaacttacggtacggtaccgg

SEQ ID NO: 251967 - DNA, 273 bp, Homo sapiens
  misc_feature: GYAE6OF02HK0XH.25.28.C06.1.454.CMB.1.raw
  modified_base (128)..(128): a, c, t, g, unknown or other
  misc_feature (128)..(128): n is a, c, g, or t
  modified_base (172)..(172): a, c, t, g, unknown or other
  misc_feature (172)..(172): n is a, c, g, or t
  modified_base (181)..(181): a, c, t, g, unknown or other
  misc_feature (181)..(181): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (242)..(273): a, c, t, g, unknown or other
  misc_feature (242)..(273): n is a, c, g, or t
tcagactgtacagtcacgaccggtgctcgatttagagctcacgtattgggtttggggcagaagtctctctcagtcaggacacagcatggacatgagggtccctgctcagctcctgggactcctgctgntcgtgctcccagctatcgagatgtgaccatccagtatgaacccngtcttaccntcctccctgtctggacctatgtgttggacntaagctcaccgattcgctttggcccggngtnnnnnnnnnnnnnnnnnnnnnnnnnnnnnnnn

SEQ ID NO: 251968 - DNA, 266 bp, Homo sapiens
  misc_feature: GYAE6OF02GSB31.25.28.C06.1.454.CMB.1.raw
  modified_base (222)..(266): a, c, t, g, unknown or other
  misc_feature (222)..(266): n is a, c, g, or t
tcagactgtacagtcacgaccggtgctcgatttagagctcacgtattgggtttgggggggaagaggaaagactgacggtcctcccaggagttcaggtgctgggcaccttgggcacgggggaggtgtgtcacaagatttgggctctgggcacagcgcctggctgcctggtcaaggactacttcccatgtacagtctggagcgggctggcaaggtcgcagtagnnnnnnnnnnnnnnnnnnnnnnnnnnnnnnnnnnnnnnnnnnnnn

SEQ ID NO: 251969 - DNA, 623 bp, Homo sapiens
  misc_feature: GYAE6OF02H04AG.25.28.C06.1.454.CMB.1.raw
  modified_base (180)..(180): a, c, t, g, unknown or other
  misc_feature (180)..(180): n is a, c, g, or t
  modified_base (199)..(199): a, c, t, g, unknown or other
  misc_feature (199)..(199): n is a, c, g, or t
  modified_base (245)..(245): a, c, t, g, unknown or other
  misc_feature (245)..(245): n is a, c, g, or t
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
  modified_base (387)..(387): a, c, t, g, unknown or other
  misc_feature (387)..(387): n is a, c, g, or t
  modified_base (494)..(494): a, c, t, g, unknown or other
  misc_feature (494)..(494): n is a, c, g, or t
  modified_base (579)..(579): a, c, t, g, unknown or other
  misc_feature (579)..(579): n is a, c, g, or t
tcagactgtacagtcacgaccggtgctcgatttagagctcacgtattgggtttgggggcagaagtctctctcagtcaggacacagcatggacagtggacgggtccctgctcagctccgtgggacctcctgctgctcgtggccctccagtccttatcgaagcgtggtcgactactcgagtntccgaccctagtcctaccncttcccgtcctgtcgtcactgttctgggtcgacgcagactccactntaccgtgtccgggacggtcagtaccgaggtactagtagttaacttcgtcggtcttagtacncgaagtaccgaacgaaacgtagtaaccgttcctactcctanactttacgagtccgacttcactaacgtccttaggttaacncggtttacggtttccggcctagtacgtagcgtacgcgtaggttcggtccggtacaggtactacgtcctactacctcgactactcgacgacgtcacgtctcgtaccgngacgtgatacgtcttacgtacttaccgttagtactaacgtaagttaacgtagaacgacgtcgtacggtagtacgttcggtaccgnggttaccgaacgtgaccgtacgtagtaacctacgacgtcgtacg

SEQ ID NO: 251970 - DNA, 360 bp, Homo sapiens
  misc_feature: GYAE6OF02FMFRV.25.28.C06.1.454.CMB.1.raw
  modified_base (346)..(360): a, c, t, g, unknown or other
  misc_feature (346)..(360): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtgggcatgggggaggtgtgtcacaagatttgggctcagggcaccctggtcaccgtctcctcagcttccaccaagggcccatcggtcttccccctggcgccctgctccaggagcacctctggggcacagcgccctgggctgcctggtcaaggctacttccactgtacagtctgagcgggctggcaaggcgcatagnnnnnnnnnnnnnnn

SEQ ID NO: 251971 - DNA, 834 bp, Homo sapiens
  misc_feature: GYAE6OF02FNT74.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccactcctccctgtctgctatcgtgttggagacagacgtccaacctactctacgttcggcccggggatacgtcggacgggctagttagggtaaattttacgtttggacccgttggtaactcgacgacgaacggaaaaccggaaggggttaaaccttaccccgttaacccttacccgtacctaacttcgtaacttcgtccgtgacctacgttacccttacgttttagaaccgttaccggttttaccgggggtccccgttaccgttacgttaacgtttacggacggggtcccgggtaacgtccggggggtttgggttaacccgggtagggggtaaaccggtaacggtttaaaccgtttaaccttaccccgttacgtaccccgtaaccctaacgtttaccgaaccggtcccggaccggttcccgtaccgtacccgtacggtaccgtaaccgggtaacggttacggtttacggttaccggttaacctttaaaccgttttaactttaaccgttaacgtttaaaaccgttaaaacgtttacggtaacgttacggttaacccggtaccggttaggttaccggtttaccggtacccgggtaccggtaaaccgggtaccggtaaaggtacggtaacgtaaccgtaacgtaaaccggtcgtaggtaccgg

SEQ ID NO: 251972 - DNA, 831 bp, Homo sapiens
  misc_feature: GYAE6OF02GJHT6.25.28.C06.1.454.CMB.1.raw
  modified_base (240)..(240): a, c, t, g, unknown or other
  misc_feature (240)..(240): n is a, c, g, or t
  modified_base (359)..(359): a, c, t, g, unknown or other
  misc_feature (359)..(359): n is a, c, g, or t
tcagactgtacagtccacgaccggtgctcgatttagagctcacgtattggggtttgggggggaagaggaagactgacggtcctcccagggagttcaggtgcgtgggcacccttgggcgacgggggaggtgtgtcacaagattgggctcgtgggcaccgtgagtcgtggggagcgtggtaccagcctgggaacgtccctaggagaccttcctccttgtgtggcgtcctagactctaccttnaagttagtatggtcttcgtcgtcgggtccgccgtagttcgtaccgagggacgtaagggggctgggagtggctaggggtagttacgttggtctagacgagtaacgaagtgacgaattacnccgacggtaccggtacggtccggtaagggtacggggtacctagttacccgaaccgtacgtaccgtacccggaagggtaaaccctaaacggttaacgaaacgtaaacccggtaaacccttacgacttacggtaagaaaccgtaaaataccgtaaacgtaaagttacggaaggtacgggtaacgaacggtaacggtaaccgttaccggttttaacttaacggtcgtaccggaccgtaaccgtacggaagggttacggttaggtaacggttaaaacggttaaaacgttcgtaacgttacgtacgtacccggtttaaccgtaccggtaaccgttccgggttaccgggaccggtacgggaccgttacccgaggttcccgtaaccgtaccgttaccgtacgtaacgtacccgtaccggttaaccgaaccgggtaccttaaccgggtccgttccccgttacccgttaccccggtacccg

SEQ ID NO: 251973 - DNA, 770 bp, Homo sapiens
  misc_feature: GYAE6OF02GIQ3M.25.28.C06.1.454.CMB.1.raw
  modified_base (305)..(305): a, c, t, g, unknown or other
  misc_feature (305)..(305): n is a, c, g, or t
  modified_base (427)..(427): a, c, t, g, unknown or other
  misc_feature (427)..(427): n is a, c, g, or t
tcagactgtacagtcacgaccggtgctcgatttagagctcacgtattgggtttgggggcagaagtctctctcagtcaggacacagcatggacatgagggtccctgcctcagcctcctgggactcctgctgcctctggcctcccagctatcagatgtggctactccgagatcgaccctagtcctccacttccctccttgtctcgtcagttcgtagttcggaacacgaggtactccaacctacttcctacgttcgggcccggagtaggcgagggactagttagttaatttagttcggacgttggtanacgacgaccgaaacggtaaacggtaacgggtaacctttcccctaacccgtcctactactctactacggtctacgacctactaccgttccttacgtaccggttaaggtttcccgggttccttntaaccgttagtaccggtacgccggtaggtacgggttcgggttacgtacgggtaacctaggtttaacctacgtcccgttaactaccaacttacgtaccggagtacccgaccggtctaacggccgttacctacgggtaataccgtttaggttcttaaccgtaactttacgtttaaacgtttacgtaaaacggttttaaactaacggtcgttaaaccggacccgttagtttacgggtacccgttacgggtcccgggttaacccggaaccggttaaaccgggtacggtaaccttaacggttaccgttaaaccggtaaccgtttaacccggtaggggttagtccccgg

SEQ ID NO: 251974 - DNA, 801 bp, Homo sapiens
  misc_feature: GYAE6OF02GRIUT.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctcgtggcctcccgagctatcagagtgtgcatccgagactcgaccagtcctccactccctccgtgtcgtcgactactcgttggttaggacgtacgaggtacgtaccaccgtattcctacggttcgggacccgggtcgtacggttcggacgggtactaaggtttaggtaaaattttggttccggtcgttaggtatacgacgaacgaaaacggtaaaccggagggttaaaaccctttaccccgtaacccttccgtactacgttcgttaagtcgtcgtacgtacgtacccttaccgttaccgtttaggtaccttttaacggggtttcccgggtacccgttacgttacccggtaacgtttaccggaacggtcggtaaccggttcggggttacgggtacggtacggggtaaactacggttaaccttccggtaacctaccgtacctaactacgtacacggtaccacgtccgtagaccttacgaccgttagaacgttcgttacgttaaccgtacgtttaaacgtttaccgttacgttaaccgtttaaagtaaaccgtttgaaccggtacggttaaccgttcgggtaacgtacccggtttacggacccgggtaacccgtaacgggtaaccggtaggtacggaacctaaccgtaaccggtaaacgttacggtcggtaaccgg

SEQ ID NO: 251975 - DNA, 865 bp, Homo sapiens
  misc_feature: GYAE6OF02JV5F8.25.28.C06.1.454.CMB.1.raw
  modified_base (149)..(149): a, c, t, g, unknown or other
  misc_feature (149)..(149): n is a, c, g, or t
  modified_base (172)..(172): a, c, t, g, unknown or other
  misc_feature (172)..(172): n is a, c, g, or t
  modified_base (358)..(358): a, c, t, g, unknown or other
  misc_feature (358)..(358): n is a, c, g, or t
tcagactgtacagtcacgaccggtgctcgatttagagctcacgtattgggtttggggcagaagtctctctcagtcaggacacagcatggacatgagggtccctgctcagtctcctgggactcctgctgctctgctcccagctatcaagntgtcggcatccagatcggacccngtcctccattccctccgtgtcctacgctagttcctggttcgacgactagactccaacctatccgtaacgttcgccgggacgtacgtcgaagggctagttaggtaactttagttcggacttcggtattcaagtactaaacggaaacgtaacggtaaacgttacctaaccgtcctaagactacgttancgtcgtacgtactacgtccttaaccgttgtaacccgttacgggttttaccggggtccccttacgttaccggttacgtttaaccggaccgtccgggtacgttaggggttacccgggttacgggtaccgggtaaacgttaacggttaaccgtttaacccgtcccgttaccggttaaacccgtaaccccttagttaaccggaccggtacccgtaaaccggttcccggtaaccgggtttaccgaaccggtacccgtaaaggtttaaaccggcggttttaaacccgtccgggttaacctttaaaaccggtttttaccggttaaccgttaaagttaaaccgtttaaaacgtttcggtaaacccgttaacggggttacgttaacccggttcggttaaccgttacccggggttaccggttaaaccccggggaacccggttaaaccgttttacggggaaccgtaaccggttaaaccggtaaaccggttaaaaccggttacgtacgggttaacccgg

SEQ ID NO: 251976 - DNA, 884 bp, Homo sapiens
  misc_feature: GYAE6OF02FQSVT.25.28.C06.1.454.CMB.1.raw
  modified_base (252)..(252): a, c, t, g, unknown or other
  misc_feature (252)..(252): n is a, c, g, or t
tcagactgtacagtcacgaccggtgctcgatttagagctcacgtattgggtttggggggaagaggaagactgacggtcctcccaggagttcaggtgctgggcaccttgggcacgggggaggtgtgtcacaagatttgggctctgggcaccgtggagtctgggggagcgtggtccagcctgggaacgtccctgagactctcctgtgtggcgcctagctcaccttcagtagttatggcttcgtctcgggtcccnccagttcgtccaggaccgaagggggtcctagggagtcgggccgttagggggacttttacgttggtcctggaacctaacggtaacaaaattggaacctagttaacttccaacggtacgggtacggtcccggtagggacgggggtccctaatttccgaaccccagttacccctccgaaggggtaacctaaacgtttcccgaaaagaccgttaaaccccctagtttaacttccttacggaaaccgtaaaacgttcgaaaaccgtaaccgtttaggaaacgtcggtacggtaaagggtaacgttaccgggtaccgttttaacgtttacgttacggttaccggaccggtaacccgtcggtaaacgggtaacggttcgggtaaccgttaaacgggttaaaaacgggttcggtttaaacggttaccgttaacccttaccggtttaccccgttaacccggttaacccggtttaccgggtaccgggtacccggtaaccgggtaacccgtacccggttaccggtacccgtaccccggttacccgtaccgttaccgttaccgttaccccgtaccgtaacccggtaaccggacccgttaaccggttcccggttaccccgttacccccggtcccggtaacccccg

SEQ ID NO: 251977 - DNA, 618 bp, Homo sapiens
  misc_feature: GYAE6OF02GUDK8.25.28.C06.1.454.CMB.1.raw
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (333)..(333): a, c, t, g, unknown or other
  misc_feature (333)..(333): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
tcagactgtacagtcacgaccggtgctcgatttagagctcacgtattgggtttggggggaagaggaagactgacggtcctcccaggagttcaggtgctgggcaccttgggcacggtggaggtgtgtcacaagatttgggctctgggcaccgtggagtcgtgggggaggcgtggtccagcctgggaagtccctgagactctcctgtgtggcgcctagctcaccttcagttagttatggcttcgtcgtgggtccgccagtgtccaggcaaggggctggagtcggctgggtagttacttgggtctgacagacaaatganatancacgcggagtcgngcgggcatcaccatcncaggacaagtccaanacgaaccctntatctgaacaaatcgaaactactgagagtacgaagtacgtacggtacgtttattacgtgtacgtacgtaccgtagacggtagtaggtacgtaaggtaaaacgtcgtagtcgtactacgtcccgtacgtaccgtcgtcgggacgacgggtccgtaccgttcgaccgtaccgtcctccgtaccgaccgtaccgttacccgaaccgtaccggacccgacggttacccggtacccgtccccggtccgg

SEQ ID NO: 251978 - DNA, 719 bp, Homo sapiens
  misc_feature: GYAE6OF02GNTPC.25.28.C06.1.454.CMB.1.raw
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatggtggcatccagatgacccagtctccatccctccctgtctgcatctgttggagacagacgtacaccatctacgttcgggccgggcgaggtcgagggctagttaggtaaatttagttcggcgtgtatcagacaaggaaacgtacgggtaaacgttacccgtaacctcctacactctatcgctcgactcgttacctacttacgtacgtacggttttccgggtcccgttactccgtagtttccgacggtccggtacgtacgggttcggggtacgttaacggggactaagttacgttacctaccgttaccgtaccaaccgtactaccgacgtccgtaaccgccgttccgacgtaaccgtccgtaagtaacgttacgttacggttaacgttaccttaaacgttttattaccgtttaagttaaaacttaaagttctaacggttaccggaccgggttacggtaggttaacccgggttggttaaccccggtaccgggtaaccgggtaaccggttaaacgggtaccggaaccgtttaaacgaacccggtttaaaccggtcggtttaacggtaccggg

SEQ ID NO: 251979 - DNA, 762 bp, Homo sapiens
  misc_feature: GYAE6OF02IXH9K.25.28.C06.1.454.CMB.1.raw
  modified_base (155)..(155): a, c, t, g, unknown or other
  misc_feature (155)..(155): n is a, c, g, or t
  modified_base (172)..(172): a, c, t, g, unknown or other
  misc_feature (172)..(172): n is a, c, g, or t
  modified_base (180)..(180): a, c, t, g, unknown or other
  misc_feature (180)..(180): n is a, c, g, or t
tcagactgtacagtcacgaccggtgctcgatttagagctcacgtattgggtttgggggcagaagtctctctcagtcaggacacagcatggacatggagggtccctgctcagctccgtgggactcctgctgctctcggcctcccagtctatcaagngtggtgcactccagtancgaacccngtcctccacttcccctccgtcgtctcgactacttcgtaggttgaacgtacacggtactaccactactccgtccggttcgggcccggggacgacggtacggtacgggacttaggttaaggttaaagttccggtttcggtacgttacggttacacgaacgtacgtaaacggaaacggtaacggttaaaccttcccttaaccgtcctactactacgtactcgtcgtactactaccgtctttaacgtcgtaccggttacggttccggtaccttcgtgtaacttcggagggtccgtacggttacgggtcggacggttacggaacgtacgtaaccgtacctccgttacctaccggtactaccggtacgaccggctaccgtccgtacgacgtcgtaaccggtagtacgtcgttacggtacttaactttaacttaacgttaacgttaaacttaaacggttaaacgtacggttacggtacggtacccggttacgggtaggtttaccgggtaccggtaccgggtaaaccgggtacgggtaacgtaaccggtacgacgtaaaccgtaccggttaaacgcgggttaataccggg

SEQ ID NO: 251980 - DNA, 728 bp, Homo sapiens
  misc_feature: GYAE6OF02G8SXQ.25.28.C06.1.454.CMB.1.raw
  modified_base (192)..(192): a, c, t, g, unknown or other
  misc_feature (192)..(192): n is a, c, g, or t
  modified_base (496)..(496): a, c, t, g, unknown or other
  misc_feature (496)..(496): n is a, c, g, or t
tcagactgtacagtcacgaccggtgctcgatttagagctcacgtattggggttggggcagaagtctctctcagtcaggacacagcatggacatgagggtccctgctcagcctcctgggacctcctgctgctcgtggcctccagctatcagatgtcggcatccagatcgacccagtctccactcctcctgtcncgctatcgttagttggaactacaggtactactacctacttccgtaccgttcgggcccggtagacggttccgaagggtcctagttaaggttaaactttcgttacggtccgtaggtactacgagaaccgaaacggaaaccggtaaggtaaccgtttaccctaaccttcctacgtatacctagtcgactcgctactaccgttacttcgtacgttaacgggtttccggtcctcgttacgtacttcggacggtccgtagttacgggtcggtcgttaggaactacgtactactaccgtcctaccacttanaccgacgtaccgtcgtcccgttaggacctaccgtccgtaagtaacgtattacggtaactaccgtttaacctttacttaacgttaacgtttaaaacgttaaacgttccgtaaagttacgttaacccgtaccggttacggttaccggttccggtacccgggtaaccggtaaccgggtaacgtaaggttacggtaaccctaaggtaaaccccgtaaggttacgtaccggttacgg

SEQ ID NO: 251981 - DNA, 856 bp, Homo sapiens
  misc_feature: GYAE6OF02GQYLJ.25.28.C06.1.454.CMB.1.raw
  modified_base (200)..(200): a, c, t, g, unknown or other
  misc_feature (200)..(200): n is a, c, g, or t
tcagactgtacagtcacgaccggtgctcgatttagagctcacgtattgggtttgggggcagaagtctctctcagtcaggacacagcatggacatgacgggtccctgctcagctcctggactcctgctgctctggctccagctatcagatgtgcatccagatcgacccagtctccattcctcctgtctgcatctgttgganacagacgtcaccatccacgttggccgggctacgtcgacgggctagttaggaaactttgtttcgggcctaggtactacgaccgacgaaacggtaaacccgtaggggtaaacctttccccgtaaaccgttcccgtaactacgttaccgttaactcggtaccttacggaccttaacgtttcccgttaacgtttttacggaccgtttaaacggggtttttccccggggggtacccctttacggtttaccggtaacttttacccgggaaacgggttcccgggtaacggtttacgggggtttaccggggttaccggttaacgggggtaaacctaaacgggtttaaacttttaccccgaaccctttaccgtacccgtaaacccgttaacgttccggaaacggtaccccgtacggttacccgtttcggaaaccgtttaaccggtaccgttaagggtaaacgtttcggttaacgttaccggaaacttttaaaccgttttaccgttaaacgttaaccgtttaaaacttaaaacgtttcggaaaccgttacgggttacccggttaacccggtaggttaccgtttaaccggggttaaccggaacccggttaagggtaaccgtagggtacgtaactaccggtaaccgtaacggttacggtggtaaccgg

SEQ ID NO: 251982 - DNA, 976 bp, Homo sapiens
  misc_feature: GYAE6OF02IJSUF.25.28.C06.1.454.CMB.1.raw
  modified_base (565)..(565): a, c, t, g, unknown or other
  misc_feature (565)..(565): n is a, c, g, or t
tcagactgtacagtcacgaccggtgctcgatttagagctcacgtattgggtttggggggaagaggaagactgacggtcctcccaggagttcaggtgctgggcaccttgagcactgaacgcagcggactcaccatggagtttgggctgaacttgggtttcctcttgtctctttagttaggtgtctgtagtcgacgcggctactacgttcgggtagggtaggtcggttaggggggcgggggtacgtccgggttccggtaccgccgtaccgggggtaacggttacccggtaccgtaaggtaaccgttcccgtttccccgttaggttcgggttcggggtaccggtaccccggtaacctttaccgtacccgttaaacccttttaccgttaacggttaaacggttttaagttcgggttccgtttccggttttaccggggtcggttaccccgggccgttaaacggtccgggttaccgggtcgggtaacgggacgggggttacgggacgggttagggtaccgggggtcgttacgggttaccgggtttaacggtttcgggttacgtacggtaanaaccggtaaataaacctagttacaacgttagtacgacggcccgggtttaggccggttaacggggacggggtacccggttcctttaacgaaccccgttaatcccggtaacggtaaccgggaaaccgtttaaccgttaaaccgtaaacgaaaccggtacccttaactacggttacttcggtaaactaacgtaaacgtacgttaaccgttaaggaggttaaccgggaacgttacggggtaaacgttccggttttaaccgggtttacttttacggtaccggttaaggtacccgttaacggtcgttaacgggcgggttcgtaaacgggttaacggttaaaaggttaccgggtttaccgtaccttacttaaccccggtaaccgggtttccccaacccgggtttccgggtaaccgggg

SEQ ID NO: 251983 - DNA, 683 bp, Homo sapiens
  misc_feature: GYAE6OF02FJ4AC.25.28.C06.1.454.CMB.1.raw
  modified_base (132)..(132): a, c, t, g, unknown or other
  misc_feature (132)..(132): n is a, c, g, or t
  modified_base (544)..(544): a, c, t, g, unknown or other
  misc_feature (544)..(544): n is a, c, g, or t
tcagactgtacagtcacgaccggtgctcgatttagagctcacgtattgggtttgggggcagaagtctctctcagtcaggacacagcatggacatgagggtccctgctcagctcctgggactcctgctgctcnggctcccagctatcagatgtggcatccagatcgacccagtctccatccctcctgtactcgcatcgtgtggagtacagacgtcactatctacgtcggccgggacgtagtacgaggactagttaggaaacttttagttcggccttaggtactcgagtacgaaacgaaaccgaagggtaaacttaccctaacctccgtacactactacgtacgtctgactaacgttccgtacgtttcgaacgttaacgggttttccggggtacccttacgtacggtacttacggacggtccgggtaacgtacggggttcgggtccggttaacgggacgtaaacgttaacggttcctaacgttccctaacgaacctacgttaccgacgactaccggacttacggactaacgccgttaagaacgttnttacggtataacgttaactatttaacgagttaaactaaagttgtaacgacgttacgacgttacggtagttaccggtaacgtccggtaacgggacttagggaacttacgaacgttaacggaaccgttaggtccgtaacgg

SEQ ID NO: 251984 - DNA, 639 bp, Homo sapiens
  misc_feature: GYAE6OF02IEREA.25.28.C06.1.454.CMB.1.raw
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
  modified_base (343)..(343): a, c, t, g, unknown or other
  misc_feature (343)..(343): n is a, c, g, or t
  modified_base (426)..(426): a, c, t, g, unknown or other
  misc_feature (426)..(426): n is a, c, g, or t
tcagactgtacagtcacgaccggtgctcgatttagagctcacgtattggggtttgggggcagaagtctctctcagtcaggacacagcatggacatgagggtccctgctcagctcctgggactcctgctgctctggcctccagctaatcagatggtggacatcccaagatcgacccagtcctccacttccctcccgtgtctcgactattcgttggttggaacacgaggtactaccaacctataccgtactcggcggctagtacgaggtntattaggtaattcgttacgactagtcanacgtanaacgaacggtaaggtactcctaaccnctacatactagtcgntactacacttcgtaacgtttcgaacttacgggtttccggtacctagtactagtacgacgtcgacgtgggtcggtacgtacggngtaaactcgtacgtactcaacgaccgttagaacgccgcacgtcgacgtacgacgtactacgtatacgtacgttaacgaaccttataaccgttagtaaataacggttaacttacgacgaacgtttcgacgttactacggtaccgggtaactaccggggactaacggtaacgaccgtttaagaaacccggttaaccgaacgttacgcgttaacgg

SEQ ID NO: 251985 - DNA, 174 bp, Homo sapiens
  misc_feature: GYAE6OF01DNX0G.49.35.D02.1.454.CMB.1.raw
  modified_base (173)..(174): a, c, t, g, unknown or other
  misc_feature (173)..(174): n is a, c, g, or t
tcagagtcgagagacacgaccggtgctcgatttagcacacgatagttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 251986 - DNA, 515 bp, Homo sapiens
  misc_feature: GYAE6OF01AXVAO.49.35.D02.1.454.CMB.1.raw
tcagagtcgagagacacgaccggtgctcgatttagcacacgatagttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtccccaaactcatgatctttgaggtcagtgatcggcccgcaggggtttctcatcgcttctccggctccaagtctggcagcacggcctccctgaccatctctgggctccaggctgagacgaggctgattatactgcagctcatatacaaacataaacacttgggtgttcggcggcggaccaaactgaccgtcctacgtcagcccaagctgcccctcggtcactctgtccctaccc

SEQ ID NO: 251987 - DNA, 173 bp, Homo sapiens
  misc_feature: GYAE6OF01D3HVK.49.35.D02.1.454.CMB.1.raw
  modified_base (172)..(173): a, c, t, g, unknown or other
  misc_feature (172)..(173): n is a, c, g, or t
tcagagtcgagagacacgaccggtgctcgatttagcacacgatagttgggtttgggggaagaggaagactgacggtccccaggagttcaggtgctgggcacagcggccctgggctgcctggtcaaggactacttcctcgtagcactctgagcgggctggcaaggcgcatagnn

SEQ ID NO: 251988 - DNA, 519 bp, Homo sapiens
  misc_feature: GYAE6OF01AX0A5.49.35.D02.1.454.CMB.1.raw
  modified_base (435)..(435): a, c, t, g, unknown or other
  misc_feature (435)..(435): n is a, c, g, or t
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgtttggtacttataattctgtctcctggtaccaacaatacccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaanataaacacttgggtgttcggcggcggaccaactgaccgtctacgtcagcccaggctcgcccctcggtcactctcgtcccacccc

SEQ ID NO: 251989 - DNA, 173 bp, Homo sapiens
  misc_feature: GYAE6OF01E4VAN.49.35.D02.1.454.CMB.1.raw
  modified_base (173)..(173): a, c, t, g, unknown or other
  misc_feature (173)..(173): n is a, c, g, or t
tcagagtcgagagacacgaccggtgctcgatttagcacacgatagttgggtttgggggaagaggaagactgacggtcccccaggagttcaggtgctgggcacagcggccctgggctgcttggtcaaggactacttcctctctcgactctgagcgggctggcaaggcgcatagn

SEQ ID NO: 251990 - DNA, 530 bp, Homo sapiens
  misc_feature: GYAE6OF01CVNOM.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgtttggtacttataattctgtctcctggtaccaacaataccccggcaaagtccccaaactcatgatctttgaggtcagtgatcggccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaacgtgaccgtctacgtcacgccaacggctcgcccctcggtaccacttctcgttcccgtcccc

SEQ ID NO: 251991 - DNA, 536 bp, Homo sapiens
  misc_feature: GYAE6OF01CFZX6.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtccccaaactcatgatctttgaggtcagtgatcggccgcagggtttctcatcgcttctccggctccaagtctggcagcacggcctccctgaccatctctcgggctccaggctgaggacgaggctgatttatactgcagctcatataacaaacataaactacgttagggtcgttcgggcggcgggaaccaacgtcgacccgtctacgtcagacccaaggcctcgcccctcggaccactctcgtcccctacccc

SEQ ID NO: 251992 - DNA, 526 bp, Homo sapiens
  misc_feature: GYAE6OF01DSW67.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtcccaaactcatgatctttgagtcagtgatcggcccgcaggggtttctcatcgcttctccggctccaagtctggcagcacggcctccctgaccatctctgggctccaggctgaggacgaggctgatttatactgcagctcatataacaaacaataaacacgttgggtgttcggcggcgggaccaaacgtgaccgtctacgtcagcccaagcctcgccccctcgcactctcgtccctacccc

SEQ ID NO: 251993 - DNA, 559 bp, Homo sapiens
  misc_feature: GYAE6OF01CFS6F.49.35.D02.1.454.CMB.1.raw
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaatacccggcaaaacgtccccaaactcatgatctttgagtcagtnatcggccgcagggtttcncatcgcttctccggctccaagtctggcagcacggcctccctgaccatctctgggctccaggcctgaggacgaggctgattattactgcagctacataactaacaaaacaataaaactacgttagggttagtttcgggcggacggggaacctaaacgtcgacccgtcctaaccgtcacgcccaaacggcctacgccccccgtcggtaccactcctcgttccccgtcccc

SEQ ID NO: 251994 - DNA, 205 bp, Homo sapiens
  misc_feature: GYAE6OF01BIEI2.49.35.D02.1.454.CMB.1.raw
  modified_base (165)..(165): a, c, t, g, unknown or other
  misc_feature (165)..(165): n is a, c, g, or t
  modified_base (171)..(205): a, c, t, g, unknown or other
  misc_feature (171)..(205): n is a, c, g, or t
tcagagtcgagagacacgaccggtgctcgatttagcacacgatagttgggtttgggggaagaggaagactgacggtcccccaggagttcaggtgctgggcacagcggccctgggctgcctggtcaaggctacttcctctctcgatctgagcgggctggcaaggcncatagnnnnnnnnnnnnnnnnnnnnnnnnnnnnnnnnnnn

SEQ ID NO: 251995 - DNA, 532 bp, Homo sapiens
  misc_feature: GYAE6OF01BU6KQ.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtcccaaactcatgatctttgagtcagtgatcggccgcagggtttctcatcgcttctccggctccaagtctggcagcacggcctcctgaccatctctgggctccgaggctgaggacgaggctgattattactgcagctcataataacaaacataaacacgttgggtgttcggacggtcgggaaccaaacgtcgaccgtcctacgtcagcccaaggcctcgccccctcggtcacctctcgttcccctaccc

SEQ ID NO: 251996 - DNA, 536 bp, Homo sapiens
  misc_feature: GYAE6OF01CBQ9T.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatataacaaacataaacactttgggtgttcgggcggcgggaaccaacgtcgacccgtcctacgtcagcccaaggcctcgccccctcggtccactctcgttcccctaccc

SEQ ID NO: 251997 - DNA, 532 bp, Homo sapiens
  misc_feature: GYAE6OF01BA11C.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcgggcggcgggacccaaactcgaccgtcctacgtcagcccaaggctcgccccctcggtccactcctcgttcccgtcccc

SEQ ID NO: 251998 - DNA, 530 bp, Homo sapiens
  misc_feature: GYAE6OF01BQK3U.49.35.D02.1.454.CMB.1.raw
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttggtgttcggcggcgggaccaaacgtgaccgtcctacgtcagcccaaggcctcgcccccgtcggccactcctcgttccccgtcccc

SEQ ID NO: 251999 - DNA, 524 bp, Homo sapiens
  misc_feature: GYAE6OF01C8IK4.49.35.D02.1.454.CMB.1.raw
tcagagtcgagagacacgaccggtgctcgatttagcacacgatagttgggtttggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatctcctgcactggaaccaccaaatgacgttggtacttataattctgtctcctggtaccaacaataccccggcaaagtcccaaaactcatgatctttgaggtcagtgatcggcccgcaggggtttctcatcgcttctccggctccaagtctggcagcacggcctccctgaccatctctggctcagctgagcgaggctgattattactgcagctcatataacaaacataaacacttagggtgttcggcggcgggaaccaaacgtgaccgtcctacggtcagcccaaggctgccccctggtcactctcgtccctacccc

SEQ ID NO: 252000 - DNA, 528 bp, Homo sapiens
  misc_feature: GYAE6OF01D6TH8.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctcctgaccatctctgggctccaggctgaggacgaggctgattattactgcagctcatatacaaacataaacacttgggtgttcggcggcggaccaaactgaccgtcctacgtcagcccaaggcctcgccccctcggtacactactcgttccctacccc

SEQ ID NO: 252001 - DNA, 525 bp, Homo sapiens
  misc_feature: GYAE6OF01DGZXS.49.35.D02.1.454.CMB.1.raw
  modified_base (304)..(304): a, c, t, g, unknown or other
  misc_feature (304)..(304): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtccccaaactcatgatctttnaggtcagtgatcggcccgcaggggtttctcatcgcttctccggctccaagtctggcagcacggcctccctgaccatctctgggctccaggctgaggacgaggctgattatactgcagctcatatacaaaacataaaacacttgggtgttcggcggcgggaccaaacgtgaccgtcacgtcagcccaaggctgccccctcggtacactctgttccctacccc

SEQ ID NO: 252002 - DNA, 503 bp, Homo sapiens
  misc_feature: GYAE6OF01BV0E6.49.35.D02.1.454.CMB.1.raw
  modified_base (372)..(372): a, c, t, g, unknown or other
  misc_feature (372)..(372): n is a, c, g, or t
  modified_base (434)..(434): a, c, t, g, unknown or other
  misc_feature (434)..(434): n is a, c, g, or t
  modified_base (479)..(479): a, c, t, g, unknown or other
  misc_feature (479)..(479): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacganagagtcacccttatcgcggacaatccacgaacacagcctacatggaactgcgcagcctaggntctgcccgacacggcctattattctgtgcgagagagatgtctttnatgattagtactagtctattatcg

SEQ ID NO: 252003 - DNA, 536 bp, Homo sapiens
  misc_feature: GYAE6OF01CZW5O.49.35.D02.1.454.CMB.1.raw
  modified_base (523)..(523): a, c, t, g, unknown or other
  misc_feature (523)..(523): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaacgtccccaaactcatgatctttgaggtcagtgactcggcccgcgagggtttctcatcgcttctccggctccaagtctggcagcacggccctcctcgaccactctcgtcgggcctccgaggctggacggacgaggctaggtattacttacgtgcagctcatatgcaggcagcaactatttgagtatagttcggcggaggaccgagcgtacggcccgtcgtaggtcacggacccaaggtccnccgtccccgtcgg

SEQ ID NO: 252004 - DNA, 639 bp, Homo sapiens
  misc_feature: GYAE6OF01AJDXU.49.35.D02.1.454.CMB.1.raw
  modified_base (280)..(280): a, c, t, g, unknown or other
  misc_feature (280)..(280): n is a, c, g, or t
  modified_base (390)..(390): a, c, t, g, unknown or other
  misc_feature (390)..(390): n is a, c, g, or t
tcagagtcgagagacacgaccggtgctcgatttagcacacgatagttggggtttaggggggggtctacaggaggcagtcggcctctcggggaaccgtctccgaaccacctggcctgggctcttgcctattccctcaccctcctcacgtcacggcacacgggtcctgggcccagtctgccctgactcagcctgcctccgtcgtctgggtctcctggaccaggtacgatccaccatcctcctgcgacctggaaccacaatgacgttggtacttataattcgngtctcctaggtaccaactaacgtaccccggacaaaccgttcccccaaaacgtccacttcgaattccttttaggaggttcagtgactaccgggcccggcgtaggggtttcncattccgcttccgtccggtctccgagtctggcagcgacggccctccctgaccatcctcgtcgggcctccgaggctagacggacgaggtctgtattattactgctagtctctatactaactaaactaattaaaccacgtttcgggtcgttcgggaccgggtaccgggaacccaacgtcgacccgtccgtacgtccgacgacccgaaggcctcggcccccgtcggaccacctcctccgttcccctaccccg

SEQ ID NO: 252005 - DNA, 528 bp, Homo sapiens
  misc_feature: GYAE6OF01ELI3U.49.35.D02.1.454.CMB.1.raw
  modified_base (429)..(429): a, c, t, g, unknown or other
  misc_feature (429)..(429): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatanacaaacataaacncttgggtnttcgggcggcgggaccaaacgtcgaccgtcctacgtcagcccaaggctcgccccctcggtccatcctgtcccctaccc

SEQ ID NO: 252006 - DNA, 525 bp, Homo sapiens
  misc_feature: GYAE6OF01EQMZY.49.35.D02.1.454.CMB.1.raw
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
  modified_base (518)..(518): a, c, t, g, unknown or other
  misc_feature (518)..(518): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacgttggtgttcggcggcggacccaaacgccgtcctacgtcacgcccaggcncgccccncgtcactcctctcccnccctccc

SEQ ID NO: 252007 - DNA, 528 bp, Homo sapiens
  misc_feature: GYAE6OF01DKXT9.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatataacaaacataaacacttgggtgttcggcggcggaccaactgaccgtctacgtcacgcccaaggcctcgccccctcggtcactctcgttcccgtcccc

SEQ ID NO: 252008 - DNA, 530 bp, Homo sapiens
  misc_feature: GYAE6OF01A7P0Z.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgtttggtacttataattctgtctcctggtaccaacaatacccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacaataaacacttgggtgttcgggcggacggaccaaactcgaccgtcctacgtcagcccgaaggctcgcccccgtcgccactctcgtcccgtcccc

SEQ ID NO: 252009 - DNA, 572 bp, Homo sapiens
  misc_feature: GYAE6OF01CRUC9.49.35.D02.1.454.CMB.1.raw
  modified_base (323)..(323): a, c, t, g, unknown or other
  misc_feature (323)..(323): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctcctggtaccaacaactacccggcaaacgtccccaaatccatgatctttgagtcagtgagtcggcccgngagggtttctcatcgcttcgtccggctcaagtctggcagcacggcctcctgaccatctctgggctcaggctggagacgagctgtattattacgtgcagctctataactaacaaactaataaactacgttgggtgttcggcggtacgggaaccaacgttcggacccgttacctacggtaccacggacccgaaggtcctaccggtcccccgtaccgggttactaccgtccgttccggttcccccgtccccg

SEQ ID NO: 252010 - DNA, 566 bp, Homo sapiens
  misc_feature: GYAE6OF01CLJH3.49.35.D02.1.454.CMB.1.raw
  modified_base (332)..(332): a, c, t, g, unknown or other
  misc_feature (332)..(332): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctctgtaccaacaactacccggacaaacgtcccaaactcatgatctttgagtcagtgagtcggcccgcgtagggtttcnctatcgtcttctccggctccaagtctggcacgcaccggcctccctgaccatctcgtgggcctccgaggctggacggacgaggctagtattattactgcagtctcataactaacaaaactaactaaactacgttgggtcgttcgggacgggaccggacctaaacgtcgacccgtctacgtcgacgacccgaacggcctccgcccccgtcgactacctcctccgttcccctacccc

SEQ ID NO: 252011 - DNA, 502 bp, Homo sapiens
  misc_feature: GYAE6OF01DEBZZ.49.35.D02.1.454.CMB.1.raw
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (499)..(499): a, c, t, g, unknown or other
  misc_feature (499)..(499): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtggaaggatcacccctatccttaatatagacaaactatgcacagacattccacgacagatcaccttatcgacgacaaactccacgaacacagccacatggaactgcgcagcctagatctcgccgacacggcctatactttcngtncgagagagntgtctttctatgatagtactagtctattntcg

SEQ ID NO: 252012 - DNA, 532 bp, Homo sapiens
  misc_feature: GYAE6OF01DEG5Q.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtcccaaactcatgatctttgaggtcagtgatcggcccgcagggtttctcatcgcttctccggctccaagtctggcagcacggcctccctgaccatctctgggctccaggctgaggacgaggctgattattactgcagctcatataacaaacataaactacgttgggtcgttcggacggcgggaccaaacgtcgaccgtcctacgtcactcccaagcctcgccccctcggtcactctcgttcccaccc

SEQ ID NO: 252013 - DNA, 535 bp, Homo sapiens
  misc_feature: GYAE6OF01AJW0L.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactacccggcaaacgtaccccaaactcatgatctttgaggtcagtgatcggcccgcgaggggtttctcatcgcttctccggctccagtctggcagcacggcctccctgaccatctctgggcctccgacggctggacggacgaggctggtattacttactgcagctacatataacaacaataactacgttggtcgttcggcggcggaccaacgtcgaccgtcctacgcacgccgagcctcgcccgtcgcacctctcgtccctccc

SEQ ID NO: 252014 - DNA, 529 bp, Homo sapiens
  misc_feature: GYAE6OF01D8Q3E.49.35.D02.1.454.CMB.1.raw
  modified_base (423)..(423): a, c, t, g, unknown or other
  misc_feature (423)..(423): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccgaggctgaggacgagctgattattactgcngctcatataacaaacaataaacagttgggtgttcggcggcgggaccaaacgtcgaccgtcctacgtcagcccaagctcgcccctcggtcactctcgtcccgtcccc

SEQ ID NO: 252015 - DNA, 554 bp, Homo sapiens
  misc_feature: GYAE6OF01CD80Q.49.35.D02.1.454.CMB.1.raw
  modified_base (378)..(378): a, c, t, g, unknown or other
  misc_feature (378)..(378): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctctggtaccaacaactacccggcaaacgtcccaaactcatgatctttgaggtcagtgatcggcccgcgtaggggtttctcatcgtcttctccggctccaagtctggcagcacggcctcccngaccatctctcgggctccgaggctggacggacgagctgatttatactcgcagctacataactaaacaaactaataaactacgttgggtcgttcgggcggacgggaaccaacgtcgaccgtcctacgtcacgcccgaaggcctcgccccgtcggtaccacgtctccgttccctaccc

SEQ ID NO: 252016 - DNA, 558 bp, Homo sapiens
  misc_feature: GYAE6OF01A7VWS.49.35.D02.1.454.CMB.1.raw
  modified_base (479)..(479): a, c, t, g, unknown or other
  misc_feature (479)..(479): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgattataactatgtctcctggtaccaacagtacccaggcaaagccccccagactcatgatttatgcggtcaggtaagcggccctcgaggggtcccctgactcgcttctcgtggcctccaagtctggacaacgccggccctccctgacccgttctcgtgggccgtccggggctaggaagagtggagggcttgtattttatttctgcagtctcatatcgcaggcagacaactattttgngtattagttcgggacgggacgggtaccaaggtctacgtacccgttcgtacggtacgaccgcccgaacggtcgtccccgg

SEQ ID NO: 252017 - DNA, 531 bp, Homo sapiens
  misc_feature: GYAE6OF01AHF9N.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtccccaaactcatgatctttgaggtcagtgatcggcccgcagggtttctcatcgcttctccggctccaagtctggcagcacggcctccctgccatctctgggctcagctgagacgaggctagattattactgcagctcatataacaaacataaacacgttgggtgttacgggcggacgggaaccaaacgtcgacccgtactacgtcagcccaaggcctcgccccctcgtcactctcgtccctacccc

SEQ ID NO: 252018 - DNA, 585 bp, Homo sapiens
  misc_feature: GYAE6OF01D1XZY.49.35.D02.1.454.CMB.1.raw
  modified_base (364)..(364): a, c, t, g, unknown or other
  misc_feature (364)..(364): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactacccggacaaacgtcccaaactcatgatctttgagtcagtgatcggccgcgtagggtttctctatcgcttctccggctccaagtctggcngcacggcctccctcgaccatcctcgtcgggcctccgaggctggacggacggaggctagtattattactgcagctacaatacaacaaacaactaaactacgttgggtcgttcgggacggaccggaacctaaacgtcgaccgtaccgtacggtacctacgcccgtaaacggccctaccgtcccccgtacggttcctaccttccgttccgttcccccgtccccg

SEQ ID NO: 252019 - DNA, 538 bp, Homo sapiens
  misc_feature: GYAE6OF01CTA59.49.35.D02.1.454.CMB.1.raw
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggccgcgagggtttcncatcgcttcnccgctcaagtctggcagcacggcctcctgaccatctcgtgggcctccgaggctgaggacgaggctgattatactgcagctcataactacaaacataaactcgttgggtcgttcgggcggacgggaaccaacgtcgacccgtctacgtcacgacccaggcctcgccccctcggtaccactctccgtccctaccc

SEQ ID NO: 252020 - DNA, 568 bp, Homo sapiens
  misc_feature: GYAE6OF01DFAJ2.49.35.D02.1.454.CMB.1.raw
  modified_base (438)..(438): a, c, t, g, unknown or other
  misc_feature (438)..(438): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtaacttataattctgtctcctggtaccaacaactacccggcaaacgtccccaaatccatgattctttgaggtcagtgatccggcccgcgagggtttctcatcgcttcgtccggctccaagtctagcagcacggcctcctcgaccactctcgtcgggcctccgaggtctggacgggacgaggctagtattagttacgngacagtctacaataataacaaactaataaactacggttagggtacgttcggacgggacggaaccaaacgtcgacccgtctacgtcacgacccgaggcctccgcccctcggacactctccgtccctacccc

SEQ ID NO: 252021 - DNA, 731 bp, Homo sapiens
  misc_feature: GYAE6OF01DUANV.49.35.D02.1.454.CMB.1.raw
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctcgtgtctgggtctccgtggacagtcgatcaccatcctcctgcactacggaaccacaatgacgttggtacttatattctgtctctagtaccaacaactacccggacaaacgtaccccaaactcatgtactcttagagtcagtgactcggccgtcgtaggggtttctacgtactcgtcttcgtccggtctaccgtaagtcgtacggccacgccgaaccggtcccttcccgtcgtaacctacgtccgtcgtacgggtcctccgacggtaccgtagggacggtacggtaggtcttaggttactttaacgttacgtcgtaccgagtcctacgtaattaactaaactaaacgtaacgttaaaccgttacgggtttacggggttaccggttcgggggaaccgggtaaccggggtaaacccgtaaaccggttccggtaaacccggtaccggttacccggtaccgtacccgggtaccccgtaacgggtcccgttaccccggtccccccggttacgggttacccctacccggtttcccgttcccggttccccccggttacccccg

SEQ ID NO: 252022 - DNA, 555 bp, Homo sapiens
  misc_feature: GYAE6OF01EZF4A.49.35.D02.1.454.CMB.1.raw
  modified_base (308)..(308): a, c, t, g, unknown or other
  misc_feature (308)..(308): n is a, c, g, or t
tcagagtcgagagacacgaccggtgctcgatttagcacacgatagttgggtttggggggggtctcaggaggcagcactctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatcttgagntcagtgacgtcggccgtcgtacgggttctcactcgtcgttctccgctccagtctggcacgcaccgcctccctcgaccactcgtcgtcggcgtccgaggcgtggagggacgaggactagtattatactgcacgctactataactaacaaacaactaaacgtacgttcgggtcggtcggcggacggaccgaaacgtacgaccgtcctacgtacgacgccgacgcctccgccctacgtctcgtccgtccg

SEQ ID NO: 252023 - DNA, 534 bp, Homo sapiens
  misc_feature: GYAE6OF01AX4A4.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgtattattactgcagctacatatacaaacataaacacgttgggtgttcggcggacggaccaaacgtcgaccgtcctacgtcagcccaaggcctcgccccctggtccactcctcgtccccgtcccc

SEQ ID NO: 252024 - DNA, 530 bp, Homo sapiens
  misc_feature: GYAE6OF01D7LHB.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacaataacacttggtgttcggcggcggaccaactgaccgtcctacgtccgagcccaaggcctcgcccccgtcggtccactcctcgtccctacccc

SEQ ID NO: 252025 - DNA, 522 bp, Homo sapiens
  misc_feature: GYAE6OF01BNEWB.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcggaaccaactgaccgtcctacgcagcccaagctcgccccctcggcactctcgtcccgtcccc

SEQ ID NO: 252026 - DNA, 622 bp, Homo sapiens
  misc_feature: GYAE6OF01A6QRH.49.35.D02.1.454.CMB.1.raw
tcagagtcgagagacacgaccggtgctcgatttagcacacgatagttgggtttggggggggtctcaggacggcgagtccgctctcgggtacgtctcctaccgatggcctgggcgtctgctattcctcgaccctcctcactcagggtcgacaggtccgtggccagtctggtccctgactcagtactgcctcgtgtctgggtctcctggacaggtcgacggtcacctatctcctgcgactcggaacacatcgacgttggtacttatattctgtctctggttaccaactaactacccgcaagtcccaaactcagtcgactacttcgaggtcgagtgtatcggccgtcgagggtttctcattccgtcttcgtccggctccgtaagttctaggtctacgccgaccggtcccgtcccgcggaccctattctcgtcgggccttccgacggcgtagacgggacgaggactagtactttacgttactgactagactacataatacaaagtaataacgtacgttagggtacgttcggacggtaccggtaactaacgtcgtaccgttaccttacgtcacgtcccgacggtccgtccgccccgttcgtctaccgtccttcggttccccgtcccg

SEQ ID NO: 252027 - DNA, 622 bp, Homo sapiens
  misc_feature: GYAE6OF01D0I0A.49.35.D02.1.454.CMB.1.raw
  modified_base (390)..(390): a, c, t, g, unknown or other
  misc_feature (390)..(390): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacacggcccctggacaaggtccttgagtgggtgggaagatccacccctataccttaatatagacaaactatgcacagacattccacgacagacgtcaccttancgacgaacaactccaacgaacacacgacctacatacggaactgccgacacgaccgtaaggacttccgtacgaccccggaactacccgggtacccgttaatttaccgttttacgtcgggttacgaccggtaaagggaacggtaagggttactttacgggtttacccttttttacacggtttagtaacgttttaaacgtacgtttaacgttacctttaagtttaacgtttacgg

SEQ ID NO: 252028 - DNA, 551 bp, Homo sapiens
  misc_feature: GYAE6OF01EM7KY.49.35.D02.1.454.CMB.1.raw
  modified_base (283)..(283): a, c, t, g, unknown or other
  misc_feature (283)..(283): n is a, c, g, or t
  modified_base (443)..(443): a, c, t, g, unknown or other
  misc_feature (443)..(443): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcgaccatctcctgcacgtggaacaaccaatgacgttggtacttataattctgtctcctggtaccaacaataccccggnaaacgtccccaaaatcatgatctttgaggtcaggtgatcggcccgctaggggtttctcatcgcttctccggctccaagtctggcagcacggcctcccgtgaccatctctcgggctccgaggctggacggacgaggctgtattattactgcagctacatanaacaaacaataaacacgttgggtgttcgggcggacggaaccaaacgtcgtaaccgtcgtacgtcgacgaccaggcctcgcccccgtcggtcactctcgtcccctaccc

SEQ ID NO: 252029 - DNA, 535 bp, Homo sapiens
  misc_feature: GYAE6OF01B8OAE.49.35.D02.1.454.CMB.1.raw
  modified_base (282)..(282): a, c, t, g, unknown or other
  misc_feature (282)..(282): n is a, c, g, or t
  modified_base (382)..(382): a, c, t, g, unknown or other
  misc_feature (382)..(382): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccccggnaaacgtccccaaactcatgatctttgaggtcagtgatcggcccgcgtaggggtttctcatcgcttctccggctccagtctgcagcacggcctcctgaccntctctgggctccgaggctgaggacgaggctgattatactgcagctcatacaacaacaataacacgttgggtcgttcggcggcggaaccaacgtcgaccgtctacgtcagcccaggcctcgcccccgtgtaccacttccgtcgtcccctacccc

SEQ ID NO: 252030 - DNA, 688 bp, Homo sapiens
  misc_feature: GYAE6OF01CYCIH.49.35.D02.1.454.CMB.1.raw
  modified_base (336)..(336): a, c, t, g, unknown or other
  misc_feature (336)..(336): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctcctggtaccaacaactacccggacaaacgtaccccaaactcatgatctttgaggtcagtgatcggcccgcgagggtttcncatcgcttctccggctccaagtctggcagcgaccggccctcctcgacctatctctgggcctccgaggtccgtggaacgggacggacggtcttaggtaactttagttacgtgtaccagtccttacaacttaactaaactaaaactaaacgttaaaaccgtacggtttaggggtacggtttaccgggaccgggtaccggggaaaccctaaacggttccggaaaccccgtttacccgtaaccggtaccgacccgggtaacccccgaaacggggttcccctaccccggtacccccccgttacgggtacccccttaaccgtttccccgttcccggtttaccccccttaacccccccg

SEQ ID NO: 252031 - DNA, 557 bp, Homo sapiens
  misc_feature: GYAE6OF01EXWGM.49.35.D02.1.454.CMB.1.raw
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctgtaccaacaactacccggacaaacgtacccaaactcatgatctttgagtcagtgatccggcccgcgtacgggtttctcactcgtcttctccggctcgaagtctggcagccacggtcctccctcgaccactctcgtcgggctccgaggcgtgagggacgaggctagtattattactgcagctanactanaacaanaataactacgttggtgtcggcggacggaccaacgtgacccgtaccgtacgtcgacgccgaacgtccaccgtccccgtcgtacacctcttccgtcccgtcccc

SEQ ID NO: 252032 - DNA, 587 bp, Homo sapiens
  misc_feature: GYAE6OF01A8I9Q.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaacgtccccaaactcatgatctttgagtcagtgatcggccgcagggtttctcatcgcttctccggctcaagtctgcagcacggcctccgtgaccatctcgtcgggcctccgaggtcgtgaggacgaggctagattacttactgacgtagctactataataacaaactaataaactacgttgggtagttccggacgggtaccgggaaccaaacgtcggtaacccgtacccgttacggtccaacggacccgaacggtcctacccggcccccgttaccggtctacccttcctccgttcccctacccccg

SEQ ID NO: 252033 - DNA, 524 bp, Homo sapiens
  misc_feature: GYAE6OF01AYNSI.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctcgggctccgaggctgaggacgaggctgattattactgcagctcatatacaaacataacagttgggtgttcggcggcggaccaacgtcgaccgtcctacgtcagcccaggctcgcccctcgtcactctcgtcccgtccc

SEQ ID NO: 252034 - DNA, 537 bp, Homo sapiens
  misc_feature: GYAE6OF01AVKU6.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaatacccggcaaagtccccaaactcatgatctttgaggtcagtgatcggcccgcgagggtttctcatcgcttctccggctccaagtctggcagcacggcctcctgaccatctcgtgggcctccgaggctggacggacgaggctgatttattactgcagctacatactaacaaacaattaaacagttgggtgttcggcggacggaacctaactcgaccgtcctacgtcagcccaaggcctcgccccgtcgtcacgtctcgtcccgtccc

SEQ ID NO: 252035 - DNA, 539 bp, Homo sapiens
  misc_feature: GYAE6OF01ET8I0.49.35.D02.1.454.CMB.1.raw
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (423)..(423): a, c, t, g, unknown or other
  misc_feature (423)..(423): n is a, c, g, or t
tcagagtcgagagacacgaccggtgctcgatttagcacacgataggttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtccccaaactcatgatctttgaggtcagtgatcggcccgngtagggtttctcatcgcttcnccggctcaagtctggcagcacggcctcctgacatctctgggctcagctgacggacgaggctgattatactgcagctnatatacaaactataaacacgttggtgttcggcggaccggacaaacgtcgtaccgtcctacgtcaggacccaaggctacccgcccccgtcggtacaccttctcgttccccctacccc

SEQ ID NO: 252036 - DNA, 580 bp, Homo sapiens
  misc_feature: GYAE6OF01D42C4.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccaccaatgacgttgtacttataattctgtctcctggtaccaacaactaccccggcaaagtccccaaactcatgatctttgaggtcagtgatcggcccgcaggggtttctcatcgcttctccggctccaagtctggcagcaccggcctccctgaccatctcgtgggcctccgaggctggaagggacgaggctgactttattactgcagctcataactaacaaacaataaacgtacgttgggttagttcgggacggaccgggaacctaaaacgtcggaaccgtccctacggtaccacgcccgaaaggccttccgcccccgttccggttacaccgtccttccggttcccctacccccg

SEQ ID NO: 252037 - DNA, 526 bp, Homo sapiens
  misc_feature: GYAE6OF01EWO3Y.49.35.D02.1.454.CMB.1.raw
  modified_base (376)..(376): a, c, t, g, unknown or other
  misc_feature (376)..(376): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctcccngaccatctctgggctccgaggctgaggacgaggctgattattactgcagctcatataacaaacataaacacgttggtgttcggcggacggaccaaacgtcgaccgtctacgtcagcccaggctcgcccctcggcactctcgtcccgtccc

SEQ ID NO: 252038 - DNA, 535 bp, Homo sapiens
  misc_feature: GYAE6OF01BC2Z6.49.35.D02.1.454.CMB.1.raw
tcagagtcgagagacacgaccggtgctcgatttagcacacgataggttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgagtcagtgatcggccgcaggggtttctcatcgcttctccggctccaagtctggcagcacggccctcctcgaccatctcgtcgggctccaggctggacggacgaggctgattatactgcagctcatactaacaaacaataaacacgttgggtcgttacgggcggacggaaccaacgtcgaccgtctacgtcagccaaggctcgcccctcggtcactctcgtccctaccc

SEQ ID NO: 252039 - DNA, 528 bp, Homo sapiens
  misc_feature: GYAE6OF01CXFZE.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgtttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacgttggtgttcggcggcggaaccaactcgaccgtcctacgtcagccaaggcctcgcccctcggtcactctcgttcccctaccc

SEQ ID NO: 252040 - DNA, 530 bp, Homo sapiens
  misc_feature: GYAE6OF01E00WX.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcaggggtttctcatcgcttctccggctccaatctggcagcacggcctccctgaccatctctgggctccaggctgaggacgaggctgattagttactgcagctcatatacaaacaataaacacgttagggtgttcggacggacgggaaccaaactgacccgtcctacgtcagcccaggctcgccccctcggtcacctctgtcccgtccc

SEQ ID NO: 252041 - DNA, 561 bp, Homo sapiens
  misc_feature: GYAE6OF01CJ0AG.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgagtcagtgatcggcccgcaggggtttctcatcgcttctccggctccaagtctggcagcacggcctccctgaccatctcgtcgggcctccgaggcgtggacgggacggaggctggtattacttactgacagctacataataacaaacaataaacgtacgttagggtgttcgggacggcgggaacctaaacgtcgacccgtcctacgtccagcccaaggcctacgccccctcggtcacctcctcgttccccgtcccc

SEQ ID NO: 252042 - DNA, 543 bp, Homo sapiens
  misc_feature: GYAE6OF01B98K6.49.35.D02.1.454.CMB.1.raw
  modified_base (434)..(434): a, c, t, g, unknown or other
  misc_feature (434)..(434): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatcctctgggctccgaggctgaggacgaggctgattattactgcagctcataanaacaaacataaacacgtttgggtgttcggacgggcggaaccaaacgtcgaccgtcctacgtcagacccaaggcctaccgcccctcggtccactcctccgttccccctcc

SEQ ID NO: 252043 - DNA, 543 bp, Homo sapiens
  misc_feature: GYAE6OF01EJ8NP.49.35.D02.1.454.CMB.1.raw
  modified_base (376)..(376): a, c, t, g, unknown or other
  misc_feature (376)..(376): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctcccngaccactctctcgggcgtccacggcgtgaggacgaggcgtgattattactgcagctcatataacaaacaataaactacgttggtggttcggcggacgggaccgaactcgaccgtccgtacgtcacgaccgacgcgtcgccccgtcgtccactcctcgtccctacccc

SEQ ID NO: 252044 - DNA, 530 bp, Homo sapiens
  misc_feature: GYAE6OF01C5BB0.49.35.D02.1.454.CMB.1.raw
  modified_base (459)..(459): a, c, t, g, unknown or other
  misc_feature (459)..(459): n is a, c, g, or t
  modified_base (514)..(514): a, c, t, g, unknown or other
  misc_feature (514)..(514): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaacgtcccaaactcatgatctttgaggtcagtgatcggccgcgtaggggtttctcatcgcttctccggctccgaagtctggcagcacggccctccctgaccatctcgtgggctccgaggctgaggacgaggctagattattactgcagctcatataacaaacaataaacacgttgggngttcggcggcggaaccaactcgaccgtcacgtcagcccagcctcgccctcggtcnctctccgtccctaccc

SEQ ID NO: 252045 - DNA, 530 bp, Homo sapiens
  misc_feature: GYAE6OF01DIXFL.49.35.D02.1.454.CMB.1.raw
  modified_base (479)..(479): a, c, t, g, unknown or other
  misc_feature (479)..(479): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtggaggatcgacccctatccttaatatagcaaactatgcacagacattaccacgacagacgtcacccttatcgacgacaaactccaacgaacacagaccctacacgtaggaactgacgcacgccctaggactctcgacccgacgtacggccgttatactttcngtgcgagagagtatgttctttctatgtattacgtacttagtactattgtcg

SEQ ID NO: 252046 - DNA, 529 bp, Homo sapiens
  misc_feature: GYAE6OF01BT9RX.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgagtcagtgatcggcccgcaggggtttctcatcgcttctccggctccaagtctggcagcacggcctccctgaccatctctgggctccaggctgaggacgaggctgattattactgcagctcatatacaaacataaacacgttggtgttcgggcgcgggacaaacgtgaccgtcctacgtcagcccaaggcctcgccccctcggtcactctcgttcccctacccc

SEQ ID NO: 252047 - DNA, 803 bp, Homo sapiens
  misc_feature: GYAE6OF01C5PNP.49.35.D02.1.454.CMB.1.raw
  modified_base (339)..(339): a, c, t, g, unknown or other
  misc_feature (339)..(339): n is a, c, g, or t
tcagagtcgagagacacgaccggtgctcgatttagcacacgatagttggggtttggggggggtctcaggaggcagcggctctcgggacgtctccaccatggcctgggctctgctattcctcaccctcctcactcgagggcacagggtcctgggcccagtctgccctgactcagcctgcctccgtgtctgggtctccgtggacagtcgatcaccatcctcctgcacgtggaaaccacaatgacgtttgtaacttatatctgtctctgtaccaacaactacccggacaaacgtcccaaactcatagtacttcgtttagaggtcaggtgacgtcgggcccgnggtacggggtttcacgtagtccgtccgttccgtccggtccttaccgaacggtccgtacgggaccaacggtcccgtaccggtccccttaccccgtacgtaacccgtaccgtaccgttccggtacgggggtcccttacccggtacgggtcccgttacgggaacggggacccggtacgggtaccttacggtaacgtttaacgttaaccggtcggaccgtaacggtacccttaacgtaacttaaccgtaaacctaaaccgtaaaccgttaaaaccggttacgggtttaccggggttacgggttaccggggaacccggggtacccgggtaaacctaaaaccggttccggaaaccccggtttacccgtaaccgggtacccgtaaccggaccccgtaacgggtcccgttaccccggtaccccccgtcgggttaaccctacccgtttccgttacccggttcccccgtccccg

SEQ ID NO: 252048 - DNA, 535 bp, Homo sapiens
  misc_feature: GYAE6OF01CB5P9.49.35.D02.1.454.CMB.1.raw
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcggtcagtaagcggccctcaggggtccctgatcgcttctctggctccaagtctggcaacacggcctccctgacccgtctctgggctccgggctgaagntgaggctgatttatttctgcagctnatatgcaggcagacaactaattttgtgtattagtcgggcggaagggaccaagtctacggacccgttcctagttccgacgccccgaaggccttcggcccccgtcggg

SEQ ID NO: 252049 - DNA, 552 bp, Homo sapiens
  misc_feature: GYAE6OF01C5BXF.49.35.D02.1.454.CMB.1.raw
  modified_base (395)..(395): a, c, t, g, unknown or other
  misc_feature (395)..(395): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactggaaccaccaaatgacgttggtacttataattctgtctcctggtaccaacaataccccggacaaacgtcccaaactcatgatctttgaggtcagtgatcggccgcgaggggtttctcatcgcttctccggctccaagtctggcagcacggcctcctgaccatctctggctccnggctgagacgagctgattatatgcagctactatataacaaactaataaactacgttagggtcgttcggacgggcggaaccaaacgtacgacccgtcctacgtcagcccaacggcctcgccccccgtcggtacctacgtcctcgttccccgtaccccc

SEQ ID NO: 252050 - DNA, 767 bp, Homo sapiens
  misc_feature: GYAE6OF01BLI4K.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgatcaccatctcctgcactggaaccaccaatgacgttggtacttataattctgtctcctggtaccaacaactacccggacaaacgtcccaaactcatgatctttgagtcagtgactcggcccgcgtagggtttctacgacgttcgtccttcgtccgcctacgaacgttcgtcggcacggccgaccggtccctcccgtacggaaccctacgtccgttccgtcggggtacctcccggaggtccgtaggaacgggaccggtacggtacgttagttaacgttttaacgttaaccgtcggtaccgtaacggtccttaacgtaacttaaaccttaaactaaaaccgtaaactttaaaaccggtaccgggtttaggggtttacccgggttacggggaaccggggtacccgggtaaaacccgtaaaccggttccggtaaacccccggttacccgttaaccgggtacccgtaacccggaaccccggttaaacgggccccgttaacccggcccccccgtttacgggtaccccttaacccgtttcccgttaccccggttccccccgttaccccccg

SEQ ID NO: 252051 - DNA, 542 bp, Homo sapiens
  misc_feature: GYAE6OF01A1M2W.49.35.D02.1.454.CMB.1.raw
  modified_base (376)..(376): a, c, t, g, unknown or other
  misc_feature (376)..(376): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcgaggggtttctcatcgcttctccggctccaagtctgcagcacggcctcccngaccatctctggctccaggctgaggacgagctgattattactgcagctcatataacaaacaataaactacgttgggtgttcggcggacgggaaccaacgtcgaccgtcctacgtcacgacccgaagccgtcgccccctcggtccacttccgtcgttccccgtcccc

SEQ ID NO: 252052 - DNA, 604 bp, Homo sapiens
  misc_feature: GYAE6OF01D8J1Z.49.35.D02.1.454.CMB.1.raw
  modified_base (186)..(186): a, c, t, g, unknown or other
  misc_feature (186)..(186): n is a, c, g, or t
tcagagtcgagagacacgaccggtgctcgattttagcacacgatagttggggtttggggggggtctcaggaggcagcgctctcgggacgtctccaccactggcctgggctctgctattcctcaccctcctcactcagggctacagggtcctgggcccagtctgccctgactcagcctgcctccgtntctgggtctcctggacagtcgatcaccatcctcctgcactggaaccacaatgacgttggtacttatattctgtctcctaggtaaccaacaactacccggcaaacgtccccaaactcatgatcgtttgaggtcagtgactcggcccgtcgacgggtttctcatccgcttctccggctccgaagtcgtggcagcacggctccctgaccatctctggcctccacggctgaggacgaggctgtattattactgactgcctacgattactaacaaacgtactaaaccgtacggttcggttacgtttccgggacggtaccgggaacctaaacggtcgacccggttacctaacgtaccgacgacccgtaaagggtccctaccggtccccctacggtcctaaccttccgtcgttccccctaccccg

SEQ ID NO: 252053 - DNA, 559 bp, Homo sapiens
  misc_feature: GYAE6OF01ENQ23.49.35.D02.1.454.CMB.1.raw
tcagagtcgagagacacgaccggtgctcgatttagcacacgatagttgggtttgggggggggtctcaggacggcagcgctctcgggacgtctccaccatggccgtcgggctctgctattccgtcaccctcctcactcagggcacagggtcctgggcccagtctgccctgactcagcctgcctccgtgtctgggtctcctggacagtcgatcaccatctcctgcactgaaccaccaatgacgttggtacttataattctgtctctggtaccaacaatacccgacaaagtcccaaactcatgatctttgaggtcagtgatcggccgcgtaggggtttctcatcgcttctccggctccgaagtctggcagcacggcctccctgaccatctcgtgggctccgaggctgaggacgaggctagtattattactgcagctacaatataacaaacgtataaaccgagtttcgggtacgttacgggacgggacggaaccgaaacgtacggacccgtactacgtccagcccaaggcctcgcccctcggtcactcttcgtcccctacccg

SEQ ID NO: 252054 - DNA, 552 bp, Homo sapiens
  misc_feature: GYAE6OF01DP1HL.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgacggacgaggctgatttatactgcagctcatataacaaacataaacacgttgggtcgtttcggccgggcgggaaccaaactcggaccgtacctacggtcagccccaagggcctccgcccccgttcggtaccagttcctcgttccccgtccccg

SEQ ID NO: 252055 - DNA, 530 bp, Homo sapiens
  misc_feature: GYAE6OF01D7OXB.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaaactcatgatctttgaggtcagtgatcggcccgcaggggtttctcatcgcttctccggctccaagtctggcagcacggcctcctgaccatctctgggctccaggctgaggacgaggctgattattactgcagctcatataacaaacaataaacactttgggtgttcggcggcgggaccaaactgaccgtcctacgtcagcccaaggctcgccccctcgtcactcctcgtcccgtcccc

SEQ ID NO: 252056 - DNA, 526 bp, Homo sapiens
  misc_feature: GYAE6OF01CJT20.49.35.D02.1.454.CMB.1.raw
  modified_base (463)..(463): a, c, t, g, unknown or other
  misc_feature (463)..(463): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgtttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctggggctccaggctgaggacgaggctgattatactgcagctcatatacaaaacataaaacacttgggtgttcggcgngggaccaaaatgaccgtcctagtcagcccaaggcctgccccctcggtcactctgttcccgccc

SEQ ID NO: 252057 - DNA, 525 bp, Homo sapiens
  misc_feature: GYAE6OF01BYA7V.49.35.D02.1.454.CMB.1.raw
  modified_base (281)..(281): a, c, t, g, unknown or other
  misc_feature (281)..(281): n is a, c, g, or t
  modified_base (324)..(324): a, c, t, g, unknown or other
  misc_feature (324)..(324): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttatattctgtctcctggtaccaacaataccccggnaaagtccccaaactcatgatctttgagtcagtgatcggcccgngagggtttctcatcgcttctccggctccaagtctggcagcacggcctccctgaccatctcgtcgggctccgaggctgaggacgaggctgattatactgcngctnatatacaanataacagttggtgttcggcggcggacaacgtcgaccgtctacgtcagacccgaggcctcgccccgtcgtcacctctcgtcccctaccc

SEQ ID NO: 252058 - DNA, 552 bp, Homo sapiens
  misc_feature: GYAE6OF01DZ39A.49.35.D02.1.454.CMB.1.raw
  modified_base (252)..(252): a, c, t, g, unknown or other
  misc_feature (252)..(252): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattcngtctcctggtaccaacaactaccccggcaaacgtcccaaactcatgatctttgaggtcagtgactcggcccgcgaggggtttctcatcgcttctccggctccaagtctggcngcacggcctcccngaccatctcgtggcctccgaggctggacggacgaggctgtaattactactncgngctacatanaacaaacaataaacgcttgggtacgttcgggcggacggaacctaaacgtcgaccgtacctacgtccacgaccacggccacgcccccgtgtccactcctccgttccctccccg

SEQ ID NO: 252059 - DNA, 539 bp, Homo sapiens
  misc_feature: GYAE6OF01CSIGV.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaacgtcccaaactcatgatctttgaggtcagtgatcggcccgcaggggtttctcatcgcttctccggctccaagtctgcagcacggcctcctgaccatctctgggctcaggctgaggacgaggctagattatactgcagctacatataacaaacataaacacgttgggtgttcggacggcggaaccaaacgtcgaccgtcctacgtccgagacccaaggcctcgaccccctcggtaccactcctcgttcccctacccc

SEQ ID NO: 252060 - DNA, 529 bp, Homo sapiens
  misc_feature: GYAE6OF01AM5TF.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgagggacgaggctgattattactgcagctcatacaacaaacaataaacactttgggtgttcggcggacggaccaaactgaccgtcctacgcagcccaggcctcgccccctcgcactctcgttcccgtcccc

SEQ ID NO: 252061 - DNA, 664 bp, Homo sapiens
  misc_feature: GYAE6OF01CA2OH.49.35.D02.1.454.CMB.1.raw
  modified_base (463)..(463): a, c, t, g, unknown or other
  misc_feature (463)..(463): n is a, c, g, or t
tcagagtcgagagacacgaccggtgctcgatttagcacacgatagttgggtttggggcatcacataacaaccagattcctcctctaaagaagcccctgggagcacagctcatcaccatggactggacctggaggttcctctttgtggtggcagcagctacaggtgcccagtcccgggtccagctggtgcaatcgtgggctgaggtgagaagcctgggtcgtcggtgaaggtctcctgcaaggcttcgtggagacaccttcaactacttgctgtcagcgtgggtcgcgacgtacggccccgtaggacaaggccttaggaggtggggtaggaaggactacgacccctatccgttaaatagtagactaaactatagacaacgacgacattacccacgtacaggtacgtaccctaaccttagtaccgacggtaacaactcccgaaacgaacaccaacgtaccctaanaacgtacggaaacctcggaccgacgaacgtccgtaagggacttccgaccggacccgaaccggtacccgggtacccgttaagtttaaccttttcgacggtttacggaccggtaacggtaaggaggttaacgttcggtttaccctttttagaaaccgttgttaaacgttacgttacgttaagttccttaaaggtttcttacgg

SEQ ID NO: 252062 - DNA, 546 bp, Homo sapiens
  misc_feature: GYAE6OF01BCF3Y.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaataccccggcaaacgtccccaaactcatgatctttgaggtcagtgatcggcccgcaggggtttctcatcgcttcctccggctccaagtctggcagcacggcctccctgaccatctcgtggctccgaggctgaggacgaggtctgtatttattactgcagctcatataacaaacaataaactacgttgggtgttcggacggacggaccaactcgaccgtccgtacgtcacgacccaggcctcgcccccgtcgtacaccttcctcgtccccgtacccc

SEQ ID NO: 252063 - DNA, 567 bp, Homo sapiens
  misc_feature: GYAE6OF01EIXO8.49.35.D02.1.454.CMB.1.raw
  modified_base (322)..(322): a, c, t, g, unknown or other
  misc_feature (322)..(322): n is a, c, g, or t
  modified_base (374)..(374): a, c, t, g, unknown or other
  misc_feature (374)..(374): n is a, c, g, or t
  modified_base (419)..(419): a, c, t, g, unknown or other
  misc_feature (419)..(419): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccgcaaacgtcccaaactcatgatctttgagtcagtgatcggcccgntaggggtttctcatcgcttctccggctcaagtctggcagcaccggcctcccngaccctatctcgtgggcctccgaggctggacggaggacccccggntgattattactgcagctacatactaacaaacaataaacagttgggttacgttcgggacggaccgggaacctaacgtcgtaccgtacctacgtcacgacccgacggcctaccgtccccgtcggtcctactccttccgttcccctacccc

SEQ ID NO: 252064 - DNA, 658 bp, Homo sapiens
  misc_feature: GYAE6OF01CL5GV.49.35.D02.1.454.CMB.1.raw
  modified_base (256)..(256): a, c, t, g, unknown or other
  misc_feature (256)..(256): n is a, c, g, or t
  modified_base (382)..(382): a, c, t, g, unknown or other
  misc_feature (382)..(382): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaaatgacgtttggtacttataattctntctcctgtaccaacaactacccgacaaacgtacccaaactccatgatctttgagtcagtgagtccggccgacgtaggggtttctcactccgtcttcgtccggctcaagtctgcagcacggcctccngacactctcgtcggccttccgagcgtggacggtacgagtctagtattacttacgtcgtcagtcctctaatagttcgaccgacgggactaacgaaccttaaaaccgtttagttttacggtacgtaacgtttaacggttcggggaaccgggttaacggggaaacccgtaaacggttccgttacggtaaccccggtttacccgttaaggggtaccccgtaaccggtacccccgtaaaggggtccccgtttaccccggtcccccccgtttaaaccccggg

SEQ ID NO: 252065 - DNA, 923 bp, Homo sapiens
  misc_feature: GYAE6OF01CBSCI.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaaccaccaatgacgtttggtacttataattctgtctcctggtaccaacaactaccccggacaaaacgtccccaaactcatgattctttgaggtcagtgactccggacccgcgtaggggttttcctacgtatccggcctttccgtccgggtccttacccgtaaagttccgtcgggacctaacggcccgtaaccgggtccccttccccgtacggaacccctaacgttcccgttccgttccggggtcccttacccggaacggggtcccgttacggggaaacggggtaaccccgggtaacggggtacctttaacgggttaaacgtttttaactttaaccggttcggacccgttaacggtaccctttaaccgtaaatttaaaccgtaaaacctaaaaaaacccttaaaacgttaaaaaaccccgtttaccggggttttttaacggggggttaccggttttaccccggggggacccggggtaacccgggggttaaaaaccccgtaaaaccggtttacccgggtaaacccccggtttaccccggtttaaacccgggtacccggtaaacccggtaacccccggtaaaaccggggtccccccgttaaccccgggttaccccccccccggtttacggggttaaccccttaaacccccggttttcccgtttcccccgggtttttaacccccccccctaaacccccccgg

SEQ ID NO: 252066 - DNA, 528 bp, Homo sapiens
  misc_feature: GYAE6OF01CMYN3.49.35.D02.1.454.CMB.1.raw
  modified_base (421)..(421): a, c, t, g, unknown or other
  misc_feature (421)..(421): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttatattctgtctcctggtaccaacaactaccccggcaaacgtccccaaactccatgatctttgaggtcattgatcggccgcaggggtttctcatcgcttctccggctccaagtctggcagcacggcctccctgaccatctctcggctccaggctgaggacgagctgtatatactgcngctcatataacaaacataaactacgttgggtgttcgggcggcggaaccaacgtcgaccgtcctacgtcagcccagcctcgccccgtcgtcactctcgttcccgtccc

SEQ ID NO: 252067 - DNA, 547 bp, Homo sapiens
  misc_feature: GYAE6OF01B57H7.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctgggctgaggtgagaaagcctgggtcgtcggtgaaggtctcctgcaaggcttctggagacaccttcaacaactttgctgtcagctgggtgcgacaggcccctggacaaggccttgagtgggtggaagatcacccctatccttaatatagcaaactatgcacagacattccacgacagagtcacccttagtccgcggaacaaatccaacgaacacacgcctaacagtaggaactgcgacacgtcctaggactccgtagacccgacgaccggccgttaagttctttacgtgtcggcgaagagagtagttgttacctttcagtagtattacgtaacttaggtctaagtttgtacgg

SEQ ID NO: 252068 - DNA, 550 bp, Homo sapiens
  misc_feature: GYAE6OF01B0XYE.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgactttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccgaggctgaggacgaggctgattattactgcagctacatataacaaacaataaacacgttagggtcgttcggcggaccgggaaccaaacgtcgacccgtcctacgtcagacccgaggcctccgccccgtcggtccacctcctccgttcccctaccccc

SEQ ID NO: 252069 - DNA, 542 bp, Homo sapiens
  misc_feature: GYAE6OF01A18VC.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcaggggtttctcatcgcttctccggctccaagtctggcagcacggcctccctgaccatctctgggcctccgaggctggacggacgaggctgattattactgcagctacatactaacaaacaataaacacgttgggtgttcggcggcggaccaacgtcgtaccgtccgtacgtcagcccgagccgtcgcccccgtcgtccactcctcgtccctacccc

SEQ ID NO: 252070 - DNA, 564 bp, Homo sapiens
  misc_feature: GYAE6OF01CI2MA.49.35.D02.1.454.CMB.1.raw
  modified_base (430)..(430): a, c, t, g, unknown or other
  misc_feature (430)..(430): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaactacccggcaaacgtccccaaactcatgatctttgaggtcagtgatcggccgcgagggtttctcatcgcttctccggctccaagtctggcagcacggccctccctcgaccatctctgggctccgaggctggacggacgaggctgatttatactgcagctnataataacaaactaataaactacgttgggtcgttcggacgggaccggaaccgaaacgtcgacccgtccgtaaccgtccgagaccccgaaggcctccggtccccctcggtcacctccttcgttccccctaccccg

SEQ ID NO: 252071 - DNA, 554 bp, Homo sapiens
  misc_feature: GYAE6OF01DY6IP.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcgtaggggtttctcatcgcttcctccggctccaagtctggcagcacggccctccctgaccatctcgtgggctccaggctgacggacgaggctgtattattacgtgcagtctcataataacaaacaactaaactacgttgggttgttcggcgggtaccgggaaccaaacgtcgaccgtcctacgtcacgcccagcctcgccccctcgtaccactctcgttcccctacccc

SEQ ID NO: 252072 - DNA, 539 bp, Homo sapiens
  misc_feature: GYAE6OF01EJ6CB.49.35.D02.1.454.CMB.1.raw
  modified_base (228)..(228): a, c, t, g, unknown or other
  misc_feature (228)..(228): n is a, c, g, or t
  modified_base (316)..(316): a, c, t, g, unknown or other
  misc_feature (316)..(316): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnccaaatgacgttggtactttataattctgtctcctggtaccaacaataccccggcaaagtcccaaactcatgaatctttgaggtcagngatcggcccgcaggggtttctcatcgcttctccggctccaagtctggcagcacggcctccctgaccatctctgggctccaggctgaggacgaggctgattattactgcagctcatataacaaacaataaactacgttgggtgttcggcggacgggaaccaaactcgaccgtcctacgtcagcccaaggcctcgccccctcgtcactcctgttcccctaccccg

SEQ ID NO: 252073 - DNA, 603 bp, Homo sapiens
  misc_feature: GYAE6OF01AJJUG.49.35.D02.1.454.CMB.1.raw
  modified_base (338)..(338): a, c, t, g, unknown or other
  misc_feature (338)..(338): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttataattctgtctcctggtaccaacaataccccggacaaacgtccccaaactcatgatctttgaggtcagtgatcggcccgcgtaggggtttcncatccgcttcgtccggctccaagtctggcagcacggccctcccgtcgaccatcctcgtcgggcctccgaggcctaggacggacgaggtctagtattagttactgcagtctcatactaacaaacaactaaactacgttgggtcgttccgggacggtacggaacctaaacgtcggtaacccgtacgtaccggtcaacggacccgacggtccctaccggtccccccgtacggtaccctacccgttccgttccgttcccccgtaccccg

SEQ ID NO: 252074 - DNA, 564 bp, Homo sapiens
  misc_feature: GYAE6OF01BL1CB.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctcctggtaccaacaactaccccggacaaacgtccccaaactcatgatctttgaggtcagtgatccggcccgcgtaggggtttctctatccgtcttcgtccggctccgaagtctggcaggcaccggcctccctcgaccactcctcgtcgggtctccgacggctaggacggacgaggtcgtagtatttacttacgcgcagtctacataactaacaaacaataaactcgttggttcgtcggcggaccgaaccacgtcgaccgtcgtacgtcacgccgacggctcgccccgtcgtcaccttcgtcgtccctccc

SEQ ID NO: 252075 - DNA, 531 bp, Homo sapiens
  misc_feature: GYAE6OF01DZ1G5.49.35.D02.1.454.CMB.1.raw
  modified_base (388)..(388): a, c, t, g, unknown or other
  misc_feature (388)..(388): n is a, c, g, or t
  modified_base (415)..(415): a, c, t, g, unknown or other
  misc_feature (415)..(415): n is a, c, g, or t
tcagagtcgagagacacgaccggtgctcgatttagcacacgatagttgggtttggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttggagtgggtgggaaggatcgacccctatccttaatatagcaaactatgacacagacattaccacgacagagtcaccttancgcggacaatccacgaacacagcctanatgaactgcgcagcctaggatctgaccgacgacggcccgttataacgtttctagtgacgagacgagtaatgttctttctaagttgtaacgttagttaactagtactagttatacgg

SEQ ID NO: 252076 - DNA, 507 bp, Homo sapiens
  misc_feature: GYAE6OF01B5SN5.49.35.D02.1.454.CMB.1.raw
  modified_base (460)..(460): a, c, t, g, unknown or other
  misc_feature (460)..(460): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaatccacgaacacagcctacatggaactgcgcagcctaggatctgccgacaccggcctatactttcngtgcgagagagattgtctttctatgattagtacttagtctattatcg

SEQ ID NO: 252077 - DNA, 634 bp, Homo sapiens
  misc_feature: GYAE6OF01A4E39.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactaggaaccaccaatcgacgttggtacttatattctgtctctgtaccaacaactacccgacaaacgtcccaaactcatgatctttgaggtcagtgagtccggccgcgtaggggtttctcgatccgtcttcctccggtctccaagtctggacagcaccggcctacccgtcgtaccacttccgtcgtcgggcctccgacggcgtaggacgggaacggacggcttagtaactttagttaacgtcgactacgtctactattaactaaacaaactaagtaaactacggtttagggttacgggttcggccgggacgggtaaccctaacggtaccgtaccgtacccgtacgtacgacggaccgtacggtcctacccgcccccgttcggtacctaccgttcccgtcccggttccccgtccccg

SEQ ID NO: 252078 - DNA, 560 bp, Homo sapiens
  misc_feature: GYAE6OF01BILSX.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaatcatgatctttgaggtcagtgatcggcccgcgtagggtttctcatcgcttctccggctccaagtctggcagcaccggccctccctgaccatctcgtcgggctccgaggcctggacggacgaggtctgtatttatactgacagctacataactaacaaactataaacgacgttgggtcgttcggacggacgggaaccaacgtcgaccgtcctacgtcacgacccgaggcctaccgccccgtcggtacactcctccgtcccctacccc

SEQ ID NO: 252079 - DNA, 545 bp, Homo sapiens
  misc_feature: GYAE6OF01CA4VG.49.35.D02.1.454.CMB.1.raw
  modified_base (400)..(400): a, c, t, g, unknown or other
  misc_feature (400)..(400): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgtttggtacttataattctgtctcctggtaccaacaataccccggcaaagtccccaaactcatgatctttgaggtcagtgatcggcccgcgaggggtttctcatcgcttcgtccggctccaagtctggcagcacggcctccctgaccatctctggggcctccgnggctgacgggacgaggctgattacttactgcagctcataactaacaaacaataaactacgttgggtgttcgggcggacgggacctaacgtcgaccgtcctacgtcacgacccaggcctcgcccctcgcacctctcgtccctcccc

SEQ ID NO: 252080 - DNA, 527 bp, Homo sapiens
  misc_feature: GYAE6OF01CKMMI.49.35.D02.1.454.CMB.1.raw
  modified_base (401)..(401): a, c, t, g, unknown or other
  misc_feature (401)..(401): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggcctccaggctgnggacgaggctagattatactgcagctacatataacaacaataacacttggtgtcggcggcggaccaactgaccgtcctacgtcacgacccgagctcgccccgtcggcactcctcgttccctacccc

SEQ ID NO: 252081 - DNA, 532 bp, Homo sapiens
  misc_feature: GYAE6OF01DJTNN.49.35.D02.1.454.CMB.1.raw
  modified_base (384)..(384): a, c, t, g, unknown or other
  misc_feature (384)..(384): n is a, c, g, or t
  modified_base (500)..(500): a, c, t, g, unknown or other
  misc_feature (500)..(500): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaagggcttctggagacaccttcaacaactttgctgtcagctgggtgcgacaggcccctggacaggccttgagtgggtggaggatcacccctatccttaatatagcaaactatgcacagacattccacgacagagtcacccttancgacgaacaaactccaacgaacacacgaccctaacagtaggaacctgccgcacgcctagggactcgtcgacccgacacggccttatatttctgtgcgagagagtattgttcttttnagtgtaagttacgtacttagtctatttgtacg

SEQ ID NO: 252082 - DNA, 809 bp, Homo sapiens
  misc_feature: GYAE6OF01ESLNZ.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcccgtcgggccagtctcgcctgacctcacgtcctcgtcccgtcggtgtcggttcgggtcctccgtaggactcggtcgactaccacctacttcctccgtcgacctacgtaccggaacccaacctaagtcggtacggttggttaacttattaacttcgttcgtcctccgtacggtaaccaactaaccgtaccccgaacgtaaacctaacccctaaactacgactagtactttcttacggacggttacaggtacgtacgtcccgggtacccgtacggttacggggtttcctcgtacgtccgttaccgttcccgtccggtacctaccgtaacgttccgtcggacgacggaccgtacccggtccctacccgtaccgtaacctacgttcccggttcggtaccggggttccacccggtacggtccgttagggaacgggtacggaacggttccgtaggttaaactttacgttacctcggtacgtacggtcctaactaactactaaaaccgtaaactaaacgttaaccgttacgggtttagggtcggttacgggaccgggaaccgtaaaccgtaacgtaccggtaaccccgtaccgtaccgtcgaaccccggaccgacgtcccgtccccgaccccggtcgttacctaccctccggttccctaccccttaccccg

SEQ ID NO: 252083 - DNA, 595 bp, Homo sapiens
  misc_feature: GYAE6OF01BB77N.49.35.D02.1.454.CMB.1.raw
  modified_base (326)..(326): a, c, t, g, unknown or other
  misc_feature (326)..(326): n is a, c, g, or t
  modified_base (521)..(521): a, c, t, g, unknown or other
  misc_feature (521)..(521): n is a, c, g, or t
  modified_base (590)..(590): a, c, t, g, unknown or other
  misc_feature (590)..(590): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttcgtggagacaccttcaactaactttgctgtcagctgggtgcgacaggcccctggacaaggtcctgagtgggtgggaagntaccgaccccttagtaccctttaaatactaagacaaaacgttatacgtacaacacgaacctacttacccaacgaacagtactcctaacccttagtccggacgaacaataccaacgaacacgacgacctacagtagaacctgcacacgactaggactcgtcgaccccgacgacccggtacttaacgttctttacgnggttacgacggaaggtagataagttcgttacgtttctagtagtaacttacgtacttaggttctagtttntacgg

SEQ ID NO: 252084 - DNA, 688 bp, Homo sapiens
  misc_feature: GYAE6OF01BNZHD.49.35.D02.1.454.CMB.1.raw
  modified_base (251)..(251): a, c, t, g, unknown or other
  misc_feature (251)..(251): n is a, c, g, or t
  modified_base (274)..(274): a, c, t, g, unknown or other
  misc_feature (274)..(274): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattcngtctctgtacaacactacccganaaacgtcccaaactcatgatctttgagtcagtgagtccggccgcgtacgggtttctacgtactccgtcttccgtccggccttaccgaacggtcgtcggcacggtcccgaccggtccccttcccgtacgtaaccctacgttccgttccgtcggggtcctacccggtacggtccgtacgggaacgggtacggacggtccgttagtaacgtttacgttacgtcggacgtacgtcctacgtaattaactaaacaaactaacttaaacgtacggttagggtacggttcgggaccgggtaccggaacctaacgtccggtacccgttaccgtaccgtcgacccgacccggtaacggtcccttaccccggccccccgttacggtaccccttaccgttcccgtcccgttacccccctaccccg

SEQ ID NO: 252085 - DNA, 728 bp, Homo sapiens
  misc_feature: GYAE6OF01C640C.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactacggaaccacaatgacgttggtacttataattctgtctcctgtaccaacaactacccggacaaacgtacccaaactcatgattcgtttgaggtcagtgacgtccggcccgcgtacggggttttctcgactccgtccttccgtcccggtccttacccgtaacggttccgtacgggtccgaacggcccgacccggtaccccgttccccgtcgaaccctacgttccgttccgtcggggtcccttacccggacgggtcccgtagggaacggggtaccggaaggtacgttagtaatttacgtttacgtcggactacgccttacgaacttaacaaactaaacaaattaaaccgtacggtttacgggtacggttaccgggaccgggaccgggaacctaaacggtaccgtaccgtacccgtaccgtccgaaccggtaccccgaacgggtcccttacccggccccccgttacggttaccctacccgttcccttcccgttacccccctaccccccg

SEQ ID NO: 252086 - DNA, 549 bp, Homo sapiens
  misc_feature: GYAE6OF01EHCT1.49.35.D02.1.454.CMB.1.raw
  modified_base (376)..(376): a, c, t, g, unknown or other
  misc_feature (376)..(376): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctcccngaccatctctgggctccgaggctgaggacgaggctgattatactgcagctcatataacaaacaataaacacgtttagggtcgttcgggacggacgggaaccaaacgtgaacccgtccgtacgtccagacccgaggcctcgccccctcggtaccactcctcgttcccctacccc

SEQ ID NO: 252087 - DNA, 820 bp, Homo sapiens
  misc_feature: GYAE6OF01DQIUS.49.35.D02.1.454.CMB.1.raw
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctcgccctgactcagcctgcctccgtgtctgggtctcctggacagtcgatcacctatctcctgcactcggaaaccaccaatggtacgttaggtacttaataattctgtctctggtaaccaacaactacccgacaaacgtacccaaactcatgtacttgtttgaggtcaggtgtacgtccggtcccggtacgtacgggtttctacgtacgttcgtccgttccgtccggtacctaccgtaacgttccgtacggtaccgtacggacccgtaccggtccccttacccgtaccgtaaccctacgttccgtaccggtcggggtcccgtaccggtaacgggtcggtacgggaacgggtacggtacggtacgttaacggttaagtttacgttaccgttacgaccgtaacgttccttaactaacgttaaactaaaaccgtaaacttaaacttaaaccggttacggggtttaacgggttccggggtttaaccgggacccggggtaaccggtaaacccggttaaaaaccggttccgggtaaacccggttacccgtaaccggtaccggtaacccggtacccggtaaaccggtcccggttaaccccggttccccccggttaaccgggtcccttaacccggttccccgtttccccgtttaaccccccgtaccccccg

SEQ ID NO: 252088 - DNA, 560 bp, Homo sapiens
  misc_feature: GYAE6OF01BC80S.49.35.D02.1.454.CMB.1.raw
  modified_base (432)..(432): a, c, t, g, unknown or other
  misc_feature (432)..(432): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtcccaaactcatgatctttgaggtcagtgatcggcccgcgaggggtttctcatcgcttctccggctccaagtctgcagcacggccctccctcgaccactctcgtcgggctccgaggcgtggaggacgaggctgattattacgtgcngctacataactaacaaactaataaactacgtttgggttgttcgggcgggacggaaccaaacgtcgaccgtcctacgtcagacccgacggcctccggcccctcggtacacctcttccgtccccgtcccc

SEQ ID NO: 252089 - DNA, 660 bp, Homo sapiens
  misc_feature: GYAE6OF01C5ZKQ.49.35.D02.1.454.CMB.1.raw
  modified_base (405)..(405): a, c, t, g, unknown or other
  misc_feature (405)..(405): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaagcctgggtcgtcggtgaaggtctcctgcaaggcttcgtggacgacaccttcaactactttgctgtcagcgtgggtgcgacgacggcccctggacaaggtccttggaggtggggtgggaaggtctccaccctataccttaatatacgacaaactatagactacagactacttccacgacagacgtacacccttanccgacgaacaactaccaacgaacacacgaccttaacacgtacggaaacctcggacgaccgtacgtaccgtaagggacttccgtacggtaccccggaacgtacccgggtacccgttaagtttacctttaccggtcggttcggtacggtacggtaaacggacggttactttacggttttacccgttttaccgttagttacgggttaaactttacgggtttaaccttaacggtttacctaaagttttacgttaaccgg

SEQ ID NO: 252090 - DNA, 553 bp, Homo sapiens
  misc_feature: GYAE6OF01EYGW4.49.35.D02.1.454.CMB.1.raw
  modified_base (343)..(343): a, c, t, g, unknown or other
  misc_feature (343)..(343): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcagggtttctcatcgcttcnccggctccaagtctggcagcacggcctccctgaccatctctgggctccgaggctgacggacgaggctgattattactgcagctacgatataacaaaccaacaactagtttgggtgttcgggcggagggaccaagcgtacgaccgtcgtacggtacacggcccaaggcctaccgtcccccgtcggtacctaccttccgtccgttccccccg

SEQ ID NO: 252091 - DNA, 710 bp, Homo sapiens
  misc_feature: GYAE6OF01CJ014.49.35.D02.1.454.CMB.1.raw
  modified_base (342)..(342): a, c, t, g, unknown or other
  misc_feature (342)..(342): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcaccatctcctgcactacggaaaccacaaatcggtaacgtttggtaacttataattctgttctccgtggtaccaaacaacgtaccccggacaaacgtcccaaactcatgatctttgagtcagtgactcggcccgngtacggggtttctctactcgtccttcgtcccgctccgaagtcgtcggcacgtccgacggtccctcccgtacgacctacgtctcgtcgggcctccgaggtccgtggacggacgaacggtcgtaaggtattaacgttacgtcgaccacgtcctacgtaactaaactaactaaaacgtaaactaaacggttaaccggtttcggggttacgggtttaccgggaccggggtacccgggtaaaaccgtaaaccggtccggtaaccccggttaccgttacccggtacccgaaccggacccgtaacggtccccggttaacccgtccccccggtcggtaccctaccgttcccgttccccggttccccgttacccccg

SEQ ID NO: 252092 - DNA, 622 bp, Homo sapiens
  misc_feature: GYAE6OF01CIM1F.49.35.D02.1.454.CMB.1.raw
  modified_base (332)..(332): a, c, t, g, unknown or other
  misc_feature (332)..(332): n is a, c, g, or t
  modified_base (418)..(418): a, c, t, g, unknown or other
  misc_feature (418)..(418): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctctgtaccaacaactacccggacaaacgtcccaaactcatgatctttgagtcagtgacgtcggccgcgtagggtttcncatcgtcttcgccggctctaagtctggcacgccgaccggcctcccgtacgacctactctcgtcggcctccgaggtcgtggggacgnggtctaggtattatttattgtcttgttcagttagtacggccgttagagttaggtacgggaccgggtaagggttggttacgggacgggagggtaacggtaagggtaccggtacccggtcggtaacggtccgaacggtacccgtaacgggtccctcccggtcccccgttcgggtacctaccgttccgttcccgttccccggtcccc

SEQ ID NO: 252093 - DNA, 731 bp, Homo sapiens
  misc_feature: GYAE6OF01BE76M.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcacgtggaaaccacaatgacgttgtacttataattctgtctctggtaccaacaactacccggacaaacgtaccccaaactcatgatctttgagtcagtgagtccggcccgcgtacgggtttctctacgtccgtcttccgtccggtctacccgaaaggttcctacggacacggccaccggtccctcccgtacgacctaacttcctcgtcgggtacctccgaacggtccgtagggaacgggaacggacgggtcgtagtaatttacgtttacgtcgactacgtccttacgaacttaactaaaccgaaaactaaacgttaaaaccgtacggtttacggggttacggttaccggggtaccgggacccggggtaaacccaaaaccggttccggtaaccccggttacccgtaaccggttaccgaaccggaccccggtaaacgggcccgttacccggtacccccccgttacggttaccccgtaaccgtttcccgttacccggttccccccggttacccccg

SEQ ID NO: 252094 - DNA, 639 bp, Homo sapiens
  misc_feature: GYAE6OF01D3YFM.49.35.D02.1.454.CMB.1.raw
  modified_base (395)..(395): a, c, t, g, unknown or other
  misc_feature (395)..(395): n is a, c, g, or t
tcagagtcgagagacacgaccggtgctcgatttagcacacgatagttgggtttgggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctcctggtaccaacaactaccccggacaaaacgtccccaaactcatgattctttagaggtctagtgactccggcccgcgtacggggtttctcactccgtcttcgtccgctaccaagtctggcacgccaccggccctaccgngacctactctcgtcgggcctccgaggctaggacggacggaggcgtagtacttattactgacagtctactagtatacgcgacggtacgacgtaactaaacttagttttcgtacgttacgttacggttaccgggaccgggtaaacgggaaccgtaacggtcgttaaccggtacccggttaaccgttacggtaccgtaccggaccccggtaaacggtcccggttacccggtcccccggttacccggg

SEQ ID NO: 252095 - DNA, 563 bp, Homo sapiens
  misc_feature: GYAE6OF01CUYIQ.49.35.D02.1.454.CMB.1.raw
  modified_base (336)..(336): a, c, t, g, unknown or other
  misc_feature (336)..(336): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactaccccggacaaacgtcccaaactcatgatctttgaggtcagtgatcggccgcgagggtttcncgatcgcttcgtccggctccaagtctggcacgcacggccctccctcgaccatctcgtcgggctccgaggcgtggacgggacgaggctaggtatttatactgccagctacatataacaaacaataaactacgttgggtcgtcggcggacggaaccaaactcgaccgtcctacgtcgacgacccgaaggcctccgccccgtcggtacctacgtcctcgttcccctaccc

SEQ ID NO: 252096 - DNA, 631 bp, Homo sapiens
  misc_feature: GYAE6OF01ACSUZ.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctgtaccaacaactacccggacaaacgtccccaaactcatgatctttgagtcagtgactcggcccgcgtaggggtttctcactcgcttctccggctccaagtctggcagccacggccctccctgaccatctcgtgggcctccgaggtctggacggacgaggtcgtagtaatttattactgacagtcctacaataactaacaaactaactaaacgtacgtttaggggtcggttaccgggaccgggaccggggtaaccctaaaacgtccggaaacccgttccgtaaccgtacgaaccgacccggaaacgggtcccctacccggtccccccgttacgggtaccctacccgttcccgttcccgttccccttaccccc

SEQ ID NO: 252097 - DNA, 720 bp, Homo sapiens
  misc_feature: GYAE6OF01ASV43.49.35.D02.1.454.CMB.1.raw
  modified_base (229)..(229): a, c, t, g, unknown or other
  misc_feature (229)..(229): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccncaatgacgttggacttatattctagtctctgtaccacgaactacccgacaaccggtcccaaaactccactacgatactttgagttcagtagtagtccggaccgtcgtacggggtttcctcgtagttccgttcttcgttccggcttcctaacgtcctcggcctacgctacggtccctcccgtacgaaccctacgtcccttccgtcgggccttccgacggtccgtacgggaacggtacggacgggtctaggtaacgttaacgttacggtgacttacgtactccgaattaccgtaaactaactaaacttaaacctacgtttacgggtacgttaccgggtaccgggtaccggtaacccgaacgttcggtaacccggttacccgttaacgggttcccggaacccggtaccccggttaaacggtacccgttcccgggtacccccccgttcggggttacccaaccgtttcccgttcccggttacccccgttacccccg

SEQ ID NO: 252098 - DNA, 624 bp, Homo sapiens
  misc_feature: GYAE6OF01BZ1UE.49.35.D02.1.454.CMB.1.raw
  modified_base (473)..(473): a, c, t, g, unknown or other
  misc_feature (473)..(473): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatccaccatcctcctgcacgtcggaaaccaaccaatcggtacgttggtacttataattctgtctcgtgtaaccaacaactacccggacaaacgtcccaaactcatgattcttgagtcagtgagtccggcccgcgtacgggtttctcagtcgtcttccgtccggctaccaagtcgtggccacgccgtaccggccccttccccgtacgaccctacgttcctcgtcgggtcctccgaggccgtaggacgggacgagctagtacttattacncgcacgctactaataacaaacaaactaactaaaccgtacggtttgggttcggttaccgggcgggtaccggaacctaaacgtcgtacccgtacctaccgtcacgaccgtacgccgtccgccccgtcggtaccacttcctccgtccccgtccc

SEQ ID NO: 252099 - DNA, 591 bp, Homo sapiens
  misc_feature: GYAE6OF01EDZE2.49.35.D02.1.454.CMB.1.raw
  modified_base (384)..(384): a, c, t, g, unknown or other
  misc_feature (384)..(384): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaactaccccggcaaacgtacccaaactcatgatctttgaggtctattgactcggcccgcgtaggggtttctcatccgtcttcctccggctccaagtctggcagcacggcctcccngaccatctcgtgggctccgaggctggacggacgaggctggtatttattacgtgcagtctactaataataacaaacgtaataaactacgttagggttcgttcgggcggtaccgggaacctaaacgtcgtacccgtaccgtacgtaccgacgacccgaaggccctcccgcccccgttcggacctaccgtcttcccgtcccctacccccg

SEQ ID NO: 252100 - DNA, 720 bp, Homo sapiens
  misc_feature: GYAE6OF01E0QB2.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactaccccggacaaacgtccccaaactcatgatctttgagtcagtgagtccggcccgcgtaggggtttctcgatccgcttccgtccggtcctaccgtaacgtccgtcggtccacggcccgaccggtccccttcccgtacgaccctattccgtcgtcgggcctcccgaggtccgtaggaacgggacggtacggtctaggtactttagttaccgtgaccgtagtcctacgtaactaactaaacaaacctaacttaaaccgtacgtttaggggttaccggttaccggggccgggacccgggtaaacccgtaaacgttcccggtaaaccccggttacccgttaaacccggtcccgaaccgggaccccgtaaacgggtcccgttaccccggtcccccccgttacgggttacccctaacccgtttccgtttccccgttcccccccttaacccccg

SEQ ID NO: 252101 - DNA, 626 bp, Homo sapiens
  misc_feature: GYAE6OF01BIOEH.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactacccggcaaacgtccccaaactcatgatctttgagtcagtgatcggcccgcgtaggggtttctcactcgtcttcgtccggctccaagtctggcagcacggccctccctgaccatcctcgtgggcctccgaggctggaggacgaggcttagtatttacttacgtgcacgctcataactaacaaactaataaacctacggtttagggttacggttccggggaccgggaccgggtaaacccaaaccggtacgtaccccggtaccgttaccggtccaaccggaccccgtaacgggcccttcccggccccccgttcggtaccctaccgtcccttcccggttcccccttaccccccg

SEQ ID NO: 252102 - DNA, 699 bp, Homo sapiens
  misc_feature: GYAE6OF01CDCSQ.49.35.D02.1.454.CMB.1.raw
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccacaatgacgttggtacttataattctgtctctggtaccaacaactacccggacaaacgtcccaaactcatgatctttgaggtcagtgatcggcccgngtacgggtttcncatcgtctcgtccggtctcaagtctggcagcacggtcctcctcgacctactcgtacgtcgggtcctacgaggtctaggaacggacggaggtcctagtaatttacgttacgtcgctagtcctactaattaaacctaaactaaaaccgtaacttaaaccgtaacggtttacggggttacggtttaccggggacccggggtaaccggggtaaacccctaaaacggttcccggtaaacccccggttaccgttaacccggtacccgtaaccggaccccgtaaacggggtcccgttaccccgggtaccccccccgttcggtacccctacccgtttcccgttccccggtttaccccccgttaacccccccg

SEQ ID NO: 252103 - DNA, 534 bp, Homo sapiens
  misc_feature: GYAE6OF01CN4B4.49.35.D02.1.454.CMB.1.raw
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggacaaacgtccccaaactcatgatctttgaggtcagtgatcggccgcaggggtttctcatcgcttctccggctccaagtctggcagcacggcctcctgaccatctctgggctccgaggctgaggacgagctgattatacngcagctnatanaacaaanataaacnttgggtgttcggacggcggaaccaactcgacctctacgctagcccaaggcctcgaccccttcggtaccacttcctcgttccccgtcccc

SEQ ID NO: 252104 - DNA, 762 bp, Homo sapiens
  misc_feature: GYAE6OF01E0F1M.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactacggaaccaccaatgacgttgtacttataattctgtctctgtaccaacaactacccggacaaacgtacccaaactcatgattcttggagtcagtgacgtccggcccgtcgtagggtttctcgtactccgtccttccgtccggtcctaccgtaagtcgtcggactacggccgacccggtcccttcccgtacgaaccctacttcccgtcggtcggggtcctacccggacggtccgtacgggaacggggacggtacggtcgttagttaacttttaacgttacgtcggaccgtacgtccttaacgtaacttaacgtaaaacctaaaacctaaacttaaaaccggttacgggttttagggggttaccggttaccggggaccggggtaacccgggtaaacccgtaaaccgggttacccgttaaccccggtaacccgttaccggtaacccgaaccggtaaccccgtaacgggtccccgttccccggtaccccccgttacgggtacccctaccggtttaccccgttcccgttaccccccgtaccccc

SEQ ID NO: 252105 - DNA, 783 bp, Homo sapiens
  misc_feature: GYAE6OF01B06B6.49.35.D02.1.454.CMB.1.raw
tcagagtcgagagacacgaccggtgctcgatttagcacacgatagttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcgaaccacaatgacgttggtacttatattctgtctcctggtaccaacaactaccccggacaaacgtaccccaaactcatgatcgtttgaggtcagtgacgtccggcccgcgtaggggtttcctctacgttcgtccttccgtccgggtcctaccgtaacggttccgtacgggcctacggcccgtaaccgggtccccctacccgtacgtacccgtacttccgttccggtcggggtccctcccggtacggtccgttagggaaccggggtacggaacgggtccgttaaggtaacttttaacgttaaccgttcgaccgtaggtccctactaacgttaaactaaaccaaaaacctaaacttaaaaccggttacggttttaaggggttaccgggtttccggggaacccggggtaccgggaaaccctaaaccggttaccggtaaaccccgttaccggtaacccgtccggaacccggtaccccgtaaacgggtccccgttacccggtccccccccggttacggtaccctaacccgtttcccgttaccccggttcccccggttccccccc

SEQ ID NO: 252106 - DNA, 796 bp, Homo sapiens
  misc_feature: GYAE6OF01EQJ1Z.49.35.D02.1.454.CMB.1.raw
tcagagtcgagagacacgaccggtgctcgatttagcacacgataggttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccacaatgacgttgtacttataattctgtctctggtaccaacaactacccggacaaacgtacccaaactcatgtattctttggaggtcaggtgtacgtccggcccgcgtaggggttttctacagtcgtcgttctccggctccgtaagtcgtcggcacgcgaccggtcccttcccgtacggaccctacgttccgtaccgttacgggggtcccttacccggaacgggtccgtacgggtaacgggggtaacccggtaaacggggtcgttaggttaacttttaacgtttaaacccgttcggtacctaacggtccttacgtaactttaaacgtaaaccctaaaaactaaacgttaaaaccgttaacgggttttacgggggttaccggttttaaccgggggaccggggtaacccggggtaaacccgtaaaaaccggttccgggaaaccccgtttaacccgttaacccgggtacccggtaaccgaccccgggtaaacgggtacccgttccccggtaccccccgttacggggttacccaaccggtttccccgtttacccgttccccccgttaacccccc

SEQ ID NO: 252107 - DNA, 708 bp, Homo sapiens
  misc_feature: GYAE6OF01DPTK7.49.35.D02.1.454.CMB.1.raw
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgccttccgtgtctgggtctcctggacagtcgatcaccatctcctgcactacggaaccacaatgacgttgtactatattcngtctctggtaccaanaactacccggacaaacgtacccaaactcatgtactctttgaggtcagtcgacgttcggcccgtactaggggtttcctctacttcgcgtttcgccggctaccgtaagttcgtcggacagaccgtaaccggcccttcccgtacgacctaacgttctaccgtcgggtacctaccgaggtccgttaggaagggaccggtaggacgttacggtaaactttaacgtttaccgaggtacctaaggtaccttacggtaaattaacttaaaaccaaaaacgtaaaacttaaaaccgtaccgggttttagggttaccggtttcggggaaccgggtacccgggtaaaacctaaacgtccggtaaccggtaaccgttaccgtacgacaccccggtaaagcccgtacccgccccgttacgtaccaccgtttcctccgttccccgttacccccg

SEQ ID NO: 252108 - DNA, 703 bp, Homo sapiens
  misc_feature: GYAE6OF01BBEX3.49.35.D02.1.454.CMB.1.raw
  modified_base (372)..(372): a, c, t, g, unknown or other
  misc_feature (372)..(372): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctcctggtaccaacaataccccggcaaacgtcccaaactcatgatctttgagtcagtgatcggccgcagggtttctcatcgcttcgtccggctccaagtctggcagcacggcctcccncgaccatctcgtcgggcctccgacggctaggtacgggacggacggtcttacgtaattttagtttaagtttaggtccgtttacggtttactaacgtttatccgggtaccgggttaggtaacgttacggggttcggggtacccgggtaaagggggtttcggttacgggggtaccggggaaggggtaaccggtaaacgggtaccgggtacccgggttacccggttaacgggttaccgaaccggtccccgtaaacggggtccccgttcccgggttacccccccgttaccgggttacccgtaaccccggttccgtttacccggtttaccccccccg

SEQ ID NO: 252109 - DNA, 644 bp, Homo sapiens
  misc_feature: GYAE6OF01CU6FX.49.35.D02.1.454.CMB.1.raw
  modified_base (250)..(250): a, c, t, g, unknown or other
  misc_feature (250)..(250): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccacaatgacgttgacttatattcngtctctgtacaacaactacccgacaacgtcccaaatcatgatcttgagtcagtnatcggcctgaggtttcncatcgtctctaccggctaccgaagtctgcacgccacggccctccncgacntcctcgtcggcctcgaggcgtaggaacgggaccgagccttaggtaatttacttaaccgttggaccacgtccgtactaattaactaaaccaaaactaacgtaaaacgttacggtttgggtacgtaccgggtaccgggaccggtaaaccgtaaacgtccgggtaaaccccgtacgttaacccggtcgaaacccggccgaaaccggtcccgtaccccggttccccccgtacgggttcccctaaccgtttccgttaacccgtcccccttaccccccg

SEQ ID NO: 252110 - DNA, 610 bp, Homo sapiens
  misc_feature: GYAE6OF01DA51K.49.35.D02.1.454.CMB.1.raw
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
  modified_base (393)..(393): a, c, t, g, unknown or other
  misc_feature (393)..(393): n is a, c, g, or t
  modified_base (432)..(432): a, c, t, g, unknown or other
  misc_feature (432)..(432): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttataattctgtctcctggtaccaacaactaccccggacaaacgtcccaaactcatgatctttgagtcagtgatcggcccgntagggtttcncatcgcttctcggctccaagtcngcagcacgcctccngaccatctcgtcgggctccgnggctggaaggacgaggctagtattacttactgcagctanaatactaaacaaacaacttaaacgtacgttagggtacgtttacgggaccggaccggggaacctaacgtacgtaccccgttaccgtaaccggtcgaaccgacccgtaacggtacccgtccccgtaccccccggtaccggttacaacccgtttcccgttccggttccccccgttcccccg

SEQ ID NO: 252111 - DNA, 769 bp, Homo sapiens
  misc_feature: GYAE6OF01DMTWR.49.35.D02.1.454.CMB.1.raw
  modified_base (210)..(210): a, c, t, g, unknown or other
  misc_feature (210)..(210): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatcacatcncctgcactacgaaccacaagtgacgttgtaacttatattctgtctctgtaaccaacaactacccgacaacgtacccaactcatgtattcgttagagtcagtgacgtccggcccgtcggtacgggtttcctacgtacgtccgtcccgtttccgttcccggtaccttacccgtaaacggttccgtacggaccgaacgcccggtacccggtccccttacccgtaccgtaaccctacgtcccgtttcggtccggggtccctcccgggtacggtaccgtacgggaacggggacggtacgggttacgttaacgttaacgtttaacgttacgtacgtcgtaacgtccttaacaacttaaactaaaactaaaccgttaaacttaaacgttacggtttacggggttacggttaccggggtaccgggaacccggtaaaccgtaacccgtaccggtaacccgttacccgttaaccggccgtaaacccggacccgtaccggtccccgtacccggtacccccgtaccggttcccgtaaccctttcccgttccccgttcccccgttacccccg

SEQ ID NO: 252112 - DNA, 558 bp, Homo sapiens
  misc_feature: GYAE6OF01BUZXC.49.35.D02.1.454.CMB.1.raw
  modified_base (433)..(433): a, c, t, g, unknown or other
  misc_feature (433)..(433): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaaccaccaatgacgtttggtacttataattctgtctcctggtaccaacaataccccggcaaacgtccccaaactcatgatctttgagtcagtgatcggcccgcaggggtttctcactcgcttctccggtctccaagtctggcagcacggccctccctgaccatctctggggctccaggctgaggacgaggctgtattattactgcagctnattactaacgaaacataaacctacgttagggtcgttcggcgggtacggaacctaacgtcgaccgtcctacgtacagacccgtacggcctccgcccccgtcggcccatccctgttccccgtacccc

SEQ ID NO: 252113 - DNA, 657 bp, Homo sapiens
  misc_feature: GYAE6OF01BNLHE.49.35.D02.1.454.CMB.1.raw
  modified_base (280)..(280): a, c, t, g, unknown or other
  misc_feature (280)..(280): n is a, c, g, or t
  modified_base (327)..(327): a, c, t, g, unknown or other
  misc_feature (327)..(327): n is a, c, g, or t
tcagagtcgagagacacgaccggtgctcgatttagcacacgataggttggggtttggggggggtctcaggaggcagcgctctcgggacgtctccaccatggcctgggctctgctattcctcaccctcctcactcagggcacaggtcctgggcccagtctgccctgactcagcctgcctcgtgtctgggtctcctggacagtcgatcaccatctcctgcactggaaccaccaatcgacgttgtacttataacttctgtctctggtaccaacactacccggnaaacgtcccaaacgtcatgatctttgagtcagtacgatccggcccgngtacggggtttctcgacgtcgtccttccgtccggtcctccaacgtcgtcgcagccacggccctccctcgaccacttccgtcgtcgggcctccgacggcgtcggaggaccgaggtctagtaatttatcgttgccgtagcctataattaacaactaaactaacttaaacgtacgtttacgggttcggtttaccgggcggggacccggtaaacccgtaaacggtaccgtacccggttaaccctacggtaccgtaaccggaccccggtaaaggcccgttcccggtaccccccggtcggtaccctaaccgttccttacccgtcccccgttacccc

SEQ ID NO: 252114 - DNA, 660 bp, Homo sapiens
  misc_feature: GYAE6OF01BG1X3.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctctgtacaacaactacccgacaaacgtcccaaatcatgactctttagacgtcagtgacgtccggcccgtcgtacgggtttctcgtacgttccgtccttccgtcccggtcctaccgtaacggttcgtacgggcaacggccgtaccggtcccctaccgtaccggaaccctacgttcctcggtcgggtcctccgacggtcgtaggacgggtacgacggtctagtattacgtactgcgtagtctactaataactaaacctaaacaacttaaaccgtcgggtttacgggtacggttaccgggaccgggtaaccggaacctaaacggtaccggtacccgtaccgtacgtaccgacgtacccggacgccgtcccgtccccgtggtaccctactccgttcccgtccccgtcccc

SEQ ID NO: 252115 - DNA, 609 bp, Homo sapiens
  misc_feature: GYAE6OF01CF03E.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaataccccggacaaacgtccccaaactcatgatctttgagtcagtgatcggcccgcgtaggggtttctcatcgcttctccggctccaagtctggcagcacggcctccctgacctatctcgtcgggctccgaggctaggacgggacgacggctagtatttattacgtgcagctacgtaataactaacaaactaataaaaccacgtttgggtacgttcgggaccgggtaccgggaacccgtaaacgtcggtaacccgtccgtaaccggtccaaccggacccgtaacgggccctccggtccccccgtcggtacccacttcccgtcccgttccccctacccccg

SEQ ID NO: 252116 - DNA, 894 bp, Homo sapiens
  misc_feature: GYAE6OF01CF9FY.49.35.D02.1.454.CMB.1.raw
  modified_base (253)..(253): a, c, t, g, unknown or other
  misc_feature (253)..(253): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatcaccatcctcctagcactggaaccactaatgtacgttgtacttatattcngtctctgtacaacactacccgacaacgtcccaaactcatgtactcgtttgacgtcagtgacgtccggccgtcgtacgggtttcacgtactcggtccttccgtccggtactaccgtaacgttcgtcggaccacggacccgtaccggtcccttaccccgtacggtaaccctacgtttccgtccgggttacgggtcccgttacccggaacggggtcccgttaacgggaaccgggggtaacggtaccggggttaccgttaacggttaaacgttttaaccgtttaaccggttacggtaacccgttacggttaacccttaacccgtaaagtttaaaacccttaaaaccggtaaaaccttaaaaccgtttaaaaccggttaccggggttttacgggggtttaaccgggtttacccgggggtaaccggggttaaccccgggtaaaacccgttaaaaccggggtttacccggtaaacccccgggtttaacccgttaaccccggggtttaacccgaaccccgggttaacccccggtaaaccggggttcccccgtttaccccccgggttaccccccggtttaacccgggttaacccgttaccccggttttacccccgggtttccccgggtttacccccccggtttccccccg

SEQ ID NO: 252117 - DNA, 648 bp, Homo sapiens
  misc_feature: GYAE6OF01BPZVT.49.35.D02.1.454.CMB.1.raw
  modified_base (216)..(216): a, c, t, g, unknown or other
  misc_feature (216)..(216): n is a, c, g, or t
  modified_base (455)..(455): a, c, t, g, unknown or other
  misc_feature (455)..(455): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctccngcactcggaaccacaatgacgttggtacttatattctgtctcctggtaccaacaataccccggcaaacgtccccaaactacatgacttctttgacggtcagtgactcggacccgcgtaggggtttctcatcgtcttcgtccggctccaagtcgtggcagcaccggccttccctagacctatctcgtacgggcctacgaggtctaggaggacggacgggtctaggtaatttacgttacgngtaccacggcctataactaacgtaaacaaactaaacttaacgtacgggtttacgggttacggttccggggaccggtaaccggaaaccgtaaccgtaccgaccccgttacctaccggtaccaccggacccgtacggtcccgtccccggtaccccgtacggtacctaccttcccgttccccgtccccttaccccg

SEQ ID NO: 252118 - DNA, 846 bp, Homo sapiens
  misc_feature: GYAE6OF01AK11C.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccaccaatgacgttggtacttataattctgtctcctcggtaccaacaactacccggcaaacgtccccaaactcatgatctttgagtcagtgatccggcccgtcgtaggggtttctcgtactccgtcttccgtcccgggtcctaccgtaaacgttccgtacgggccaacggcctaacccgggtccccttcccccgtacgtaacccctacgttcccgttccggttcggggtcccttcccggtaacgggtccgttacgggaacggggtaaccggtacgggtaccgttacggtttaaacgttttacgtttaccgttacggaccgtaaccgttccgttaaccgtaacttaaacgttaaaccctaaaaacgtaaaccgtttaaaaccgttaaccgggttttacggggtttaccgggtttaacccgggggacccggggtaacccggggtaaaccccgtaaaaccggttaccggtaacccccgggtttacccgttaacccggtttcccggaaccggttaacccccggtaaccggggtaccccggttaccccggtaccccccccggtttacgggttaccccgttacccgttaccccggtttccccgtttacccccccggttcccccccg

SEQ ID NO: 252119 - DNA, 581 bp, Homo sapiens
  misc_feature: GYAE6OF01DAX9Y.49.35.D02.1.454.CMB.1.raw
  modified_base (390)..(390): a, c, t, g, unknown or other
  misc_feature (390)..(390): n is a, c, g, or t
tcagagtcgagagacacgaccggtgctcgatttagcacacgatagttgggtttgggggcatcacataacaaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtggaggatcaccctataccttaatatagcaaactatagctaacagacattaccacgacagagtcaccctttancgacgacaaatccaacgaacacagacctacatggaactgcgacagcccttaagggactcgtacgcccgaacgtccgggacccgttattacgttttcgtaggttcgaccggaagacggaagtagtttaggtttaccttttcgtaaattcggtaactttaacgttaccttaggtaaccttagtttaattcggg

SEQ ID NO: 252120 - DNA, 558 bp, Homo sapiens
  misc_feature: GYAE6OF01AUWMK.49.35.D02.1.454.CMB.1.raw
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgtttggtacttataattctgtctcctggtaccaacaataccccggcaaagtccccaaactcatgatctttgaggtcagtgatcggcccgcgaggggtttctcatcgcttctccggctcaagtctgcagcacggcctccctgaccatctctgggcctccgaggctgaggacgaggctgtattattactgcagctnatataacaaanaactaaacacgttgggtcgttcggcgggcggaaccaacgtcgtacccgtctaccgtcacgacccgaacgccgtaccgcccccgtacggtaccaccttccgttccgttccccgtcccc

SEQ ID NO: 252121 - DNA, 687 bp, Homo sapiens
  misc_feature: GYAE6OF01DXVXT.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatctctgcactacgaaccacagtgacgtttgtactatatctgtctctgacaacaactacccgacaacgtacccaaatcatgtatcgttagagtcagtgacgtcggccgtaggttacgggttctacgtacgtcgtccttccgtccggtcctaccgaacgttcgcggaccgacgcccgtaccggtcccttacccgtacgacctcgttcgtaccggtcggcctacgacggtcgacgggaggacggacgtcgtagttaactttacgttacgtcgtacgtacgtcctaactaataacctaaaacgtaacctaaacgttaaaccgtacggggtttacgggttaccgggttacggacccgggtaccggaaaaccttaacgggtaccgtaacccggttaccgttaacccggtacgacgacccgtacggtcccgtccccgtaccccgtcggtcctaaccgtttccgttccccgtcccttacccccg

SEQ ID NO: 252122 - DNA, 774 bp, Homo sapiens
  misc_feature: GYAE6OF01A0AXC.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaaccaacaactacccggacaaacgtccccaaactcatgactctttgaggtcagtgatccggcccgcgtacggggtttctcgtacgtccgtcttccgtccgggtcctccgtaaacgttcgtcggccgaacgccgaaccggtcccctccctacggtaccctaacgttccgttccgttcggggccttacccgacgggtccgttacgggaacgggtaaccggacgggtccttaggtaacgttttaacgttacgtcggaccgtacggtcctactaacgttaaactaaacctaaaactaaacttaaaaccgttacggtttacgggggttacggtttacccggggaccggggtaacccgggtaaaacccttaaaacccgggtccgggttaaaccccgttaccccgttaaaccggtacccgtaaccgggacccccggtaaacgggtccccttccccgggtacccccccgttcggtacccctacccgttcccgttcccggtttccccccttaccccccg

SEQ ID NO: 252123 - DNA, 792 bp, Homo sapiens
  misc_feature: GYAE6OF01EEN4K.49.35.D02.1.454.CMB.1.raw
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctctgtaccaacaactacccgacaaacgtacccaaactcatgattctttgaggtcagtgtacgtcggcccgcgtaggggtttctacgacttcgtccgtttccgtccggtcctaccgtaaacgttcgttcgggacacggtccgaacccggtccccgttaccccgttacggaacccctaactttcccttaccgggtacgggggtccctttacccgggaccgggtacgtacggggaaacggggtaaccgggtaacgggtaccgttaagggtaaacttttaagttaaccgtttcgaccggtacgtaccttactaattaacctaaacaaaaccgtaaacttaaaaccgtacggtttacggggttacggtttaaccggggaccgggtaacccggggaaaccctaaaccggtacccggtaaccccggttaacccgttaaccggtacccgtaaccggtaacccccgaagggtccccttacccgggtacccccccgttcggtaccccttaacccgtttcccgttacccgtttccccccgttaacccccc

SEQ ID NO: 252124 - DNA, 746 bp, Homo sapiens
  misc_feature: GYAE6OF01DZUL1.49.35.D02.1.454.CMB.1.raw
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (252)..(252): a, c, t, g, unknown or other
  misc_feature (252)..(252): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccntctcngcactggaaccacatgacgttgtacttatattctntctctggaccaacaactacccggactaaacgtcccaaactcatgtatcgtttgaggtcagtgacgtccggcccgcgtaggggtttctacgacgttcgtccttccgtcccggtcgtaccgtaaggtccgtacggccgtacggccgtaaccggtcccttacccgtacgaaccctacttccgtccgttcggggtacctcccggtagggtccgtagggaacggggtaacggtacgggtcttaggttaactttaacgttacgtacgaccgtaacgtccttaactaacgttaactaaccaaaacgttaaacgttaaaccgttccgggtttaacggggtttcggtaccggggtaccggggtaaccgggaaacccgttaaaaccggtccggtaacccgttaacccgtaccggtaccgaccggtaacccggtacgggcccttaccccggtcccccggtacgttccccgtaaccgttcccgttacccgttacccccgtaccccg

SEQ ID NO: 252125 - DNA, 548 bp, Homo sapiens
  misc_feature: GYAE6OF01EGACH.49.35.D02.1.454.CMB.1.raw
  modified_base (326)..(326): a, c, t, g, unknown or other
  misc_feature (326)..(326): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgnaggggtttctcgatcgcttctccggctccaagtctggcagcacggcctccctgaccatctctgggctcccaggctggagacgaggctgattattactgcngctcatanaacaaacaataaacgacgttgggtcgttcggcggacgggaccaacgtgacccgtcctacgtcgagccccgaaggcctcgcccccgtcggtaccacttcgtccgtccctaccccc

SEQ ID NO: 252126 - DNA, 567 bp, Homo sapiens
  misc_feature: GYAE6OF01DWYRV.49.35.D02.1.454.CMB.1.raw
  modified_base (333)..(333): a, c, t, g, unknown or other
  misc_feature (333)..(333): n is a, c, g, or t
  modified_base (428)..(428): a, c, t, g, unknown or other
  misc_feature (428)..(428): n is a, c, g, or t
  modified_base (443)..(443): a, c, t, g, unknown or other
  misc_feature (443)..(443): n is a, c, g, or t
  modified_base (542)..(542): a, c, t, g, unknown or other
  misc_feature (542)..(542): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctcctggtaccaacaactaccccggacaaacgtaccccaaactaccatgacttctttggaggttcagtgagtccggcccgngtaggggtttctcatcgcttctccggtctccgaagtctggcagccgacggccctcctcgacctatctcgtcgggcctccgaggctggaggacggngtcagtattatacgncagctacataacaacaaactaactaaacgtacgtttagggtcgttccggacggaccggaaccaacgtcgacccgtctacggtcacgacccgagccctcnccccgtgccacttctctccctcccc

SEQ ID NO: 252127 - DNA, 543 bp, Homo sapiens
  misc_feature: GYAE6OF01CKWG7.49.35.D02.1.454.CMB.1.raw
  modified_base (227)..(227): a, c, t, g, unknown or other
  misc_feature (227)..(227): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccncaatgacgttgtacttatattctgtctcctgtacaacaatacccggcaaacgtcccaaactcatgatctttgagtcagtgatcggcccgcaggggtttctctatcgtcttcctaccggctccaagtctacggcacgcacggcctccctcgaccatctcgtcgggcctcgagctgaggacgaggctgaattatactggcacgctacataactaacaaacataaacgacttgggtacttcgggcggtacgggaaccaagtcgaccgttctacgtcacgccgaagcctcgcccctcggtaccactctcgtcccgtcccc

SEQ ID NO: 252128 - DNA, 557 bp, Homo sapiens
  misc_feature: GYAE6OF01D5X2K.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtcccaaactcatgatctttgaggtcagtgatcggcccgcaggggtttctcatcgcttctccggctcaagtctggcagcacggcctccctgaccatctctgggctccagctgaggacgaggctgattattactgcagctctaatataacaaacataaacacgttgggtgttcggcggaccggggacaaaacgtgacccgttccgtaccgtctaagccccgaaggccgtaccgccccccgttcggtaccaccttcgtccgttcccccggtccccc

SEQ ID NO: 252129 - DNA, 684 bp, Homo sapiens
  misc_feature: GYAE6OF01BPKG1.49.35.D02.1.454.CMB.1.raw
  modified_base (279)..(279): a, c, t, g, unknown or other
  misc_feature (279)..(279): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatcaccatcctcctgcactacggaaccacaatgacgttgtacttatattctgtctcgtagtaccaacactacccgganaaaccgtcccaaactcatctactctttgagtcagtgacgtccggccgtacgtagggttctcgtactcgtcgttccgtccggtcctacgtaacgttcgcggacacggtccaccggtccctcccgtacgtaccctacttccgtacgtcgggacccttccggaacgtcggttacggaacggtacgggtacggtaccgttagttaacgtttacgtttaacgcgttaccgacgtaccgtactaactaaccttaaaccaacgtaacgttaaacgtccggtttaggggttaaccgggttccggaacgggtaccggtaaccgacgtaccgtaccggttaccttccggtacaccggaccgtacgccgttacccgaccccgttcgtacccttacgtcccgtcttcccccgtaccc

SEQ ID NO: 252130 - DNA, 797 bp, Homo sapiens
  misc_feature: GYAE6OF01D4KDE.49.35.D02.1.454.CMB.1.raw
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacgagggtcctgggcccagtctgccctgactcagcctgcctcgtgtcgtgggtctctggacagtcatcacatcnctncactcgaaccacaatgacgttgtacttatatctgtctctagtaccaacacgtacccgactaacgtacccaatacatcgtattcgttgacggtcagtggacgtccggccgtaggttacgggtttctcagttccgtccttccgtaccgtacgtaccgtaacggtcggtcgggacctacggtacccggacccggtcccctttcccgaccgtaacctacggttcccttacgggtcccggggtactacccgggacggtacggtacggggaaccggtaagggaccgggttacgttacggtttaacttttaaccgtttacccggtaggacccgtagttacccttactaaacgttaaacaaaccttaaaactaaacgttaaaccggtttacggggtttccggggttaacggggttcccggggtaacccggggtaaccggtaaacccgtaaaccggttcccggtaaacccgggttaaccccttaaccgggtaccgtaacccgggtaaccccgaacgggttccccggtaacccccggtccccggttacggtacccttacccggtttccccgttcccgtttcccccggtcccc

SEQ ID NO: 252131 - DNA, 618 bp, Homo sapiens
  misc_feature: GYAE6OF01AKJFJ.49.35.D02.1.454.CMB.1.raw
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccaccaatgacgttggtacttataattctgtctcctggtaccaacaactacccggacaaacgtccccaaactcatgactctttgacgtcagtgatcggccgcgtagggtttctcagtcgtcttctccggctccaagtctggctacgcacggcctccctacgacctagtcctcgtcgggtctccgaggtctaggacggacgaggtctagtaacttacttacgtgacgacgctacaataactaaactaaacaattaaaccgtacgttagggttcgttacgggtaccggacgggtaacccaaacgtcgtaacccgttccgtacgtcgtaccgaccgtacggccctaccgtcccccgtacggtacctaaccgtccgtccggttccccgtaccccg

SEQ ID NO: 252132 - DNA, 645 bp, Homo sapiens
  misc_feature: GYAE6OF01BI91R.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttcgtggagacaccttcaaacaactttgctgtcagctgggtgcgacacggcccctggacaaggtccttggaggtggggtagggaagggtactaccgtaacccccttagttaccctttaaaatacgttaacggaactaaaaccttattaggaccaacaacgtaactacttaccacgaacgaagacgtacctaacccttatcccggacgaaccaaactcccaacgaacaacgacgtacctaacacgtacggaacctcgccgacaagccctaaggattccgtcgacccgaacgaacccgggtccgttaatttactttcgtacgtcggacggtaaggagtaagtacttgtttacgtttcttagttacgagtttaacgtactttaagtcttaagttcgttaccgg

SEQ ID NO: 252133 - DNA, 608 bp, Homo sapiens
  misc_feature: GYAE6OF01EIZ9M.49.35.D02.1.454.CMB.1.raw
  modified_base (325)..(325): a, c, t, g, unknown or other
  misc_feature (325)..(325): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtcccaaactcatgatctttgacggtcagtgatcggcccgnaggggtttctctatcgctttccgtccggtctcccaaagtcctggctagcacggcctcccgtgacctatcgtctgggtctcctaggctagaggacgaggctagattattactgcagctcaatataacaaactaataaactacgtttgggtacgttcggcggtaccgggaacctaaacgtacggtacccgtaccgtaaccggtaccgtaacggacccgaaacggtaccctaccggacccccccgttcgggttaccctaccgttccgtccgttccccgtaaccccc

SEQ ID NO: 252134 - DNA, 538 bp, Homo sapiens
  misc_feature: GYAE6OF01BEY59.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctcctggtaccaacaataccccggcaaagtccccaaactcatgatctttgaggtcagtgatcggcccgcaggggtttctcatcgcttctccggctccaagtctggcagcacggccctccctgaccatctctgggctccgaggctgagggacgaggctgattattactgcagctcaatataacaaacaataaacgacttagggtgttcggcggacggaaccaacgtcgaccgtcctacgtcacgcccaaggcctcgcccctcggcactcctcgttcccgtccccg

SEQ ID NO: 252135 - DNA, 729 bp, Homo sapiens
  misc_feature: GYAE6OF01DVBAC.49.35.D02.1.454.CMB.1.raw
tcagagtcgagagacacgaccggtgctcgatttagcacacgatagttgggtttggggggggtctcaggaggcagcgctctcgggacgtctccaccatggtctgggctctgctattcctcacccctcctcactcagggcacagggtcctgggcccagtctgccctgactcagcctgcctccgtgtctgggtctcctggacagtcgatcaccatctcctgcactggaaccaccaatgacgttggtacttatattctgtctctgtaccaacaactacccggacaaacgtacccaaactcatgtatctttagaggtcagtgacgtccggccgcgtagggtttctcgactcgtcttccgtccggccttaccaacgtctcggcacgccgaccggtccctcccgtcgaccctacttccgtccggtcggggtacccttcccggaacgggtccgttagggaaccggggtaaccgggacgggtaccgttaggtaaacttttacttacgttcggactacggtccttactaataactaaactaaaacctaattaaaaccggttaacgtttggggttacgggttaccggggaccggggaccgggtaaaccctaaaccggtcggtaaccccgttacccgtaccgtaccgaccggaaccccgtaaacgggtccccgttacccggtacccccccgttacgggtaccctacccgtttcccgttcccggtttcccccctaccccccg

SEQ ID NO: 252136 - DNA, 730 bp, Homo sapiens
  misc_feature: GYAE6OF01CCA5H.49.35.D02.1.454.CMB.1.raw
  modified_base (252)..(252): a, c, t, g, unknown or other
  misc_feature (252)..(252): n is a, c, g, or t
  modified_base (332)..(332): a, c, t, g, unknown or other
  misc_feature (332)..(332): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccacaatgacgtttgtacttataattcngtctctggtaccaacaatacccggcaaacgtcccaaactcatgatctttgagtcagtgatcggcccgcgtaggggtttcnctatcgtcttcgtccggctccaagtcgtgctagcacggccctcctgacctatctcgtcgggctccgagtcgtaggacggtacgacggtcgttaggtaactttaacgttaacgtcggtacctaacggtccttactaagttaaacttaaaccaaaacttaaacgttaaaaacccgtaacgggttttacggggttacggtttacccggggtacccggggtaaccggggtaaaaccccgtaaaacgttacccgggttaaccccgttaccccgttaacccgggttaccctaaacgggaccccctaaacggggtacccccgttacccgggaccccccccgtttacgggttacccccttaacccgtttccccgttacccgtttccccccccgtttaacccccccg

SEQ ID NO: 252137 - DNA, 578 bp, Homo sapiens
  misc_feature: GYAE6OF01AYA0P.49.35.D02.1.454.CMB.1.raw
  modified_base (332)..(332): a, c, t, g, unknown or other
  misc_feature (332)..(332): n is a, c, g, or t
  modified_base (412)..(412): a, c, t, g, unknown or other
  misc_feature (412)..(412): n is a, c, g, or t
  modified_base (468)..(468): a, c, t, g, unknown or other
  misc_feature (468)..(468): n is a, c, g, or t
tcagagtcgagagacacgaccggtgctcgatttagcacacgataggttgggtttggggggggtctcaggaggcagcgctctcgggacgtctccaccatggcctgggctctgctattcctcaccctcctcactcagggcacaggtcctgggcccagtctgccctgactcagcctgcctccgtgtctgggtctcctggacagtcgatcaccatctcctgcactggaaccaccaatgacgttggtacttataattctgtctcctggtaccaacataccccggcaaagtccccaaatcatgatctttgagttcagtgatcggccgctagggtttcncatcgcttctccggctccgaagtctggcacgcacggcctccctgacctatctctcgggctccgaggcctaggacggacgngggtctgactttattacctgactagcctactataactaacgaaactaacttaaacnccggtttagggtcgttccgggcggacgggaacctaacgtcgtacccgtctaaccgctacggaccaacggcctccgccccgttcggtcacttcctccgttcccctaccccg

SEQ ID NO: 252138 - DNA, 588 bp, Homo sapiens
  misc_feature: GYAE6OF01DJBWW.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactgaaccacaatgacgttgtacttatattctgtctctggtaccaacaactacccgacaaacgtcccaactcatgatctttgagtcagtgactcggcccgtcgtagggtttctcgtatcgtccttcgtccggtctaccgtaagtcgtcggcacgcgaccggcctcctgacctatctcgtcggctccgaggctaggacggacggaggctagtattaacttacgtgcgtacgtctactaataactaacaaactaataaacgtcgtttagggtacggttcgggacggtacgggaacctaacgtcgaccgtaccgtacgtcgacgtaccgagccgtccgtccccgtcggtactacgtccttccgtcccctacccg

SEQ ID NO: 252139 - DNA, 711 bp, Homo sapiens
  misc_feature: GYAE6OF01D7EGC.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccacaatgacgttgtacttatattctgtctcctgtaccaacaactacccggacaaacgtaccccaaactcatgtatcgtttgaggtcagtgacgtccggcccgtgtacgggtttctcgactcgtccttccgtccggtctaccgtaagtcgtggcacggccgtaccggtccctcccgtcgaacccgtattccgtaccggttcgggtccctaccggacgggtcgtagggaacgggtacggacggtacgttaggtaactttactacgtgaccgtagtcctacgtaacttaactaaaccaaaactaacgttaaacgtacgggtttaggggtacggtttaccgggacgggtaacccggtaaacctaaccgtcggtaaccccgttacccgttaaccggtaccaacccgggtacccgaacgggtcccgttaccccggtcccccgttaccgggtaccttacccgttcccgttaccccgttccccctacccccg

SEQ ID NO: 252140 - DNA, 574 bp, Homo sapiens
  misc_feature: GYAE6OF01ENGLX.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctgtaccaacaactacccggcaaacgtcccaaactcatgatctttgagtcagtgatcggcccgcgtaggggtttctcatccgtcttcgtccggctccgaagtcgtgcacgccaccggtccctccccgtagaccctactctcgtcgggcctcccgaggcgtcggaggacgacgcttagtattattacgtgcagctacatactaaacaaacaataaacgtacgttgggtgttcgggacggacgggaacctaacgtcgaccgtccgacgtcagacccgtaagccgtcgcccctcggtaccactcctccgtccccgtccc

SEQ ID NO: 252141 - DNA, 586 bp, Homo sapiens
  misc_feature: GYAE6OF01DH816.49.35.D02.1.454.CMB.1.raw
  modified_base (436)..(436): a, c, t, g, unknown or other
  misc_feature (436)..(436): n is a, c, g, or t
  modified_base (460)..(460): a, c, t, g, unknown or other
  misc_feature (460)..(460): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttatattctgtctcctggtaccaacaactaccccggacaaacgtaccccaaactcatgattctttgaggtcagtgacgtccggcccgcgacggggtttctcattccgtcttccgtccggctaccgaacgttcgtcggcacgccaccggccctcccgtgaccatctcgtcggcctccacggctggacgggacgnggactagtattatactgcagctanatactaacaaactaataaactacgttgggtgttcggacggacggaaccgtaacgtcgacccgtccgtacgtcacgacccgacggccttccggccccctcggtctacctcttccgtcccctaccccg

SEQ ID NO: 252142 - DNA, 577 bp, Homo sapiens
  misc_feature: GYAE6OF01BBN2D.49.35.D02.1.454.CMB.1.raw
  modified_base (326)..(326): a, c, t, g, unknown or other
  misc_feature (326)..(326): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgngaggggtttctcatcgtcttctccggctccaagtctggcagcacggcctccctgaccatctctcgggctccgaggctgaggacgaggctagtattacttacgtgcagctcatataacaaactaataaacgtacgttgggttcgttcgggacggtaccgggaaccaacgtcggtacccgtcctaacgtccacgcccgtaacggcctcccggcccccgttcggtacctaccttccgtccgttccccgtccccc

SEQ ID NO: 252143 - DNA, 671 bp, Homo sapiens
  misc_feature: GYAE6OF01DKEAW.49.35.D02.1.454.CMB.1.raw
  modified_base (326)..(326): a, c, t, g, unknown or other
  misc_feature (326)..(326): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatcctcctgcactggaaccacaatcgtaacgttgtaacttatattctgtctctggtaccaacaactacccgcaaacgtcccaaactcatgatctttgagtcagtgactcggccgngtagggtttctctacgtcgtcttcgtccggtctaccgtaacgtctaggcaacgccgaacggtccctccctacggacctattccgtcgtcgggactccgaaggtctagggacggacgaggtcgtcgtaagtttatacgtgactagtctacaacttagaaactaaactaattaaaccgtacggtttacgggttacggtttacgggaaccgggtaccgggaaacctaaaccggttcggtaacccgttaccgttaccggtaccgtaacccggaaccgtacgggtacccgtacccggtcccccgttacggtacccttaccgttcccgtttccgttacccccggttccccg

SEQ ID NO: 252144 - DNA, 596 bp, Homo sapiens
  misc_feature: GYAE6OF01BY0R8.49.35.D02.1.454.CMB.1.raw
  modified_base (329)..(329): a, c, t, g, unknown or other
  misc_feature (329)..(329): n is a, c, g, or t
  modified_base (403)..(403): a, c, t, g, unknown or other
  misc_feature (403)..(403): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatcgtgggctgaggtgagaagcctgggtcgtcggtgaggtctcctgcaggcttcgtggagacaccttcaactaactttgctgtcagcgtgggtgcgacacggcccctggacacggccttggaggtggggtgggaaggntcaccccgtataccttaatactagactaaactatgacacacgactactaccacgacagacgtacctacccttanccgacgaactaactcccaacgaacacacgaccctaacgatacggaacctcgccgacacggcctaaggctcgtacgacccgactaccggtccttattactttcgtcgtgacgtaggagtagtacgtttggtttaccttttacgtagttacggtaacgttttaacggtactttaggtacttaagtttcgttacgg

SEQ ID NO: 252145 - DNA, 579 bp, Homo sapiens
  misc_feature: GYAE6OF01BEY7T.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccacaatgacgttggtacttataattctgtctcctgtaccaacaatacccggacaaacgtcccaaactcatgatctttgaggtcagtgatcggcccgcgtaggggtttctcatcgcttctccggctccaagtctggcagcacggcctccctgaccatctcgtcgggcctccgaggctaggaggacgaggctagtattattacgtgcagctcaatactaacaaactaataaacgtcgtttagggtcgttacgggcgggacgggtaaccaaacgttcgacccgtacctacggtccgacgacccgaacggccttccgcccccgttacgggtccaccttcctccgttcccctacccc

SEQ ID NO: 252146 - DNA, 548 bp, Homo sapiens
  misc_feature: GYAE6OF01EMF8Y.49.35.D02.1.454.CMB.1.raw
  modified_base (545)..(545): a, c, t, g, unknown or other
  misc_feature (545)..(545): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacacggcccctggacaagggccttggaggtggggtgggaaggatcacccctataccttaatactagacaaactatgacacagacacttaccacgacagacgtcacccttatcgacgaacaaactccaacgaaacacacgacctaacatacgaactgacgcacgaccgtaggactcgtacgaccgacaccggtccgttattactttcgtgtcgacgagagagtattgttcttctagtgaattacgtaactagtctattntcg

SEQ ID NO: 252147 - DNA, 580 bp, Homo sapiens
  misc_feature: GYAE6OF01EILAR.49.35.D02.1.454.CMB.1.raw
  modified_base (281)..(281): a, c, t, g, unknown or other
  misc_feature (281)..(281): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaataccccgganaaagtcccaaactcatgatctttgaggtcagtgagtcggcccgtcgtaggggtttctcatcgcttcctccggctaccaagtctggcagccacggcctccctgaccatctcgtgggctccgaggctgagggtacgaggctagtattattactgcagctcaatataacaaactaataaactacgttgggtacgttcgggacgggaccgggaaccaaacgtcgacccgtccgtaacgtcgacgacccgaacggacctccgaccccccgtcggtaccctacttccgtcgttcccccgtacccc

SEQ ID NO: 252148 - DNA, 719 bp, Homo sapiens
  misc_feature: GYAE6OF01AW11P.49.35.D02.1.454.CMB.1.raw
  modified_base (342)..(342): a, c, t, g, unknown or other
  misc_feature (342)..(342): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatcctctgcactgaaccacaatgacgttgtacttatattctcgtctctggtaccaacactacccggacaaacgtacccaaactcatagtatcgtttgaggtcaggtgacgtccggcccgagtacggggtttcnctacgtcgtaccttccgtccgggtcctaccgtaacgtcggtacgacgacgccgaaccggtcccctcccgtacgtaaccctacgtcgttccgtcgggccctccggacggtccgtacggacggtacggacggtactagttaacttacgttacgtcgtccgaacgtccttacgaacttaacgtaaactaaaaccgtaaattaacccgtaagggttttacgggtacgggttacccggggacgggtaacccgggtaaacctaaaccgtaccggtaaccccggttaccgtaaccggtccgtaacccgacccggtacggcccccgtacccgttccccccggtacggttccctaacgtttcccgtaccccggttcccctcccccg

SEQ ID NO: 252149 - DNA, 722 bp, Homo sapiens
  misc_feature: GYAE6OF01CBVKX.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccaccaatgacgttgtactatatctgtctctgtaccaacaactacccggacaaacgtcccaaactcatgattctttgacgtcagtgacgtccggcccgtcgtagggtttcctctagtccgtccttccgtccggcctaccgaagtccgtggctacgcgaccgtcctccctgacctagtcctcgtcgggtacctccgtaggtccgtagggacggtaacggacggtcgtacgtaagtttaacgttaccgtacgtccgtacgtccgttaactaacgttaaactaaacctaaacgtaaacttaaaccggttacggtttacggggttaccggttacccggggtaccgggtaccgggtaaacccgtaaacgtaccggtaacccccgttaccgtaacccggtacccgaacccggtaccccggtaaacggtccccgttaacccccggtccccccggtttacggtacccttaacccgttcccgttccccgttaacccccctacccccg

SEQ ID NO: 252150 - DNA, 734 bp, Homo sapiens
  misc_feature: GYAE6OF01ELGK2.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcaccatctcctgcactgaaccaccaatgacgttgtacttataattctgtctcctgtaccaacaactacccggacaaacgtaccccaaactcatgattctttgaggtctagtgacgtcggcccgcgtacggggtttctcacttccgtcttccgtccggtacctaccgtaacgtcgtacggcgtacggacccgacccgggtcccttccccgtacgtaaccctacgttccgttcggttcggggtcccttacccgacgggtccgtacgggaaacggggtaccggtacgggcgttaggtaactttacgtttaacgtcgtaccgtaacgtaccttactaacgttaactaaacctaaaactaaacgttaaacgttaccggtttggggttaccggtttaccggggaccgggtaccgggtaaaccgtaaaccgtaccggtacccgtacgtaaccggtaccgtaaccgacccggtaacggtcccgtacccgtccccggttacgtacctaccgttcccgttacccgttcccctacccccg

SEQ ID NO: 252151 - DNA, 659 bp, Homo sapiens
  misc_feature: GYAE6OF01CGR1T.49.35.D02.1.454.CMB.1.raw
  modified_base (139)..(139): a, c, t, g, unknown or other
  misc_feature (139)..(139): n is a, c, g, or t
  modified_base (283)..(283): a, c, t, g, unknown or other
  misc_feature (283)..(283): n is a, c, g, or t
  modified_base (364)..(364): a, c, t, g, unknown or other
  misc_feature (364)..(364): n is a, c, g, or t
  modified_base (428)..(428): a, c, t, g, unknown or other
  misc_feature (428)..(428): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacngggtcctgggcccagtctgccctgactcagcctgcctccgtgtctgggtcctccgtggacagtcgatcaccatctcctgacacgtacggaaccacaaatggtacgtttggtacttataattctagtcttccgtaggtaaccaanaactacccggactaaaacctcccaaaactcatagacttaccgttaggagtcaaggtcgacgtccggccctgtagggtttcncagtcgtcctcgtccggtctaccgaagtcgtggaccaacgtcgacggtcctaccgagaaccctntcgtcgtcgcgtcgagcgtacggacggacgtagtcgtacgttattacgtacgtacgacgtacgtactactaataaacctaaacgtaaacgtaaactaacggttacgggttcgggtacgggttaccggaaccggtacggtaaaccgtaacgtaccggtaccgtactacgaccgaccgaccgacggtccgtacccgtcccgtaccgtactaccctcccgttcccgtccctccg

SEQ ID NO: 252152 - DNA, 541 bp, Homo sapiens
  misc_feature: GYAE6OF01BGHNY.49.35.D02.1.454.CMB.1.raw
  modified_base (451)..(451): a, c, t, g, unknown or other
  misc_feature (451)..(451): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtcccaaactcatgatctttgaggtcagtgatcggcccgctaggggtttctcgatcgcttctccggctccaagtctgcagcacggcctccctgaccatcctcgtcggggcctccgacggtcgtggacggacggaggctagtatttattactgcagctcatataacaanaataacagttgggtcgttcggcggacggtaaccaacgtcgaccgtctacgtcagacccgagcctcgcccctcgcactctcgtccctaccc

SEQ ID NO: 252153 - DNA, 595 bp, Homo sapiens
  misc_feature: GYAE6OF01CD9OH.49.35.D02.1.454.CMB.1.raw
  modified_base (201)..(201): a, c, t, g, unknown or other
  misc_feature (201)..(201): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccacaatgacgttgtactatattctgtctctggtacaacaactacccggacaaacgtccccaaactcatgatcttgaggtcagtgatcggcccgcgtagggtttctcatcgcttctccggctccgaagtctggcacgcgaccggccctccctcgaccatccgtcgtcgggcctccgaggctcggaagggacgaggactagtactttattacgtgcagtctacataactaacaaaactaattaaacctacgtttggggtacgttcgggacgggaccgggaacctaacgtcgtaaccgtccctacggcctacggacccgtacggcctaccgccccgtaccggtccaccttccctccgttcccctaccccc

SEQ ID NO: 252154 - DNA, 737 bp, Homo sapiens
  misc_feature: GYAE6OF01BT5IW.49.35.D02.1.454.CMB.1.raw
  modified_base (336)..(336): a, c, t, g, unknown or other
  misc_feature (336)..(336): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatcctcctgcactggaaccacaatgacgttgtacttatattctgtctctgtaccaacaacacccgacaaactcccaaactcatgattctttggagtcagtgacgtccggcccgcgtacgggtttcncgtactccgtcttccgtccggcctaccgtaagtcgtcgcgacgtccgaccgtccctaccgtcgaacctcgtcgtcggtcggtccctccggtacggtcgtacgggaacgggtacgacgggtacgttacggtaatttacgttacgtcggtacgtacgtacctactaaagttaaacctaaactaaaccgtaaacgttaaaccgttaccgggtttacggggtttaccggttaccggggaacccgggggtaaccgtaaacccgtaaaccggttacccgaaccccggtttacccgttaaccggtaccgtaacccggtaaccccggtacggtccccgttacccccggtaccccccgttacgggtacccttaacccgtttcccgttccccggttacccccgttcccccg

SEQ ID NO: 252155 - DNA, 682 bp, Homo sapiens
  misc_feature: GYAE6OF01C89T0.49.35.D02.1.454.CMB.1.raw
  modified_base (337)..(337): a, c, t, g, unknown or other
  misc_feature (337)..(337): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttatattctgtctctaggtaccaacaactaccccggacaaacgtcccaaactcatgatctttgagtcagtgatccggccgcgtagggtttcncactcgtccttcgtccggtctacctaacgtctggcctagccgaccggtccctcccgtagaccctacttcctcgtcgggtacctcccgagggtccgtaggacgggacggtaggtcttaggtatttacgttacgtcgcgacgtctacattaacgtaacaaaactaacttaaacgtacgtttgggtacggttacgggacgggtaccgggaaacccgtaaacgttccggaacccggttaccgtaaccggttaccgaaccggacccgtaaacgggtccccgttacccggtaccccccggttaccgggtacctaccccgtttccgttccccggtttaccccctaacccccg

SEQ ID NO: 252156 - DNA, 565 bp, Homo sapiens
  misc_feature: GYAE6OF01AP2OX.49.35.D02.1.454.CMB.1.raw
  modified_base (361)..(361): a, c, t, g, unknown or other
  misc_feature (361)..(361): n is a, c, g, or t
  modified_base (527)..(527): a, c, t, g, unknown or other
  misc_feature (527)..(527): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactacccggcaaacgtcccaaactcatgatctttgaggtcagtgatcggcccgctaggggtttctcactcgcttctccggctccaagtcnggcacgcacggccctcccgtcgaccatccgtctcggggcctccgaggctagacgggtacgaggtctagtaatttacttacgtcgcagctacatactaacaaacaataactacgttggtcgttcggacggacggaaccaacgtcgaccgtacctacgtctacgccgngcctcgccccgtcggcctactcctccgtccctaccccg

SEQ ID NO: 252157 - DNA, 545 bp, Homo sapiens
  misc_feature: GYAE6OF01ECCAK.49.35.D02.1.454.CMB.1.raw
  modified_base (325)..(325): a, c, t, g, unknown or other
  misc_feature (325)..(325): n is a, c, g, or t
tcagagtcgagagacacgaccggtgctcgatttagcacacgatagttgggtttggggggggtctcaggaggcagcgctctcgggacgtctccaccatggactgggctctgctattcctcaccctcctcactcagggcacagggtcctgggcccagtctgccctgactcagcctgcctcgtgtctgggtctcctggacagtcgatcaccatctcctgcactggaaccaccaatgacgttgtacttataattctgtctcctggtaccaacaactaccccggcaaacgtccccaaactcatgatctttgaggtcagtgatcggcccgntaggggtttctcatcgcttctccggctccaagtctggcagcacggcctccctgaccatctctgggctccaggctgacggacgaggctgtattattactgcagctcatataacaaacaataaactacgttggtcgttcggcggacggaccaacgtcgaccgtacctacgtcacgaccgacggcctcgcccccgttcgtacaccttctcgttccctaccccg

SEQ ID NO: 252158 - DNA, 697 bp, Homo sapiens
  misc_feature: GYAE6OF01C6O4C.49.35.D02.1.454.CMB.1.raw
  modified_base (319)..(319): a, c, t, g, unknown or other
  misc_feature (319)..(319): n is a, c, g, or t
  modified_base (500)..(500): a, c, t, g, unknown or other
  misc_feature (500)..(500): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtcgtgggtctcctggacagtcgatccacctatcctcctgcactacggaaaccaccaagtgtaccgttggtaacttataatttctgtctcgtcgtaaccaacaactacccggactaaacgtaccccaaactcatgattntttagaggtcagtgacgtccggcccgcgtacggggttttcacgtactccgtccttccgtccggtctaccgtaagtccgtcggacacgccgaccggtcccttccctacgaaccctcgttccgtcgtccggggccttccgcggtcgaggacggacggtaggcttaggtaattacgtttaacgngtcagtacctactaataaccgtaaacaaacctaacttaaacgtcggtttacgggtcgggtccgggtaacgggtacccggaaacctaaccggttccgtaccccggttaccaccggtacaacccggaccccgtaggtaccccgttcccgacccccggttaccggtcttacccgtcccgttcccgttcccccttaccccg

SEQ ID NO: 252159 - DNA, 860 bp, Homo sapiens
  misc_feature: GYAE6OF01BPT9G.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccaccaatcgacgttggtacttataattctgtctcctaggtaccaacaactaccccggacaaacgtccccaaactcaatgatctttgacgtcagtgacgtccggcccgcgtacggggtttctcgtatccgtccttccgtccggtctaccgtaaacgtcgtacggcgacgtccgaaccggtccctcccgtacggtaccctacttccgttcggttacggggtccctcccggtacgggtccgttacgggaacggggtaaccggacgggttaccgttaaggttaacgttttaaacgtttaccgtttacgggaccgttaacggtaccctttaacgtaaactttaaaccgttaaaaaccgtaaaacctaaaccggtttaaaacccgtaacgggtttttacgggggttacggggttttacccgggggaacccggggtaacccggggttaaaacccccgttaaaaccgggtaacccgggttaaacccccggtttaacccggtaacccgggttaaccggtaaccccggtaacccccggtaaacgggacccccgtttccccgggtaaccccccccggtttaccgggtttacccctaaccccgtttcccggtttcccccgggtttaccccccggtttcccccccg

SEQ ID NO: 252160 - DNA, 776 bp, Homo sapiens
  misc_feature: GYAE6OF01EFQDP.49.35.D02.1.454.CMB.1.raw
  modified_base (282)..(282): a, c, t, g, unknown or other
  misc_feature (282)..(282): n is a, c, g, or t
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactcggaaccacatgtacgttggtacttatattctgtctcctgtaaccaacaactaccccgganaaaccgtacccaaactcatgtatctttgaggtcagtgactccggcccgngtagggtttcnctacgtcgtcttcgccgctaccgaagtcgtcgacgacgccgaccgccctcccgtacgacctactcctacggtcggtcctccggacggtcgtacggacgggtacggacgggttaccgttaggttaacttttaacgttaccgtacggtacctacggtaccctacttaaattaaaccgtaaaaccaaaaacttaaaccgttaaaaacgttcggggttttacggggttaccgggtttccgggggaaccggggtaacccgggtaaaccgttaaaccggtacccgggttaacccccggttacccggttaacccggtccgttaaacccgggaacccccgggttaacccggtacccggttaccccccggtacccccccggttcggttacccccgttaacccgttccccggttttaccccgtcccccccgtttaacccccccg

SEQ ID NO: 252161 - DNA, 621 bp, Homo sapiens
  misc_feature: GYAE6OF01CL54N.49.35.D02.1.454.CMB.1.raw
  modified_base (421)..(421): a, c, t, g, unknown or other
  misc_feature (421)..(421): n is a, c, g, or t
tcagagtcgagagacacgaccggtgctcgatttagcacacgatagttgggtttggggggggtctcaagaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggacaaacgtccccaaactcatgatctttgagtcagtgatccggccgcgtagggtttctcgtatcgtcttctccggctccgtaagtctggcagcaccggcctccctgaccatctcgtgggcctccgaggctggaggacgaggntagtattattactgcacgtctacaataactaacaaaactaattaaacctacggtttggggtacgttccgggacggtaccgggaaaccctaaacgttcggaaccccgttacctacggtaccgaacgacccccgaaagggtccctacccggtaccccccgtacggttacccaccgttcccttcccggttccccctacccccg

SEQ ID NO: 252162 - DNA, 663 bp, Homo sapiens
  misc_feature: GYAE6OF01CUK33.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactcggaaccacaatgtacgttgtacttatattctgtctctgtaccaactaactacccggacaaacgtcccaaatcatgacttcgtttagagtcagtgacgtccggccgtgtacgggtttctctagtccgtccttcgccgtcctaccgaacgtcgtacggcgacgcccgtaaccggtccctccccgtagaccctatccgtacggttcggcctccggaggtcgtaggacgggtacgtagtcgtagttattaacttacgtgacctagtacctacaacttaacgaaactaaacaattaaaccgttacggttgggttaccggtaccggaccggggacggtaacccaacgttaccggacccgttaccgtaccggtaccgaccgacccggtaacggcccgtacccgtccccgtacgtacctacccttcgttcccgttcccccttaccccg

SEQ ID NO: 252163 - DNA, 797 bp, Homo sapiens
  misc_feature: GYAE6OF01CWQM2.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctctcactcagggcacagggtcctgggcccagtctgccctgactcagcctgcctcgtgtctgggtctccgtggacagtcgatcaccatctcctgccactggaaccaccaatgacgtttggtacttatattctgtctctgtaccaacaactacccgtgaccaaacgtacccctaaactcatatattctttaggaggtactaggtcgtacgtccggacccgtcggtacggggtttcctctacgttccgtcttaccgttcccggtccttaccgaacgttccgtcgggtaccacggccgaccggtccccttacccgtacggacccttacgttccgttccgttaccggggtccttaccccggaagggtcgtaggtacgtacggaaccgggtacgggtaccttacggttaacgtttaactttaacggtcggtacgtaacggttaccttaactaacttaaaccttaaaaccctaaaactaaaccgtttaaaaccgttcgggttttaacgggggttaccgggtttccggggaaccggggtaacccggtaaacccgtaaaccggttacggtaacccccgtttaacccggttaccggtaccggaaaccggtaccccggtaaaccgggtcccgttaccccggtacccccggtacggttaccccggtaccttcccggtttacccccg

SEQ ID NO: 252164 - DNA, 560 bp, Homo sapiens
  misc_feature: GYAE6OF01CTWJT.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttatattctgtctcctgtaccaacaactacccggcaaacgtcccaaactcatgatctttgaggtcagtgactcggccgcgtaggggtttctcactcgcttctccgctccaagtctggcagcacggcctccctgacctatctactcgggacctcgacggtctggacggacggaggtctagtacttattacgtgcgacgtcctacaataactaacaaactaataaactacgttgggttcgttcgggacggacggaaccgaacgtgaccgtcacgtcacgaccaggcctcgtacccgtcgtacactctcgtcccgtccc

SEQ ID NO: 252165 - DNA, 724 bp, Homo sapiens
  misc_feature: GYAE6OF01EJ09E.49.35.D02.1.454.CMB.1.raw
  modified_base (352)..(352): a, c, t, g, unknown or other
  misc_feature (352)..(352): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtcgtgggtctccgtggacagtcgatcaccatcctcctgcacgtcgaaccacaatgacgttgtacttataattctgtctccgtgtaaccaacaacgtacccggactaaaccgtaccccaaactcatagtattcgtttggagtcagtgacgtccggccgtcgtacgggtttcncgtactccgtcttccgtccggtcctaccgtaacgttcgtacggacacgtccgaccggtcccctcccgtacgaacctactccgtcggtcggtcctccggacggtcgtacgggacggacggtacgtcgttaagttaacgtttacgttacgtacgtacgtacgtacttaactaacgtaaactaaaccaaattaaaccgttaaacgttacgggtttacggggttcggttaccgggaccgggtaacccggtaaacctaaccggtaccgttacccgtaccgttaccggtacctacccggaccgtaaccggtcccgttaccccggccccggttcgtacccgtacccgtttcccggtttccccgtcccccggttaccccc

SEQ ID NO: 252166 - DNA, 762 bp, Homo sapiens
  misc_feature: GYAE6OF01CVUF9.49.35.D02.1.454.CMB.1.raw
  modified_base (279)..(279): a, c, t, g, unknown or other
  misc_feature (279)..(279): n is a, c, g, or t
tcagagtcgagagacacgaccggtgctcgatttagcacacgatagttgggtttggggggggtctcaggaggcagcgctctcgggacgtctccacatggcctgggctctgctattcctcaccctctcactcagggcacagggtcctgggcccagtctgccctgactcagcctgcctccgtgtctgggtctcctggacagtcgatcaccatctctgcactggaaccacaatgacgttggtacttatattctgtctcctaggtaccaacaactaccccgganaaacgtccccaaactcatgattctttgagtctagtgacgtccggaccgtcgtagggtttcacgtactccggtacttccgtccggtcttacccgtaaggttcctaggccgaggtcccgaaccggtcccttcccgtacgtacccgtattccgtacggtcgggaccttaccggacggtcgtaggacggaccggtacggtcgttagtaactttacgttaccgtacggactacggccttaacgtaacttaactaaaaccgtaaacctaaacgtttaaaaccgttaacggggtttcggggtttaccgggtttacccgggggaacccggggtaacccgggtaaaaccgttaaacccggttacccggtacccggttacccgtttaacgggtaacccgacccgggtaaccccgtacgggtaccccttccccggttacccccgtaccggttacccgtaacccgtttcccgttccccgttcccccgttaccccc

SEQ ID NO: 252167 - DNA, 773 bp, Homo sapiens
  misc_feature: GYAE6OF01DBC2I.49.35.D02.1.454.CMB.1.raw
tcagagtcgagagacacgaccggtgctcgatttagcacacgataggttgggggtttggggggggtctcgaggaggcagcgctcgtcgggacgtctccaccatggccgtgggctctgctattcctccaccctcctcactcgagggcacgacgggtcctcgggcccagtctcgccctgactcacgcctgcctcgtgtcgtgggtcctcgtggacagtcgatccaccatcctcctgccacgtacggaaaccacaagtgtacgttaggtacttaatattctgttcctcctacggtaaccaacaaccgtaccccggactaaaccgtaccccaaactcatgtacttcgtttaggacgtcaggtgtacgtccgggcccgtcggttacggggttttctacgtacgtccgtccgtttccgtcccggtaccttaccgtaagttccgtacggtaccgacggcccgacccggtccccttccccgtacgtaccctacttccgttcggtccggggtcccttccggacggtccgtaggaacggggaacgtcgggtcgttagtaactttacgtaccgtgaccgtcgtaccttacaagttaacaaacctaaaactaacgttaaaaccgttacgggttttacggggtacgggttacccggggaccgggtaccggtaaaaccccgtaccggttaccggtaccccgtaccggtaccgtaccgaacccgaccggacggtccctcccgtaccccgtcggtaccctaccgttcccgttcccgttacccccgtcccc

SEQ ID NO: 252168 - DNA, 729 bp, Homo sapiens
  misc_feature: GYAE6OF01A6FD0.49.35.D02.1.454.CMB.1.raw
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatcctcctgctacgtgaaccacaatcgacgttgtacttatattctgtctctgtacaacactacccgacaaacgtcccaaactcatgattcttgaggtcagtgactcggccgcgtacgggtttctactatcgtcttccgtccgtacctctaacgtcgtcgcgacgtccgacggtcccttcccgtacgaaccctaactccgttcgttcgggccgttaccgacggtcgtacggacggacggtacggtacgttagtaaacgtttacgttaaccgtcgtaccgtaacgtcctaacggtaacttaactaaaccaaacgttaaacgttaaacgttccgggtttaacgggggtttcggtttaccggggaccggggttaacccgggaaccttaaaaaccggtccggttaacccggttaaccgtaccggttaccgtaaccggaaccccgtaaacgggtcccgttaccccggtacccccggttaccggttaccctaaccgtttcccgttccccggttccccctttacccccg

SEQ ID NO: 252169 - DNA, 552 bp, Homo sapiens
  misc_feature: GYAE6OF01A8FB0.49.35.D02.1.454.CMB.1.raw
  modified_base (432)..(432): a, c, t, g, unknown or other
  misc_feature (432)..(432): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcaggggtttctcatcgcttctccggctccaagtctggcacgcacggcctccctgacccatctctgggctccgaggctggaggacgaggctgattattactgcagctnatataacaaactaataacacgttgggtcgttacgggcggtacggaccaaacgtcgacccgtaccgtacgtcacggcccaaggcctccgcccctcgacgtcctactccgtccgttcccccg

SEQ ID NO: 252170 - DNA, 556 bp, Homo sapiens
  misc_feature: GYAE6OF01AKL5C.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtcccaaactcatgatctttgagtcagtgatcggcccgcacggggtttctcactcgcttctccggctccaagtctgcagcacggcctccctgaccatctctcgggcctccgaggctggacggacgaggtctagtattattactgcagtcctcatataacaaactaataaactacgttgggttcgttacggcggacggaaccaacgtcgacccgtcctacgtccagcccaaggcctcggcccccttcgacctacctcctcgttcccctaccccg

SEQ ID NO: 252171 - DNA, 670 bp, Homo sapiens
  misc_feature: GYAE6OF01AW5EV.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactagaaccacaatgacgttgtacttatattctgtctctcggtaccaacaactaccccgacaaacgtaccccaaactcatgtactctttgacggtcagtgacgtccggcccgtcgtacggggtttctacagtcgtccttccgtccggtcctcgaacgttcgtcggacacgccgaccggtcccctcccgtacgacctacgttcctacgtcgggtcctcccggtaggtccgtacggacgggtaacggagggtcgttagtaacttttaacgttaacgttcgacgtacgtctactaactaaacgtaaacaaactaaacgtaaacctaccgggtttacgggttcggttaccggggcgggaaccgggtaacctaaacggtcgtaacccgtccgtaacggtccacgacccgacggccgtcccgccccgtcggtacctacctcgttcccgtcccgtcccc

SEQ ID NO: 252172 - DNA, 733 bp, Homo sapiens
  misc_feature: GYAE6OF01AU4YR.49.35.D02.1.454.CMB.1.raw
  modified_base (275)..(275): a, c, t, g, unknown or other
  misc_feature (275)..(275): n is a, c, g, or t
  modified_base (399)..(399): a, c, t, g, unknown or other
  misc_feature (399)..(399): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctcctgcactgaaccaccaatgacgttgtacttataattctgtctctggtaccaacaactacccgnaaacgtccccaaactcatgatctttgagtcagtgactccggcccgcgtagggttctcgagtccgtcttccgccggtctaccgaagttcgtggacacgtccaccggtccctaccctcgtaccgtntccgttacgtcgggtcctccgacgggtcgtacgggtacgggaaccggtaacgggtcgttaacgggttaactttaacgtttacccgtacgggtaccctacgggtacccttactaaagttaaacctaaaacccgtaaaaacctaaacttaaaaccggttacgggttttacgggggttcgggtttaaccggggaccggggtaacccgggaaaccctaaacggttccggtaaccccgttaccgtacggtacccgtaacggcccgtaaacgggtccccgtacccggccccccgttacgggtccctaacccgttcccgttcccgttccccctaacccccg

SEQ ID NO: 252173 - DNA, 654 bp, Homo sapiens
  misc_feature: GYAE6OF01CO5SW.49.35.D02.1.454.CMB.1.raw
  modified_base (393)..(393): a, c, t, g, unknown or other
  misc_feature (393)..(393): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgtttggtacttataattctgtctcctgtaaccaacaactacccggacaaacgtcccaaactcatgattctttaggaggtcagtgactccggcccgcgtaggggtttcctacatcgtcttccgtccggtctccaagtctggcagcacggccctccgngacctatctcgtcggtcctccgaggtctaggaacgggacgaggtctagtacttacttacgtgacgcgtctacataactaacaaaactaattaaaccgtacgtttgggttacggttccgggacggggtaccggaaaccgtaaacgtccggtaaccgttacccgtacggtacccgtaacggaccccgaaacgggtcccgtaccccgtcccccgttaccggttacccaacccggtttcccgttcccggttacccccgttccccg

SEQ ID NO: 252174 - DNA, 806 bp, Homo sapiens
  misc_feature: GYAE6OF01BJ7D2.49.35.D02.1.454.CMB.1.raw
tcagagtcgagagacacgaccggtgctcgatttagcacacgatagttggggttggggggggtctcgaggaggcagcgctctcgggacgtctccaccatggcctgggctctgctattcctcaccctctcactcagggcacgaggtcctgggccagtctgcctgactcagcctgcctcgtgtctggtctccgtggacagtcgatcaccatcctcctgcacgtaggaaaccacaagtgtacgttaggtaacttataattctcgtctccgtagtaaccaacaacgtacccggacaaacgtacccaactcagtagtattctttgagtcaagtgacgtcggccgagtacgggtttcactacgtcgtcttccgtccggtcctaccgtaacgtcgtacggaccgtaacggccgaaccggtcccttacccgacggaacccttacgtccgttccggtacgggccttaccgggaacgggtccgtaacgggaacggggtaacccggtaggttccgttaaggtaacgttttacgttaaccgttgggaccttaacggtaccctaactaacgtttaaaccgaaaacctaaaacggttaaacgttaaaaccggtttacgggttttagggggttaaccgggttaccggggtacccggggtaacccggaaaaccgttaaaccgggtcccggtaaaccccgggtttaccgttaacccgggaccgttaacccggaacccggaaccgggttccctaccccgggtacccccgttcggggttacccctaacccgtttcccctccccggtttaaccccccggttaccccc

SEQ ID NO: 252175 - DNA, 773 bp, Homo sapiens
  misc_feature: GYAE6OF01EF7UF.49.35.D02.1.454.CMB.1.raw
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctcgccctgactcagcctgcctccgtgtctgggtctcctggacagtcgatcaccatctcctgcactggaaccaccaatgacgttgtacttatattctgtctcctagtaccaacaactaccccggacaaacgtaccccaaactcatgtatctttgaggtcagtgacgtcggcccgngtagggtttcncactcgtcttcgtccggtctaccaagtcgtcggcacgccgaccggtccctcccgtacgaccctaatccttacggtcgggtcctacccgtacgggccttagggaacgggtaaccggacgggtacgttaggttaacttttaacgtttaccgttacgggacctacgtcccttactaacttaactaaaacaaaacgtaaacttaaaaccgttacggtttaacggggtttacgggtttacccggggacccggggtaacccgggtaaaccccgttaaaccggttaaccggttaacccccggtttaacccgttaacccggttaccggtaaacccggtaccccggaaaccggggttaccccttccccgggtaccccccccgttaccgggttacccgtaaccccgttttcccggttccccgttccccccttaaccccccg

SEQ ID NO: 252176 - DNA, 735 bp, Homo sapiens
  misc_feature: GYAE6OF01EIHNY.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaagcctgggtcgtcggtgaggtctctgcaggcttctggagacaccttacaactactttgctgtcagcgtgggtgcgacacggcccctggacaaggtccttggacggttggggtagggaaggtactcccgaaccccttattacccgtttaaatacgtaacggacctaaaacttagtacgacctaacgaagtaacctaacttacccgaaccgacgaacggtaacgttacccgtaacccctttaagtacccggaccggtaaacctaaaaccgtacccgaaaccggaaacccaaccgaaccgtccctaaaacgtacgtaacgggtaaacctcggaccgaccgaaggtaccccttaagggaccttccgtaccggaaccccgtaaccgtaacccgggtaccgttttaacttacgttttaccggttcggtcgggtaaccggtaggtaaacggaggttaacgtttcggttttacctttactaacggtttagtaacgttaacggtttaacttacgttacttaagttgtttaccgg

SEQ ID NO: 252177 - DNA, 749 bp, Homo sapiens
  misc_feature: GYAE6OF01CTZYY.49.35.D02.1.454.CMB.1.raw
  modified_base (275)..(275): a, c, t, g, unknown or other
  misc_feature (275)..(275): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctctgtacaacaactacccgganaaacgtcccaaactcatgatctttgagttcagtgacgtccggacccgcgtaggggtttctacgtactccggtcctttccgtcccggtcttacccgtaaacggttcgttacgggaccaaggcccgtaacccgggtccccttccccgtacgtaacccctacgtttcccgtccggttccgggggtcctacccggtaacgggccgtttagggaacggggtaccggaacggggttcttaacgggtatttaacgttaaccgttggaccgtacggtacctactaaacttaaaccgttaaaccgaaaaacctaagttaaaaccgtcggttttacggggtcggttaccggggacccgggtacggaaacccgtaacgtcgtaacccgttaccgtaccgttacgaccggacccgtaaggtccctaccccggtcccccgttacgggttaccctaccgttcccttcccgttaccccccttaaccccg

SEQ ID NO: 252178 - DNA, 820 bp, Homo sapiens
  misc_feature: GYAE6OF01CH4CZ.49.35.D02.1.454.CMB.1.raw
  modified_base (253)..(253): a, c, t, g, unknown or other
  misc_feature (253)..(253): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccaccaatgacgttggtacttatattcngtctctagtaccaacaactacccggacaaacgtacccaaactcatgacttcgtttgacggttcagtcgacgtccgggcccgtcgtacgggtttcctacgacgtccgtccttccgtccggtcctaccgtaaacgttccgtcggaccacggtcccgacccggtcccttccccgtcgaacccctattcctcggttacgggtccgtcccggagggtccgtagggaacgggtaccggtaaggtcgttaggtaacttttacgttaccgtcgtacgtacgtccgtaactaaactaacgttaaaaccctaaaacgttaaaacgttaaaacccggttaacggggttttcgggggttaccgggtttaacccggggggacccggggtaaaccggggtaaaaccccgtaaacccggtttacccggggaccccgttttaccccggtaaacccggttacccggaaaccggtaacccccggtaaaccggggtcccccgtttaccccgggaccccccgtttacccggggttaacccttccccgtttacccggtttacccccggttccccccgggttacccccc

SEQ ID NO: 252179 - DNA, 676 bp, Homo sapiens
  misc_feature: GYAE6OF01DDLJO.49.35.D02.1.454.CMB.1.raw
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (309)..(309): a, c, t, g, unknown or other
  misc_feature (309)..(309): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctctcactcagggcacagggtcctgggcccagtctgccctgactcagcctgcctcgtgtctgggtctcctggacagtcgatcaccatctcctgcactggaaccngcagtgacgttgganattataactatgtctccgtggtaccaacacgtaccaggaccaaacgcccccagactcatgtatttagngcgtacagtacgccgccctacggacgggtccctagactcgtcttctcgtcgtcctaccgtaacgtcgtacggacctaccgaccggtccccttaccgtacggtacccgttccggttccggtacgggtcccgttcccggggtcgtaacggaaacgtgtacggtacgggtcctttaggttaatttttccgtttcgtacgtaccgtacggtccttaacgtagttactcggaaccggtacgggaccaacggtacttaaacgtttacgttttggtacgttattaccggtccgggacgggtaacggaccgtagtcccgtacgtaccccggtacgtacgggtaccaccggtacccgtacggtcccgtacccccgg

SEQ ID NO: 252180 - DNA, 794 bp, Homo sapiens
  misc_feature: GYAE6OF01DSOEM.49.35.D02.1.454.CMB.1.raw
  modified_base (215)..(215): a, c, t, g, unknown or other
  misc_feature (215)..(215): n is a, c, g, or t
  modified_base (304)..(304): a, c, t, g, unknown or other
  misc_feature (304)..(304): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctctcactcagggcacagggtcctgggcccagtctgccctgactcagcctgcctccgtgtctggtctcctggacagtcgatcaccatctcctncactggaaccagcagtgatgttaggaattactaacttttctctagtaaccaacaaccacccagacaaacgcccccaaatcatcatttangacgcgatcgagcgcctcgagggtctctagactcgctttctcgtcgctcccgtacgtcgtacggcacgccgaaccggtcccctacccgttagaacctaacttccgtaccgtcgggtccccttacggacgggtcccgggttacgggggaacgtaacgggtccgttagttaacgttttaacgtttaaagtttcggtaccgttttacggtttacctaacgtttacgggttacggtacccgggtttaggtaaacgggttacgggttacggggtaacccggggttaaagggggtttcggggtttacccgggggaaaccgggggtaaaccgggggtaaacccggttaaaacggggttcccgggtaaacccccgggttttaccggtaaccggggttaccgaaaacccgggtaaccccccgtaaacggggtcccccggtttaacccccggtacccccccgggttttaacccgggttcccgtaacccgttttcccccgg

SEQ ID NO: 252181 - DNA, 648 bp, Homo sapiens
  misc_feature: GYAE6OF01AYH1A.49.35.D02.1.454.CMB.1.raw
  modified_base (336)..(336): a, c, t, g, unknown or other
  misc_feature (336)..(336): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactggaaccaccaatgacgttgtacttataattctgtctcctggtaccaacaactaccccggacaaacgtcccaaactcatgatctttgaggtcagtgatcggcccgcgtaggggtttcnctatcgtcttccgtccggtctaccgtaacgtcgtggacacggaccaccgggtccctccccgtacgtacccacgttcctaccgtcgggcctccgacgggctaggacgggacggtacggcttaggtaattattacgtcgtcgtacgtactacaataactaacaaactaactaaactacgttacgggttcgttacgggaccggacgggtaaacctaacggtcgtaacccgttaccgtaccgtacgaccggacccgaacggtccctccggtcccccgtcggttacctacccgttccttcccggttccccgtccccg

SEQ ID NO: 252182 - DNA, 784 bp, Homo sapiens
  misc_feature: GYAE6OF01CIC0P.49.35.D02.1.454.CMB.1.raw
  modified_base (364)..(364): a, c, t, g, unknown or other
  misc_feature (364)..(364): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcgagggcacgagggtcctcgggcccagtcctgccctgactcagcctgccctcgtgtcgtgggtctccgtaggacagtcgatcacctatcctcctgcacgtacggaaccaacagtgacgttgtaacttataattctgtctctacggtaccaacacgtacccggactaacgtcccaactcatgtacttcgtttagacgttcaggtcgacgtccggcccgtcggtaagggtttccnctacgtccgtccttccgtcccgggtacttacccgtaacgtccggtcggactaccggcccgtaaccggccccgttacccctacggaaacccgttcgttaccgtccgggttacgggtcccgttaccggacgggtccgtacgggtacggggaacgggtaacggtacgttacgttaacgtttaccgttaacggttacgaccgtacgtaccttaacgtaataaccttaaactaaaccgtaagttaaaccgtacgggtttacgggttaccgggttacgggaacccgggtaccgggtaaaacccgtaacgtaccgggtaccccgttaccgtacccggtacgacccggtaacccggtacggccccgttacccggtacccccgtacggttcccgtaacccgttcccgttcccgttcccccgttcccccg

SEQ ID NO: 252183 - DNA, 672 bp, Homo sapiens
  misc_feature: GYAE6OF01CE77Z.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactacggaaccacaatgacgttgtactatattctgtctctgtaccaacaactacccggacaaacgtcccaaactcatagatcgtttgaggtcagtgacgtccggccgcgtagggtttctcactcgtcttcgtccggtctccaagtcgtcggcacggccaccggtccctccctcgaccctagtccgtcgttcgggcctaccgacggcgtaggaacgggaccgacggtacttaggtacttacgttaacgtgacctagtcctacgtaacttaactaacaaactaacttaaaccgttacggtttggggtacgttacgggaccgggtaccggtaaacccgtaaacgttccggtaaccccgttaccgtacccggtcaaccggtaccccgaaacggtccctaccccggacccccgttaccggaccttacccgtcccttacccggttccccctaacccccg

SEQ ID NO: 252184 - DNA, 687 bp, Homo sapiens
  misc_feature: GYAE6OF01AX472.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttataattctgtctcctggtaccaacaactacccggacaaagtccccaaactcatgatctttgaggtcagtgatcggccgcgtagggtttctcgactcgtcttctcggctaccgaagtctaggctagcaccggtccctccctcgaccactctacgtcgggctccgacggtcgtacggtagggaaccggtacggcgttagtaagtttacttaacgtcggactaacggtcctaactaacttaactaacgtaaacctaagttaaaaccgtacgggtttacggggtttacggttaccggggtacccggggtaaccggaaacccgtaaccgtaccggtaacccgttacccggttaaacgtaccgtaacccggacccgtaaacgggtacccttccccgggtcccccgttaccggtacctacccgtcctttcccggtaccccctacccccg

SEQ ID NO: 252185 - DNA, 790 bp, Homo sapiens
  misc_feature: GYAE6OF01COXQY.49.35.D02.1.454.CMB.1.raw
  modified_base (414)..(414): a, c, t, g, unknown or other
  misc_feature (414)..(414): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacgagggtcctcgggcccagtctgccctgactcagcctgcctccgtgtctgggtctcctggacagtcgatcaccatcctcctgccacgtcggaaaccaaccgtaaagtcggtaccgtttaggttaactttaataacttttcgtcgttccttccgttaggttaaccaaactaaaccgttaaccccgggaactaaaacggtacccccaaaactccaattagaactttccgtttaggtaggtacctaggtacgacgtcggacccgacgttacgggtttcncgtactccggtaccttccgtccggtactaccgtaacgtccggcggacacggccgaaccggtccctaccctcgaaccctattccgtcgttcgggccctcggacggtacgtagacgggtaccgaggtactaggtaatttaacgtacgtacgacgtacgtaccttactaactaaactaaaacctaaaaaccgtaacttaaaacccggtacggtttacggggttccggggtaccgggtaccgggaaccggggtaacccttaaaaccggtccggtaccccgttaccgtaacggtacccggaacgtaccccggaaacggtccccgttacccggcccccgttacggtaccttacctttcccgtccccgttccccgttaccccc

SEQ ID NO: 252186 - DNA, 605 bp, Homo sapiens
  misc_feature: GYAE6OF01B8FRQ.49.35.D02.1.454.CMB.1.raw
  modified_base (165)..(165): a, c, t, g, unknown or other
  misc_feature (165)..(165): n is a, c, g, or t
  modified_base (427)..(427): a, c, t, g, unknown or other
  misc_feature (427)..(427): n is a, c, g, or t
  modified_base (460)..(460): a, c, t, g, unknown or other
  misc_feature (460)..(460): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttctctttgtggtggcagcagctacaggtncccagtcccgggtccagctggtgcaatctgggctggaggtgagaaagcctgggtcgtcggtagaaggtctcctgcaaggcttcgtgggagacaccttacaacctaactttgctgtcacgtcgtgggtcgcgacgacggcccccgtaggacgaacggccttggaggtggggtaggaaggactccgtacccctagtaccttaaatactaacgtactaaactagtgacacaagactacttaccaacgacagacgtacaccgttancgacgaacaactaccaacgaacacacgacctanatacggaactgaccgctaacgcctaagggactcgtacgccgtaaccgcggtaccgtttaattcgttcgagtcgacgaacggagtacgtattggttaccttttacgtagttagtaagttacttaacgtacgttattatttggtacg

SEQ ID NO: 252187 - DNA, 609 bp, Homo sapiens
  misc_feature: GYAE6OF01C95ZE.49.35.D02.1.454.CMB.1.raw
  modified_base (252)..(252): a, c, t, g, unknown or other
  misc_feature (252)..(252): n is a, c, g, or t
  modified_base (336)..(336): a, c, t, g, unknown or other
  misc_feature (336)..(336): n is a, c, g, or t
  modified_base (457)..(457): a, c, t, g, unknown or other
  misc_feature (457)..(457): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctctcactcagggcacagggtcctgggcccagtctcgccctgactcagcctgcctccgtgtctgggtctcctggacagtcatcaccatctcctgcactcggaaccacaatgacgttggtacttatattcngtctctagtaccaacaactaccccgacaaacgtcccaaaactcatgatctttgaggtcagtgactcggccgcgtacgggtttcnctactcgtcttctccggctaccaagtctcgacacgcacggtcctcccgtagacctatctcgtcgggtctaccgacggcgtaggacggtacgaggtacttaggtattattactgacagctanataactaacaaacaactaaactacgttgggtacgttacggacgggtacggaacgaaaccgtcgaacccgttcctaccgtacgtaacgacccgaaacggtccgtaccgcccccgttcggtaccctacgttccgttcccgttccccgtaccccc

SEQ ID NO: 252188 - DNA, 758 bp, Homo sapiens
  misc_feature: GYAE6OF01CQMWX.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactacggaaccacaagtcggtacgttgtacttaatattctgtctcctaggtaccaactaaacgtacccggacaaaccgtccccaaactcatagtacttcgtttagagtcagtgacgtccggccgtacggtagggtttctacgtactcgtaccttcgtcccggtctaccgtaaggtcgcggtacacggtacccgtaccggtccccttaccccgtacgtaaccctacgttcccgttcggtccgggtcctaccgaggtccgtaagggacggtaccggtacggtacttagtaacttttaactacggttgaccacgttacctaagtaaacttaaactaaactaaaactaagttaaaccgtcggggtttaggggtaccgggttaccgggaccgggtaaccgggaaacccttaaaccgtccgggtaaccccgttacgtaacccggttacgaaccccggttaacccggaacggttccccgttacccccggtaccccggttacggttaaccctacccgtttacccgtccccgtttcccccccggtacccc

SEQ ID NO: 252189 - DNA, 639 bp, Homo sapiens
  misc_feature: GYAE6OF01DSW1A.49.35.D02.1.454.CMB.1.raw
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgtacgttggtactttatattctgtctcctggtaccaacaacgtaccccggacaaacgtccccaaatcatgatctttagagtcagtgactccggccgngtagggtttctcatcgcttcnccggctacgagtcnggcncgcaccggtcctcctgacctntcctcgtgggcctccgaggctaggaacggcggtacggctaggtactttagttacgtgacctagtctacgtaataactaaactaaagtaaacttaaacgtacggtttagggtcggtttacgggaccgggaccgggtaaacccaaccgttcggaaccccgttccgtaacgtccgacggaccccgaagggtcccgttaccggtacccccgtttcggaccctaccgttcccttcccggttccccttaccccc

SEQ ID NO: 252190 - DNA, 627 bp, Homo sapiens
  misc_feature: GYAE6OF01AR3F6.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcactggaaccacaatgacgttgtacttatattctgtctcctggtaccaacaactaccccggcaaacgtccccaaactcatgatctttgagtcagtgatcggcccgcgtacggggtttctctactcgtcttccgtcccggtctcccgaagttcgtcggcacggccaccgggtcccttccccgtacggtaccctacttccgttcgtcggggcccttcccgagggtctacggacgggacgaggtctagtatttactacgtgcagtcctacataactaacaaactaattaaacgacgtttacgggtgttaccgggacgggtaccggaacctaaacgtcgtaccgtccgtacgccgtacggacccgacggccgtccgacccccgtcggtaccaccttccgtccgtcccctaccccg

SEQ ID NO: 252191 - DNA, 709 bp, Homo sapiens
  misc_feature: GYAE6OF01DJNJ9.49.35.D02.1.454.CMB.1.raw
  modified_base (258)..(258): a, c, t, g, unknown or other
  misc_feature (258)..(258): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctcgccctgactcagcctgcctccgtgtctgggtctcgtggacagtcgatcaccatctcctgcactagaaaccagcagtgatgtaggaattataaccttttcnctagtaccaacaacaccagacaaacgaccccaaancatnaatttanagcggaccgatacagcgccctgacgggtctctagactccgcttctcgtggctaccgagtctggacacgccgtacgccctacccgtagaactaacttcgtaccgtcgggtacctcccgaagggtccgtagggggaaccgtagggaccgttagttaaagttttaacttttaaggtttggtacctttacggtttaccaagtttacgtaccggtacggttacgggtaaagttacggggttggtaacccgggtaaaggggttcgggtttacggggaaccgggtaacggggtaaacgaaaacggggttccggtaaaccccggttacggtacgggttaacccgaaccggtaccccggaaaacgggtcccgttacccggcccccccgtttacggtcccgtaccgtttaccccg

SEQ ID NO: 252192 - DNA, 719 bp, Homo sapiens
  misc_feature: GYAE6OF01B3QNP.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaaccacaatgacgttgtacttatattctgtctctgtaccaacaactacccggacaaacgtcccaaactcatgatctttgaggtcagtgacgtcggccgacgtagggtttctctatcgcttctccggctcctaagtcgtggcacgccgaccggccctcccgtcgacctacgttccgtcgtcgggcctcccgaggtccgtagggaacgggtaaccggtacggtcttaggtaactttacgtttacgtacggaccgtacggtaccttactaacgttaaactaaaccgtaaaactaaacgttaaaccgttacgggttttaggggttaccggtttacgggacccgggtacgggaaaacccgtaaaccgttcggtaaccccgttaccgtaaccggttaccgaaccggtaacccggtaaccgggtcccgttaccccggacccccccgtttaccgggtaccttaaccccggtttcccgttccccggtttaccccccgttccccccg

SEQ ID NO: 252193 - DNA, 620 bp, Homo sapiens
  misc_feature: GYAE6OF01AVTMW.49.35.D02.1.454.CMB.1.raw
  modified_base (479)..(479): a, c, t, g, unknown or other
  misc_feature (479)..(479): n is a, c, g, or t
  modified_base (578)..(578): a, c, t, g, unknown or other
  misc_feature (578)..(578): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaggtctcctgcaaggcttcgtggacgacaccgttcaactaactttgctgtcagtcgtgggtgcgacgacggccccgtggacaacggtccttaggaggtggggtgggaacggactccgaacccccttattacccgttaatacgtagacaaactatacgacacagtaacctacttaccacgacaacgacgtcctaacccttagtccgacggtaaccaactaccccaacgaaccgaccgtaacgtaccctaacnctaacgggaactcggaccgacgacgacctacggtactccgacggacccgaaccgtaccgggtccttaagtctttacgtgtggacgagtacgagtagttnttactttcgtatacggtaattacgtagttacgtatattgtac

SEQ ID NO: 252194 - DNA, 657 bp, Homo sapiens
  misc_feature: GYAE6OF01EO147.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctcctggtaccaacaactaccccggacaaacgtccccaaactcatgatctttgaggtcagtgactccggcccgcgtacggggtttctcatcgcttcgtccggctccgaagtctggcacgcaccggcctcccgtgacctactctcgtcgggcctccgacggtctaggacgggacggaggctagtactttacttacgtgcgacgtctacgaataactaacaaactaacttaaaaccgtacggtttaggggttacggttccggggaccgggtaccgggaaacccgtaaacgtaccggtaacccgtacccgttaaccggtaccgaaccggtaccccgtaaacgggcccttacccggccccccgttacggtaccctacccgttcccgttcccgttccccctaccccccg

SEQ ID NO: 252195 - DNA, 682 bp, Homo sapiens
  misc_feature: GYAE6OF01COHXS.49.35.D02.1.454.CMB.1.raw
  modified_base (339)..(339): a, c, t, g, unknown or other
  misc_feature (339)..(339): n is a, c, g, or t
  modified_base (383)..(383): a, c, t, g, unknown or other
  misc_feature (383)..(383): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatctcctgcactcggaaccacaatgacgttgtacttataattctgtctctcgtacaacaactacccggacaaacgtacccaaactcatgtattcttgagtcagtgacgtcggcccgcgtagggtttcncatcgtcttctccggctccaagtctggcagccgacggccctccncgacctatctcgtcgggcctcgacggtccgtggaacgggacgaggtcgtagtaatttaagttaacgtcgacgaggtacctacctaattaaactaaaccaaaaacgtaaacttaaaaccgtacggtttacgggggttacggtttcggggacccggggtaccggggtaaacccaaaaccggttccggaaaccccggttaccgtaacccggttccgaacggaccccgaaacgggtcccgtaccccggtccccccgtaccgggtaccctaccgttcccgttcccggttcccccttaacccccc

SEQ ID NO: 252196 - DNA, 663 bp, Homo sapiens
  misc_feature: GYAE6OF01ACCX3.49.35.D02.1.454.CMB.1.raw
  modified_base (207)..(207): a, c, t, g, unknown or other
  misc_feature (207)..(207): n is a, c, g, or t
  modified_base (332)..(332): a, c, t, g, unknown or other
  misc_feature (332)..(332): n is a, c, g, or t
  modified_base (381)..(381): a, c, t, g, unknown or other
  misc_feature (381)..(381): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctctcactcagggcacagggtcctgggcccagtctgccctgactcagcctgcctcgtgtctgggtctctggacagtcgatcaccntctcctgcactggaaccacatgacgttgtacttatatctgtctctggtaccaacaactacccggacaaacgtcccaactcaatgactctttgagtcagtgagtccggccgtcgtacggggtttcncgatccgcttcgtccggctccgaagtctggcacgcaccggcctcccgtnacctactctcgtcgggcctccgaggctaggacggacgtacggcgttagtactttacgttaactcgactagtcctacgtaactacgtaaacctaaacgaacttaaaccggtacgttttacggggttacggtttccggggaccgggacgggtaaccctaaacgtccggtacccggttaacccgtacggtacccgaacgggtaccccgaacgggtcccgttacccggtccccccggttacggttacccgtaacccgtttcgttcccggtttcccccgttcccccg

SEQ ID NO: 252197 - DNA, 756 bp, Homo sapiens
  misc_feature: GYAE6OF01BJUPG.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatcaccatcctctgcactggaaccacaatgtacgttgtacttatattctgtctctggtaccaacaactacccggacaaacgtacccaaactcatgtacttcgtttgacggtcagtgacgtccggcccgtcgtacgggttttcctctacgtccggtccttccgtccggtacctaccgtaacgtcgtcggacacggcctaccggtccctcccgtacgaccctactccgttcgtcggggtcccttaccggaggtaccgttacgggaacgggtacggaaacggttcgtacggtaacttttaagttaccgtacgtcgtaacgtccttaacgtaattaaaccgtaaaccgaaaacttaacttaaacccgttacgggtttcggggtttaaccggttccggggtaaccgggtaacccgggtaaaccctaaaccggttccggtaaccccggtttacccgtaccgtaccgtacccggaccccggtaacgggtccctaccccgtacccccggttacccgggtaccttaacccgtttaccccgttcccgttaccccccgttaccccc

SEQ ID NO: 252198 - DNA, 538 bp, Homo sapiens
  misc_feature: GYAE6OF01A4NLJ.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattatactgcagctcatataacaaacataaacacgttgggtgttcggcggcgggaaccaacgtgaccgtcctacgtccagcccaaggcctcgccccccgtcggtccacctctcgttcccctaccccg

SEQ ID NO: 252199 - DNA, 651 bp, Homo sapiens
  misc_feature: GYAE6OF01CUCAJ.49.35.D02.1.454.CMB.1.raw
  modified_base (369)..(369): a, c, t, g, unknown or other
  misc_feature (369)..(369): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccaccaatggacgtttggtacttataattctgtctcctggtaccaacaactacccggacaaacgtccccaaactcatgacttctttgaggtcagtgactccgggccgcgtacgggtttctcatcgcttctccggctacagtcnggcacgcacggtcctcccgtgaccctatctcgtcggtctccgaggctaggacgggacgtagggcttaggtactttataccgtcgactagccttacaatttaacgtaaacaaaccgtaacttaaaaccgttacgggtttacggggttcggtttaccgggccgggaccgggttaaaccctaacggttaccgtacccggttaccgtaacgtccgaaccgtaccccggaagggtccctcccggtacccccgtcgtacctaccctccggttcccgttccccgtcccc

SEQ ID NO: 252200 - DNA, 784 bp, Homo sapiens
  misc_feature: GYAE6OF01EL7KH.49.35.D02.1.454.CMB.1.raw
  modified_base (583)..(583): a, c, t, g, unknown or other
  misc_feature (583)..(583): n is a, c, g, or t
  modified_base (681)..(681): a, c, t, g, unknown or other
  misc_feature (681)..(681): n is a, c, g, or t
tcagagtcgagagacacgaccggtgctcgatttagcacacgatagttgggtttgggggcatcacataacaaccagattcctcctctaaagaacgcccctgggagcacagctcatcaccatggactggacctggaggttcctctttgtggtggcagcagctacgaggtcgcccgacggtccccgggtccagcgtggtcgacaagtcgtggggtctggaggtggaagaacgccgtgggtcggtcgggtaggaacggttcctccgtgacgtaaggtccgttcgtggacgtacctaccttacaacttacgtttgcgtgtacgagtcgtgggtcgaccgacgtaccggtccccgtaggaaccgtaacgggtccgttaggtagggtaggggtagggtaacggtaccttacccgtaacccttacgttaccgttaaacgtaacgtaacgtaaccgtaaacgtacgtacaacgtaaccgtaacgacgtaccttaaccgaacgaacgtaacgtaccgtacctaacccgttacgacccgggtaaccgtaaacctaaacctccccgaaagaaccctacgaaccgtccgtaaacgngttaaccggaactggacccgtaacgtaacggtccccgtaaggacttcccggaccggaaccccgaacggttaccgggttaccttaaatttccggtttancgggttagaccgggtaaacggagtttcgtcctttttaggttccctttaagtaaggtacctttaacgtttaacgaaccggtttattacgttaaagtttcgtacg

SEQ ID NO: 252201 - DNA, 597 bp, Homo sapiens
  misc_feature: GYAE6OF01EOPM1.49.35.D02.1.454.CMB.1.raw
  modified_base (337)..(337): a, c, t, g, unknown or other
  misc_feature (337)..(337): n is a, c, g, or t
  modified_base (564)..(564): a, c, t, g, unknown or other
  misc_feature (564)..(564): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctcctgtaccaacaactaccccggacaaacgtaccccaaactcatgatctttgaggtcagtgatcggcccgcgtaggggtttcncatcgtcttctccggtctccaagtctcggcagccgaccggccctcccgtgaccactcgtcgtcggggtccttaccgaggtcgtcggaacgggtacgaggtccgtaggtaactttacttacgtcgacgtagtcctactaatacgtaaacaaactaactaaactacgttgggtcgttcggacgggacggtaaccaacgtcgaccgttactacgtcacgtccaaggtccncgcccctggtcctactcctcgtcccctaccccg

SEQ ID NO: 252202 - DNA, 602 bp, Homo sapiens
  misc_feature: GYAE6OF01C1UC9.49.35.D02.1.454.CMB.1.raw
  modified_base (340)..(340): a, c, t, g, unknown or other
  misc_feature (340)..(340): n is a, c, g, or t
  modified_base (471)..(471): a, c, t, g, unknown or other
  misc_feature (471)..(471): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctcgcctccgtgtctgggtctccgtggacagtcgatcacatctcctgcactagaaccacaatgacgttgtacttataattctgtctctaggtaccaacaactaccccggacaaacgtcccaaactcatgtatctttagaggtcagtgactccggccgcgtagggtttcnctatccggtcttccgtccggtctaccaaagttcgtcggacagccacgcccttcctcgaccatcctcgtcgggtcctcgaggcgtaggaggacggagcgtgttaattaacttactggacacgtactactaanaattaaacaaaacgaactaaacgtacgttgggtacgttcgggacgggaccggaaccaacgtcgaccgtcctacgtaccacgaccgaacggcctccgccccgtcgtaccacttccgtcgttccccgtacccc

SEQ ID NO: 252203 - DNA, 719 bp, Homo sapiens
  misc_feature: GYAE6OF01CTUV3.49.35.D02.1.454.CMB.1.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcngcactggaaaccncaatcgacgttgacttataattctgtctctcggtaccaacaactacccggacaaacgtaccccaaatcgatgacttctttgagtcagtcagtccggccgcgtagggtttctcgtactcggtcttcgtccggctacgaagttcgtggacgcgtacaccggccttacccgcgacctacgttccgtacgtcgggtccaccggtacggccgttagggaacgggtacggtaacggcgttacggtaatttaacgtttacgcggacctacggtacctctaaactaacgtaaacctaaactaaccgttaaaccgtacggtttacggggtcggttaacccgggtagggacccgggtaaaccctaaacgttcccggaaacccggttccgttaaacccggttccgaaccgggtacccgaaacggttcccgtacccccggaccccctttaaccggggtaccttaaccccggtttcgttacccggttcccccgttaccccccg

SEQ ID NO: 252204 - DNA, 677 bp, Homo sapiens
  misc_feature: GYAE6OF01BVBF2.49.35.D02.1.454.CMB.1.raw
  modified_base (214)..(214): a, c, t, g, unknown or other
  misc_feature (214)..(214): n is a, c, g, or t
tcagagtcgagagacacgaccggtgctcgatttagcacacgataggttggggtttggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatcncctgcacgtggaaccacctaatgacgttggtacttatacttctgtctcgtaggtaaccaactaactacccggacaaacgtaccccaaactctatacgaacttcgttggaacggtctaaggtgacgtccggcccggtgtacggggtttcctacgtactccgtcttccgtccggtctccgaagtctcgggacaaggtccgaccggtccctcccgtagacctacgtcctcggtacgggtctccggacggccgtggtacggacggtaggctagtaagttattacgtacggactaacggtctactaactaacgtaacaaactaactaaacgtcggtttgggttaacggttccggacgggtaccggtaacctaacggtccgtaacccgtccgtaccgtacgttacgacccgtacggccccgtacccgcccccgtggtaccgtacccgttccgttcctccccgtaccccg

SEQ ID NO: 252205 - DNA, 771 bp, Homo sapiens
  misc_feature: GYAE6OF01DF1N2.49.35.D02.1.454.CMB.1.raw
tcagagtcgagagacacgaccggtgctcgatttagcacacgatagttgggtttgggggcatcacataacaaccagattcctcctctaaagaagccccctgggagcacagctcatcaccatggactggacctggaggttcctctttgtggtggcagcagctacaggtgcccagtcccgggtccagctggtgcaatctggggctgaggtgagaagcctgggtcgtcggtgaaggtctcctgcaaggtcttcgtggacgactacccttcaactaactttgctgtcagtcgtgggtgcgacgacggccccgtggaacaacggtccgttaggagggtgggggtaggaacggaccttacccgaacccccttattaccttaaagttacgtaacgactaaaacgttgtacgacaacacgaacctacttacccgacgtaacgaaggtacttaccctaaccccttagtacccggaccggaaccaaacgtacccgaaacgtaaaccaccgaacgtccctaacaacgtacgggaaaccgtcgaccgtacgtaaccggtacccgtaaggacttccgtaaccggaccccggtaacccggtaacccgggtacccgttttaagttttaaccgttttccggtacggttaccgggaaccgggtaaagggtaacggtacggtttaaacgtttcgggtttttacccctttttaaacgttaacggtttacggtaaacgttttaaaccggttaaacgtttaccggtttaaactaacgtttttaagttacccgg

SEQ ID NO: 252206 - DNA, 848 bp, Homo sapiens
  misc_feature: GYAE6OF01EK7AJ.49.35.D02.1.454.CMB.1.raw
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccacaatgacttgtacttatattctgtctctggtaccaacactacccggacaaagtccccaaatcatgattctttagagtcagtgactccggcccgngtaggggttttccncgtacttccgtctttaccgtccgggtcctacccgtaaaggttccgtacggaccgtacgtacccggtaccgggtcccccttaccccgtacggaaccccttacttcccgtttccggttacggggtacccctcccgtaacgggccgtttagggaaccgggtacgggtaacgggtcttacggttaaactttaacggttttaccgtacggacccgtaacggtaccttaaccgttaaattaaaccctaaacccggtaaaaacttaaacgttaaaaacccggttaccggggttttacggggggtttaccggtttacccggggggaacccggggttaaccccgggggttaaaaccccaaaaaccgggtttcccgggtaaaccccggtttacccccttaaacggggttaccccgtaaaccgggaaccccccgtaaggggttcccccggtacccggttacccccccggttacgggttacccctaaccgtttcccgttaccccgttaccccccttaccccccgg

SEQ ID NO: 252207 - DNA, 654 bp, Homo sapiens
  misc_feature: GYAE6OF01DF9LP.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttccttctttgtggtggcagcagctacaggtgcccagtcccgggtccagctggtgcaatcgtgggctggaggtgagaaagccgtgggtcgtcggtagaggtctcgtgacgaggtcttcgtggacgacctaccttacaactactttgctgtcagtcgtgggtcgcgacgacggtccccgtaggacgacggtccgttaggagggtggggtagggaagacgtacccgtaccccttacttacctttaataacgtacgaactaaactagtacgactaacgagtactacttaccgacgacgagacgttaccctaccgtttacgaccggaaccgaactaaaccgtccgaaaccgaaaccaacgaaccgaccttaacgacgttaccggaactccggaccacgacgtaccgtagacgttcacggcccacgtacggtaaccttatttacgttcagggtcgagagtagacgttagtttccgttacttacgtagttaggtaattaccgtacttagttacttagttgttccg

SEQ ID NO: 252208 - DNA, 708 bp, Homo sapiens
  misc_feature: GYAE6OF01ED6A6.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctgtacaacaactacccggacaacgtcccaactcatgatctttgaggtcagtgatccggccgcgtagggtttctcactcgtcttcgtccggtctccgaagtcgtcgcacgccgaccggccctccctcgaccactcctcgtcgggcctccgaggcgtggacgggacggaggtcgttagtattactttacgtgacagtcctactattaactaacaaaactaacttaaacccgtacggtttacggggttccgggttaccggggtaccgggtacccggggtaaaccctaaaaccggttcccggtaaccccggttacccgttaacccggttcccggtaaacccggtacccccggtaaacgggtcccccgttccccggtaccccccccggttacccgggttaccctaacccccgttttcccggtttacccccgttcccccccgttaccccccccg

SEQ ID NO: 252209 - DNA, 732 bp, Homo sapiens
  misc_feature: GYAE6OF01EKQNB.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcaggacacagggtcctgggcccagtctgccctgactcagcctgcctccgtgtctgggtctccgtggacagtcgatcaccatctcctgcactacgaaccacatgtacgttgtacttatattctgtctccgtagtaccaacaaccgtaccccggacaaacgtacccaaactcatgtacttcgtttagacggtcgtagtcggtacgtccggcccggtcgttacgggtttctacgtacgttccgtccgtttcccgtccggtaccttaccgaacgttcgtacggacacggccgtacccggtccccttaccccgacgtaacccgtacgttccgtcggtcgggtaccctacccggtacgggtaccgtaggggtaacgggtacggtacggtcgttaacgttaagtttacctttacgtcgactacgtaccttacgtaactaactaaactaaacctaacgttaaaccgtacgggtttagggtaccggttcgggaccgggtaacccggtaaaccgaaccgttaccggtacccgtacgtaaccgtcgaccgacccgtacgtccccgtacccgtccccgtcgtacctaccgttcccttcccgtccccgttaccc

SEQ ID NO: 252210 - DNA, 705 bp, Homo sapiens
  misc_feature: GYAE6OF01CU76R.49.35.D02.1.454.CMB.1.raw
  modified_base (228)..(228): a, c, t, g, unknown or other
  misc_feature (228)..(228): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctctcactcagggcacagggtcctgggcccagtctgccctgactcagcctgcctccgtgtctgggtcctcctggacagtcgatcaccatctcctgcactggaaccncaatgacgttgtacttatattctgtctcctggtaccaacaactacccggacaaacgtcccaaactcatcgattctttagagtcagtcgactccggcccgtcgtacgggtttctcagtccgtcttccgtccggtcctaccgaacgttctcggcacgccaccggtccctccctagacctacttcgtccgtcgggtacctccggtacggcgttacggaacggacggtacgggtccttagtaacgtttaacttaacggttcgacgtacgaccttaacgaacttaaacttaaaccgaaaaactaaacgtaaaaccgttacggtttaggggttacggttaccggggtaccggggtaccgggtaaacccgtaaaacggtaccgacccgttacccgtaacggttaccgaccgtaacccggtaaccggtccgtcccggtacccccgttcgttaccctaccgtttccttcccgttcccccgtacccc

SEQ ID NO: 252211 - DNA, 682 bp, Homo sapiens
  misc_feature: GYAE6OF01A1HDC.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggcagtcgatcaccatctcctgcactggaaccacaatgacgttgtacttataattctgtctcctggtaccaacaactaccccggacaaacgtccccaaactcatgacttctttgaggtcagtgactcggcccgtcgaggggtttctctatccgtcttcctccggtctaccgaacgtctcggcacgtccgaccggccctccccgtgaccctatcctccgtgggtcctccgacggctaggagggaacggtggcctagtactttacttacgtcgcgtacgtctacgtaataactaaacaaacctaaactaaaccgttaacggtttggggtacggtttacggggaccgggtaccggaaacccgtaaccgtacggtaacccgttcccgtaacggtacccgaacggacccccgtaaacgggtccgtaccccggtaccccccgtacgggttacccctacccgttcccgtttcccggttaccccccgttccccccg

SEQ ID NO: 252212 - DNA, 960 bp, Homo sapiens
  misc_feature: GYAE6OF01DN8AL.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacgagggtcctgggcccagtctgccctgactcagcctcgcctccgtgtcgtcgggtctccgtggactagtcgactcaccatctccgtgcacgtacggaaccacaatcggacggtttagttactttaattaattccgttgttcctacccgttacggtaaccaaactaaaccgtaccccggaacaaaccgtaccccctaaactcatagtacttcgtttaggagtacgagtacgacgtcccggccggtacgtagggttcctctatccgtccttccggtccggtcctaccgtaacgttcgtacggaccgtacgacccggtaccgtccccttacccgtacgtaacccgtccgttccgttccggtccgggggtacccccttacgaaaccgggggtcgtacggggggaaacgggtaaccgggtaaccggggttattaaccgggttttaaagttttaacccttaacgggttcgtaaccgggtaccctacgttaaccttaaattaaaacccgttaaaaccgtaaaaacccttaaaaacgttttaaacccgggttaacgggggttttaccggggttttacccggggtacccgggggaccccgggggtaaacccgggggtaaaaacccccttaaaccgggttaccccgggttaaacccgggttacccccgttaaccccggttaaagggaaccccccgggtaaaccccgttaaacggggtcccccccccggttaaccccgggttacccccccgggtttacccggggttttaaaccccctcccggtttaccccccgggtttttacccccgtttacccccccccctttaaacccccgg

SEQ ID NO: 252213 - DNA, 764 bp, Homo sapiens
  misc_feature: GYAE6OF01E1XT9.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactgaaccacaatgtacgttgtacttatattctgtctcctggtaaccaacaactacccggacaaacgtacccaaactcatagacttcttggacgtcagtgtacgtccggccgtacggtacgggtttctacgtacgttccgtcttccgtccggtactacctaacggtcgtacggacgacgtaccgtacccggtccctacccgtacgtacctacgttccgttcggtacgggtcctaccggaggtcgtagggaacgggacggtaacggtcgttagttaactttacgttaccgtacggaccgtacgtacgtaactaagttaaactaaaccgtaaaagtaaaccgttaaacggttaccgggtttacgggggttacggttacccggggtaccggggtaacccggtaaaccgtaaaaccgttccgggttaaaccccgtacccgttaaccggtacccggaacccggttaacccggtaaccgggtcccgtacccccggtcccccgttacggtaccccttaccgttcccgtttacccccgttaccccgttacccccg

SEQ ID NO: 252214 - DNA, 698 bp, Homo sapiens
  misc_feature: GYAE6OF01BWV4G.49.35.D02.1.454.CMB.1.raw
  modified_base (200)..(200): a, c, t, g, unknown or other
  misc_feature (200)..(200): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacngtcatcaccatctctgcactgaaccacatgacgttgtacttatattctgtctccgtggtacaacaactaccccggacaaacgtaccccaaactcatagacttcgtttgaggtcagtggacgtccggcccgcgtaggggtttctcgtacgtccgcttcgtccggtctccaacgtcgtggacacgccgacggccctcccgtacgacctactcgtcgtcggtcctccggacggtcgtacgggacgggacggacggtcgttagtaaactttacgttacgtcggacacggtacctctaataactaaacaaaactaacttaaacgtacgttacggggttcggttaccggggacgggtacccgggaaaccgttaaacgtaccgtaacccggttacccgtaaccggtacgaacccggtacccggtaaaccggacccgttcccccggtacccccgttaccgggtaccctaaccctttcccggttccccgttcccccttaaccccccg

SEQ ID NO: 252215 - DNA, 922 bp, Homo sapiens
  misc_feature: GYAE6OF01BXZVS.49.35.D02.1.454.CMB.1.raw
  modified_base (723)..(723): a, c, t, g, unknown or other
  misc_feature (723)..(723): n is a, c, g, or t
tcagagtcgagagacacgaccggtgctcgatttagcacacgataggttggggtttgggggggggtctcaggaggcagcgctctcgggacgtctccacatggcctgggctctgctattcctcaccctcctcactcagggcacgacgggtcctgggccctagtctcgccctgactcgagcctgcctccgtgtcgtcgggtcctccgtgggacagtcgatcgacctactcgtacctgacctaacgtacgggaaacctaacctaagttcggtaacggtttacggtaacctttaattaacgttcgtacgttccgttaccgttaacggtaaaccctaaacgtaaccggtacccccggaactaaaacccggttaccccaaaacgttccgaattacgtacgttttaccgtttagggaaacggtttcgaaacgggttacggtccggttacccggggaccccggttacgggtttacgggggtttaccctacgtaaccggttcccggtaccgtttccgggtacccgggtaccttaaccgtaacgggtttcgtacggaccggtaaccggtaccggtaacccggtccccttaccgtaacggtaccctaatccgggttaaccgtccggggtaacctccgggtacgggtaccgttaaggggaaccgggtacggtaacggttaccgttaagttaaccgtttacgtaccgttacggaaaccgtcgtaacctaaccttaanaaacccgtaaacaacttaaacgtacgttaacggggttccgggtacgggtcgggaccgggtaacccggtaaactaaccgggtcctaaccgggttaccctaaaccgggtcctaacccgggtaacccacggggttcccgtcccccggttacccggttacgttacccgtaacgttcccccggtttccggacccccctttcccg

SEQ ID NO: 252216 - DNA, 529 bp, Homo sapiens
  misc_feature: GYAE6OF01DQHBN.49.35.D02.1.454.CMB.1.raw
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (399)..(399): a, c, t, g, unknown or other
  misc_feature (399)..(399): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctctggtaccaacaataccccggcaaagtccccaaactcatgatctttgaggtcagtgatcggcccncagggtttcncatcgcttctccggctccaagtctggcagcacggcctcctgaccatctctggctccaggctgaggacgnggactgatttatactgcagctcatataacaaactactaaacgtcgttgggtagttcggcggcgggaaccaacgtcgacccgtcacgtcacgcccaaggcctcgccccgtcgtacactctcgtccctaccc

SEQ ID NO: 252217 - DNA, 721 bp, Homo sapiens
  misc_feature: GYAE6OF01C0WZ2.49.35.D02.1.454.CMB.1.raw
  modified_base (252)..(252): a, c, t, g, unknown or other
  misc_feature (252)..(252): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccaccaatgacgttgtacttaatattcngtctcctaggtaaccaacaactaccccggacaaaacgtcccaaactcatgattctttagaggtcagtgacgtccggccgtcgtaggggtttctacgatccgtcgttctccggtctcccgtaagtcgtcggctaggccaaccggtccctcctacgaccctaattcccgtacgtcgggacccttccgagggtctagggaacggtacggtaggcttaaggtactttagtacctgacctagacctactaacttaataaaccaaaactaaacgttaaaaccgttacggttttagggggtacgttaccgggggtacgggaccgggtaaaaccctaaaaggttaccgaaccccggtttacccaaaccgggttccgaaacccggtaaccccgtaaaggggttccctaaccccgggtccccccgttaccggttaaccccttaccgtttacccgtcccggttccccccttaaacccccg

SEQ ID NO: 252218 - DNA, 892 bp, Homo sapiens
  misc_feature: GYAE6OF01E22Y3.49.35.D02.1.454.CMB.1.raw
tcagagtcgagagacacgaccggtgctcgatttagcacacgatagttggggtttgggggcatcacataacaaccagattcctcctctaaagaacgcccctgggagcacagctcatccaccatggactggacctggaggttcctctttgtggtggcagcagctacaggtcgcccgagtccccgggtacagcctggtgcatcgtggggctgaggtgagaaacgccgtggggtcgtacgggtagtaacggttctaccgtggacctaagggtccttcgtagggacggaccctacccttaccaaactaaccttttcggcctggtcagtcgtaggggtcgaccggaacaccgggtcccccgtagggaacccgtaaacgggtcccgtttagggtaacggggttcggggggtaacgggtaaacgggtacctttaccccgaaccccccgtttaaagtttaccccgtttaaaagtacgttaaccggaaccttaaaaccgttacgacgtaaccgtaacctaacgggaacccttaacgtttaccccgaaacgtaaccgtaacgggtaaccggttaaccccgtaaccccgttttaacggtaacccggtaacccgggtaaaacctaaaccgttaccccggaaaccgtaaaacctaacccgaaccggttacccctaaaccgaaccggttacgggaaccgttaccggaccggtaccgtaacggttacccgggttacggtaccgtaccggtacccggtaaccccggtacccgtacccggggttaccgtttaactttacggtttaccgtacggtaacgggccgtaaaaccgggtagtacggtacgttacgttccgtttacgtagttaccgtaagttacgttacctaggtttactacgtttagttacccgg

SEQ ID NO: 252219 - DNA, 660 bp, Homo sapiens
  misc_feature: GYAE6OF01DWFGW.49.35.D02.1.454.CMB.1.raw
  modified_base (331)..(331): a, c, t, g, unknown or other
  misc_feature (331)..(331): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccaccatgacgtttgtacttatattctgtctcctggtaccaacaactacccggcaaacgtcccaaactcatgatctttgagtcagtgatcggccgcgtagggtttcnctactcgtcttcgtccgtctaccaacgtctggcaacgtcaccggtcctcccgtacgaccctagtcttaccggtcgggtccttcccggaacggtcgtacggaacggacggaagggtccgtagtaaacgttttacgtttaacgttcggtacgacggtccttacgaattaacgtaaacaaactaaacttaaaccgtacgtttcgggttacggttccgggaccgggtaccgggtaaacctaaccgtacgtacccggttaccgtaccgtaccgacgaccccgaaggtccctccgtcccccgtggtaccctaccgtccttccgtcccctaccccg

SEQ ID NO: 252220 - DNA, 783 bp, Homo sapiens
  misc_feature: GYAE6OF01CT5CE.49.35.D02.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
tcagagtcgagagacacgaccggtgctcgatttagcacacgatagttggggtttggggggggtctcaggaggcagcgctctcgggacgtctccaccatggcctggctctgctattcctcaccctcctcactcagggcacgagggtcctgggcccagtctcgccctgactcagcctgcctccgtgtcgtggtcctcgtggacngtcgatcaccatcctctgactacgtacgaaccactagtcgtacgttgtacttatacttcgtntctcgtacgtaaccaacaaccgtacccggactaaaccgtacccaaacgtcctagtagtactttcgttacggaggtccgaggtcgacggtcccggaccgtacggttacgggtttccacgtcgtccgtccgttccgtccggtacctaccgaagtcgtcggacacgccgtaccggtccctacccgtacgtaacctacgttccgtacgggtccggtacccgttaccggacgggtccggttagggaaacccggggtacggtacggttaccgttaaggttaacctttacgtaccggtcgtaacccgtacgtacccttaacgtaaactttaaacccgtaaaactaaaaccgttaaaaccggtttaaaccggttacggggttttacgggggttacccggttacgggggtaacccgggtaaccgaaaccgtacgttaccggaacccgttcgtaacgccgtaacccgacgtaccggtccccgtacccgtcccgtaccttaccaccgtttcccgtccccttacccgtccc

SEQ ID NO: 252221 - DNA, 761 bp, Homo sapiens
  misc_feature: GYAE6OF01BRTCQ.49.35.D02.1.454.CMB.1.raw
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctctggacagtcgatcaccatctcctgcactggaaccaccaatgacgttggtacttataattctgtctccgtggtaccaacaacgtacccccggacaaacgtccccaaactcatgatctttgaggttcagtgatccggcccgtcgtacggggttttctcacgtccgtactttccgtcccggggtcctacccgtaacgtcgttcggcgtacggcccaccggggtcccccttaccccgtacgaccctacttacctcgtcggggtaccctccgacgggtcttacgggaacggggtaccggagggtccttaaggtaacttttacgttacgtggaccgtacgtccctacgtaacttacgtaaacaaaacctaacgttaaaaccgtaccgggttttagggggttacgttttacccgggggaccggggtacccgggtaaacccgtaaaaccgtcggtaaccccgttacccggttaaccgtacccgtacgggacccccgtaaagggtccccgttaccccgacccccccggtttcggttaccctacccgttcccgtttccccgttccccccgtacccccccg

SEQ ID NO: 252222 - DNA, 727 bp, Homo sapiens
  misc_feature: GYAE6OF01A9LAD.49.35.D02.1.454.CMB.1.raw
  modified_base (276)..(276): a, c, t, g, unknown or other
  misc_feature (276)..(276): n is a, c, g, or t
tcagagtcgagagacacgaccggtgctcgatttagcacacgatagttgggtttggggggggtctcaggaggcagcgctctcgggacgtctccaccatggcctggctcgtgctattcctcaccctcctcactcagggcacagggtcctgggcccagtctgccctgactcagcctgcctccgtgtctggtctcctggacagtcgaatcacatctctagcactggaaccacaagtgacgttgtacttatattctgtctctgtacaacaacgtacccganaaacgtcccaaactcatgattcgttgagtcagtacgacgtccggcccgtacggttacgggtttctacgtacgttccgttctttacccggtccggtacctaaccgtaaggttccggtacggacctaaaccggtccggtacccgttcccgtacggtaacccggttccgtaccgggtcgggtccggtaccggtacgttaacggaacgtacggtacggtaccgggttcgtaacgttaacgtttctttccggacgtaaccgtcggtaaccttacggtaactttcggacgaccgtacggactacggtaactaaacgttttaacgttttggacgttaacggttacggtcgggaccgggaacggtaaccctagggtacccgtacggttacccgtacggttaaccggtccacccgtaccggtaacggtccctcccggaccccggtttcgaccgtaccccg

SEQ ID NO: 252223 - DNA, 579 bp, Homo sapiens
  misc_feature: GYAE6OF01CBGNH.49.35.D02.1.454.CMB.1.raw
  modified_base (255)..(255): a, c, t, g, unknown or other
  misc_feature (255)..(255): n is a, c, g, or t
  modified_base (392)..(392): a, c, t, g, unknown or other
  misc_feature (392)..(392): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctgggctgaggtgagaagcctgggtcgtcggtgaaggtctcctgcaaggcttcgtggagacnccttcaactaactttgctgtcagctgggtgcgacacggcccctggacaggccttggagtggggtggaagactcaccctatccttaatatagacaaactatgcaacagacacttccacgacagactcctaacccttancgacggaaacaacttacccaacggaaacaccgaacgtccctaacactacggaaactcgaccgaccgacgacgtacggatccgacgcccggaacggtccgaccgttattacgtttcaggttgcgaggtacgagtacttaggttctttacgtacttaggtacttacgttagttagtcttaattgttacg

SEQ ID NO: 252224 - DNA, 685 bp, Homo sapiens
  misc_feature: GYAE6OF01A6L7B.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttatattctgtctctgtaccaacactacccggcaaacgtcccaactcatgatctttgagtcagtgagtccggcccgtcgtacggggtttctcgtacgttccgtctttccgtccggtcctaccgtaagttcgtggccacggaccgaccggccctacccgtcgacctacttccgtcgtcggggtcctacccggacggtcgtacgggacgggtacgacgggtcttaggtaactttaacgttacgtcgcgtacgtcctactaataactaacgtaaactaacttaacgtacggtttgggtacggttaccgggaccgggtaccggtaaaccgtaacgttaccggtacccggttacccgtacggtaccgtacggacccggtaacggcccgtacccgtaccccccgttcgggtacccttaccgttccttccccgttcccccgttaccccg

SEQ ID NO: 252225 - DNA, 769 bp, Homo sapiens
  misc_feature: GYAE6OF01A7OXA.49.35.D02.1.454.CMB.1.raw
tcagagtcgagagacacgaccggtgctcgatttagcacacgatagttggggtttggggggggtctcaggaggcagcgctctcgggacgtctccaccatggcctggctcctgctattccctccaccctcctcactcagggcacagggtcctgggcccagtctgccctgactcagcctgccctccgtgtctgggtctcctggacagtcgatcaccatctcctgcactggaaccacaatcgacgttaggtacttataacttctgtctctggtaccaacaactacccggcaaacgtccccaaactcatcgtatcttgaggtcagtgagtcggcccgcgtacggggtttctcagtccgtcttcctccgggtcctaccgtaacgtccgtaggccacggtcctaaccgggtcccctccccgttacggaccctaacgttccgtccggtcggggtccctacccggacgggccgtaggacgggtaacccgagggtcctaggtaatttacgttacgtcgacgtacgtcctactaacttaacgtaaacgtaaacgtaaacttaaaaccgtacgggttttacggggttacgggtttacccggggaccgggggtaaccgggtaaacccctaaaacggttccggtaaccccgggttacccgttaacccggtaccgtaacgggaacccccggtaaacggggaccccgttacccgggtcccccccggtttacccgggtacccttaaccccgttcggtttcccccggtttccccccgttaccccccc

SEQ ID NO: 252226 - DNA, 604 bp, Homo sapiens
  misc_feature: GYAE6OF01BKR25.49.35.D02.1.454.CMB.1.raw
  modified_base (508)..(508): a, c, t, g, unknown or other
  misc_feature (508)..(508): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatcgtggggctgaggtgagaaagcctgggtcgtcggtgaaggtctcctgcaaggcttctggagacaccttcaacaactttgctgtcagctgggtgcgacacggcccctggacaacggccgttggaggtggggtgggaaggatccgaccccgtataccttaatatagactaaactatgcacagacattcccagacagacgtaccacccttagtcgacgacaactccaacgaacacacgcctaacagtaggaacctgcgcacgtaccgtaggactcgtacggacccgacgtaccgggacctttaacgttacgttttcgnggttcgacggtaaggtaacggtaggtacgtttcggttacttttccgtaagtagtaacgttaaggtttaacccttaagttccttaagttttgtacgg

SEQ ID NO: 252227 - DNA, 652 bp, Homo sapiens
  misc_feature: GYAE6OF01EVDZL.49.35.D02.1.454.CMB.1.raw
  modified_base (446)..(446): a, c, t, g, unknown or other
  misc_feature (446)..(446): n is a, c, g, or t
  modified_base (472)..(472): a, c, t, g, unknown or other
  misc_feature (472)..(472): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaatcaccaatgacgttgtacttataattctgtctctggtaccaacaactacccggacaaacgtccccaaactcatgatctttgaggtcagtgacgtccggcccgcgtacggggtttctcgtagtccgtccttcctccggcctccgaagtcctggcagccaccgggtcccctcccgtcgacctactcgtcgtgggcctcccgagggtcgtagggacggacggnggtactgtaatttattaccgtcgacncgtctactaagtaactaaactaaaactaacgtaaacctacggtttagggttacggttccggggaccgggtaccgggaaacccgtaaaccgtccgtaacccgttccgtaccggtacacggaccccgtaacgggcctcccggtcccccgttcggtacccaccgttcccgtccgttacccccc

SEQ ID NO: 252228 - DNA, 677 bp, Homo sapiens
  misc_feature: GYAE6OF01DYGMU.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccaccaatgacgttgtacttatattctgtctctggtaccaacaactaccccggcaaacgtaccccaaactcatgatctttgaggtcagtgatcggcccgtcgtacggggtttctcatcgtcttcgtcccgctccaagtctggccagccaccggtccctccctcgaccctatccgtcgtcggggtcctcccgaggtccgtgggaacgggaccggaggtcgttgtaagtttactttaaccgtcgaccgtacgaccttactaacttaaactaacaaaacctaacttaaaccgtacggttttagggttcggttacggggaccgggaccgggaacccgtaaaccgtccggtacccgttaccgttaccggtaccgaaccggacccgacgggtacccgtcccggtccccccgtaccggttaccctaccgtttcccgtcccgttccccccgtcccccg

SEQ ID NO: 252229 - DNA, 769 bp, Homo sapiens
  misc_feature: GYAE6OF01APUM7.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgcactggaaccacatcgtacgttgtacttatattctgtctctgtaccaacaactacccggacaaacgtcccaaactcatagatctttgaggtcagtcgacgtccggcccgtcgtacgggtttctctacgtccgtccttaccgtccggtacctaccgtaacgttccgtaggaccacggacccgaccggtcccctcccgtaccgtacccgtactccgttccggtccgggtacctaccggtacgggtccgtacgggaacgggaccggtacggtccttagggttaacttttacgttaaccgtcggtaccgacgtaccttaacgtaacttaaaccgtaaaacctaaaaccttaaacgttaaaccggttacggtttacggggttaccggttaccggggaccggggtaacccgggtaaaccctaaaccggttaccggtaaccccggttacccgttaaccgtaaccggtaccgaacccgggtacggtaccccgttaccccggtcccccggttaccggttacctacccggtttcccgttcccgttaccccccgttccccg

SEQ ID NO: 252230 - DNA, 725 bp, Homo sapiens
  misc_feature: GYAE6OF01CEYZ6.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctcgccctgactcagcctgcctccgtgtctgggtctcctggatagtcgatcaccatctcctgcactgaaccacaatgacgttgtacttataattctgtctctgtaccaacaatactccggacaaacgtaccccaaactcatgattcttgagtcagtgagtccggccgtcgtacgggtttctacgtacttcgtcgttcctccggctaccgtaagtcgtcggactacgcctaccggtccctccctagaccctagttctccgtcgggccctaccgacggtcgtagggaacggacggacgtcgttagtaacgtttattacctgtaccgagtacctactaacttaactaaaccgtaaaacctaaattaaaccgttacgtttacgggggtttaccgggtttaccgggggacccgggtaacccgggtaaacccgtaaaacggttacccggtaaccccgttaacccggttaccggttaaccgtaacccggaccccggtaaacggtccccgttaccccggtaccccccggttaccgggtaccctaccccgttaccggttcccggttaccccccccgg

SEQ ID NO: 252231 - DNA, 877 bp, Homo sapiens
  misc_feature: GYAE6OF01C18KN.49.35.D02.1.454.CMB.1.raw
  modified_base (259)..(259): a, c, t, g, unknown or other
  misc_feature (259)..(259): n is a, c, g, or t
  modified_base (356)..(356): a, c, t, g, unknown or other
  misc_feature (356)..(356): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtgacagtcgatccaccatctcctgcactcggaaccaccaatcgtacgttgttacttaattattctntctcctaggtaccaacaactaccccgacgaaacctaccccaaactccatcgtattcgtttgaggtcagtgacgtccggtaccgtcgtacgggtttcnctagtccgtccttcgtaccggcctcctaacgtctcggcacgccgaccgtccctcccgtacgacctacttccgttcggtcggtaccgttccccggacgggtaccgttcgggaaaccgggcggtaacgggtccctttaaggtaacttttacggttaaccgtcgtaccggtaccgtccgttaaactaacgtttaaccgtaaaaacctaaaaccgttaaaccgtttaaaacccggttaaccggggttttttcggggggggtaaccgggttttcccggggaaaccccgggggttaaccgggtaaaaccccccgtaaaaccgggtttacccccgggaaaccccccggtttaccggttaaacccccggggtcctaaaacccccgggggttaaccccccgtaaacgggttcccccgttaacccccccccggggttacccccggtttacccgggtttaaaccccccttttaacccccggttcccccgggtttaaccccccggttcccccccccccgggtttttaaccccc

SEQ ID NO: 252232 - DNA, 781 bp, Homo sapiens
  misc_feature: GYAE6OF01EIKGF.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctctgtaccaacaactaccccggacaaacgtaccccaaactcatgtattctttggaggtcaggtgacgtccggccccgtcgtacggggtttctcgtacttccgtctttccgtcccggtcctacccgaacgttcgtcggcacggccgtacccggtccctcccgtacgaaccctacgttccttcggtcgggtcctacccgacgggtccgtagggaacgggtacggacgggtacgttacggttaattttaacgtttacgtacggactacgtccttaacgtaaattaactaaacctaaaacctaaacgttaaaaccgtacgggttttaggggttcgggtttaccggggaccggggtacccgggaaacccgttaaaccggtaccggtaaccccggttacccgttaaccgggtacccgtaacccggtaaccccggtaaaccgggtccccgtaccccggtacccccccgggttaccggttaccctaaccccgttttaccccgttccccgttacccccccgttacccccccg

SEQ ID NO: 252233 - DNA, 894 bp, Homo sapiens
  misc_feature: GYAE6OF01A1JDL.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacgagggtcctgggcccagtctgccctgactcacgcctgcctcgtgtcgtgggtctcctggacagtcgactccaacctagttcctcctgacctacgtacggaaacccaaccgtaagttcgggtaaccggttttacggttaactttaagttaacgttttccttacggtttccttacccgttaggttaaaccccaaacgtaaaccgtaccccccgggaacttaaaaaccggtaccccctaaaacgtacctagttacggtacttttacggtttacgggtacggttacgtaaggttcggtaccggttccgggcccgggttacggtacggggttttcctacgtaccgttccgttccgttcccggttccggtaccttaccggtaacgttcggacggtacgtaccggacccgtacccgtcccgttaccccgtactaacccgtacgtttccgcggttcggtacccgtccggtacggtaccgttagggaaccgggtacggtacgtacgtacgtttacgttacgttacgtacgtacgtaaccgtacgttacgtaacttaacgttaaacaaacgttaaccgttaaacgttccggtttaacggggtttacggtacccgggttaccggggtaacccggtaaacccgttaacggtccgttaacccgtacccggtaccgtaccgtaaccggtacccggtacggtccccgtacccgggtccccggtaacccgttccgtacccgttcccgttaccccgttccccgttacccccg

SEQ ID NO: 252234 - DNA, 706 bp, Homo sapiens
  misc_feature: GYAE6OF01DSQXO.49.35.D02.1.454.CMB.1.raw
  modified_base (307)..(307): a, c, t, g, unknown or other
  misc_feature (307)..(307): n is a, c, g, or t
  modified_base (335)..(335): a, c, t, g, unknown or other
  misc_feature (335)..(335): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcacatctctgcactgaaccacaatgacgttggtacttatattctgtctctgtaccaacaactacccggacaaacgtaccccaaactcatgatctttgacggtnagtgacgtccggccgacgtagggtttcncgtactcgtcttcgtccggctccgaagtctggcacgccgaccggtccctcccgtgaacctcgttctcgtcgggcctccgacggcgtaggacggacgacggtctaggtaactttatacgtgacgtacgtcctaacgtaattaactaaactaaaacgtaacttaaaccgttacgggtttggggttacggtttaccgggaccggggtaccggaaacccgttaaaccgttacccggtaaaccccggtttacccgtaacccgggtaccggaaacccggtaaccccggtaaccgggtaccccttccccgggtacccccccgttaccgggttaccctacccggtttaccccttccccggttaccccccttaccccccg

SEQ ID NO: 252235 - DNA, 816 bp, Homo sapiens
  misc_feature: GYAE6OF01DPQYU.49.35.D02.1.454.CMB.1.raw
tcagagtcgagagacacgaccggtgctcgatttagcacacgatagttgggtttggggggggtctcaggaggcagcgctctcgggacgtctccaccatggcctggctctgctattcctcaccctctcactcagggcacagggtcctgggcccagtctgccctgactcagcctgcctccgtgtctgggtctccgtggacagtcgatcaccatctcctgcacgtacggaaccaccaatggtacgttgtaactttataacttctcgtctccgtacggtaccaaactaacgtaccccggacaaacgtaccccaaactctaactgtattacgtttgacggttacagtacgaccggtccggcccgtacggtacggggttttcctccgtacgtccgtccgtttaccgtcccgggtaccctttaccgaaacgttccgtacgggaccgtacggacccgaacccgggtccccttaccccgtacggtaacccctacgtttcccgttccgggtcgggtcccgtacccggtaagggtcccgtaggggtaaccgggaaccggtaacgggtccttaaggttaatttaacgttcgttacggacgtacgtaccctagtaactaactaaaccgtaaactaaacgttaaccgttacgggtttcggggttacggttacggggaccgggtaacccggtaacctaaaccggtaccgtacccggtttaccgaaccggttacccgaccggtaaccccgtaacgggtcccgtacccccgttaccccccgggttcggttacccctaacccggtttcccgtttaccccgtcccccggttacccc

SEQ ID NO: 252236 - DNA, 727 bp, Homo sapiens
  misc_feature: GYAE6OF01CISRG.49.35.D02.1.454.CMB.1.raw
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
  modified_base (459)..(459): a, c, t, g, unknown or other
  misc_feature (459)..(459): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgaatcaccagtcctcctagccacgtcggaaacctaccaaagtcggaccgtttggtaacttataacttctgtctctagtaccaacaacgtacccganaaacgtcccaaatcaatgaacttctttagacggttcagtcgacgtcggccgtagtacgggtttcncgtaacgtcgtaccttcgtccggacttaccgaaggttccgaggaccagccgtaccggtcctacccgtcgaacctacgtctacgtgggcctaccgngtacgtaggacggacggtaggacgtaggtaactttagttaccgtagtaaccgtacgtaacgtaccttaaataccgtaaaaccaaacgtaacctaaaacggttaccggggttacgggttaaccgggttacgggacccggggtaccgggaaaaccttaaaacggtcccggtaaacccggttaccgtaacgggtaccaacggtacccggacgtaacccgtcggtccccccgtacgggttaccaccgttcccttcggtaccccccttacccg

SEQ ID NO: 252237 - DNA, 787 bp, Homo sapiens
  misc_feature: GYAE6OF01DQABM.49.35.D02.1.454.CMB.1.raw
tcagagtcgagagacacgaccggtgctcgatttagcacacgatagttgggtttggggggggtctcaggaggcagcgctctcgggacgtctccaccatggcctggctctgctattcctcaccctctcactcagggcacagggtcctgggcccagtctgccctgactcagcctgcctcgtgtctggtctctggacagtcatcaccatctcctgcactacggaaccaccaatgtacgttgtacttatattctgtctcctgtaccaacaactacccgacaaacgtacccaaactcatgacttctttggagtcagtgacgtccggcccgtcgtacgggtttctactacgtcgtcctttcgtcccggtcctaccgtaacgttcgtcggtacacgccaaccggtcccctcccgtacgacctacgttcgtccgtcgggtcccttccgacgggtcgtaggaacgggtaccggaggtccgttagtaacttttaacgttacgtcggaccgtacgtccttaacgtaattaacctaaaactaaactaaaacgttaaaaccgtttaccgggtttacggggtttaccgggtttacccggggaccgggtaacccggggttaaaaccctaaaacccggttacccggtaaacccccggttttacccgttaacccggttaacggaaccccggttaaccccgggaaaccggttcccccggttacccccgggttcccccccgttacccgggtttaacccttacccccggtttccccgtttccccgtttacccccccctttaccccccg

SEQ ID NO: 252238 - DNA, 854 bp, Homo sapiens
  misc_feature: GYAE6OF01BHQ41.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacgagggtcctgggcccagtctcgccctgactcagcctgcctcgtgtctcgggtctcgtggactagtcgactcacctatctcctgcactggaaccacgatggtacgttgtaactatattcgtcgtctcttacggtaacctaactaacgtaacccgacgaaacgttacccaaactcactgtacttcgttagacggtacctagtcgacgtcggcccgtacggttacgggttcctcgtacgtcctccgtttccgaccggtacttaccgtaacgttcgtacggtaccgacggtaccggtaccgtaccccttcccgtaacgtaacctaccggttaccgttcccggttaacggggtccgtacccgggtacgggttaccggtacgggtaaccccggggtaggtaaccggggtttaccggttaaccgggttaatttttaacccgttaaccgggttcggtaaacccgtagtaccccgtttaaggtaaaccttaaccggtaaactaaaacccgtacgtttaaacggaccgggtttttacgggttacgggtttacccggggaccgggtaaccgggtaaacccttaaacgggtacccgtttaacccggtaccctttaaccgggtaacccgacggtaaaccccgtaccggggtcccttaacccccgggttacccgggttcccgttaacccttaacggtttccccttacccgggttcccccttaaccccgg

SEQ ID NO: 252239 - DNA, 661 bp, Homo sapiens
  misc_feature: GYAE6OF01A4KBR.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcatcaccatctcctgcactcggaaccaccaatcgacgttgtacttatattctgtctctcgtaccaacactacccggacaacgtacccaactcatgatctttgagtcagtgactccggcccgtcgtacggggtttctctacgtccgtacttcctccgggtcctaccgtaacgtctcggccagccgaccggtccctcccgtcgacctactcctcgtcgggcctcgacggtcgtaggacggacggaggtcctaggtactttacgttaccgtcggtaccgacgtccttactaattacgtcggaccgaagggcaacggtacccttaaagtttaacgttttggtacttagtacgggttcgggtaaccgggaaccgggtacgaacgggtccgtacgggtaccccgttaccggtaccggtacgtaaccggacccgtaaccggtcccgtcccggtcccccggttacccgg

SEQ ID NO: 252240 - DNA, 739 bp, Homo sapiens
  misc_feature: GYAE6OF01DE811.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactcggaaccacctaagtgacgtttggtacttataattctgtctctggtaccaacaactacccggcaaacgtcccaaactcatgattcttgtaagtcagtcgatccggccgtacgtagggtttctcacgtccgtcttcgccgtcgttaccaagtctcggcagtccgaccggtccctccctcggaaccttacgttcccttacggtcggggtcccttaccgggacgggtaccttacggggaacgggtaaccggtacgggacttagggtacttttaacgtttacgtacgtcgaacgtcctacgaactttaactaaacgtaaacctaaacgttaaaccgtacgggtttcgggttacggttaccggggacccggggtcgggtaaaacccgtaaaccgttcggtaacccccgttaacgtttaccggacccggtaacccggttacccggaaaccgggtccgttacccggtaccccccggtcgggttaaccctaccgttccgttaccccggtttcccccgtacccccg

SEQ ID NO: 252241 - DNA, 887 bp, Homo sapiens
  misc_feature: GYAE6OF01B3IMW.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcacatctcctgcacgtacggaaaccaccaagtggacgtttaggttaacttaattaactttctagtcctccgtacggtaaccaaacaacgtaccccggacaaaccgtaccccaaaactctatgtaacttcgtttagacggtcagttcgacgtccggacccgtacggttacggggtttcctaccgtacgtccggttcctttcccggtcccgggtacctaccgtaaacggttcgtacgggaccacggaccgtaccggtccccttacccgtacgaaccctacgttcccgtcggttccggggtccttaccggacgggtaccgttacgggaacgggaccgggtaggtaccgttaaggttaacgttttaacgttaccgttacggacctacggtacctaacgtaacttaaactaaactaaaaccgtaaactttaaaccggttacggggtttacggggttaccgggtttacgggggaacccgggtaacccggggtaaaacccgtaaaccggttacccggtaaccccggtttaacccgttacccgggtaacccgtaacccgggaacccccggttaaccggggttacccccgttaccccccggggttacccccccgtttaccggggttacccctttaaccccggttttcccccgtttaacccccgggtttccccccccgttaacccccccg

SEQ ID NO: 252242 - DNA, 720 bp, Homo sapiens
  misc_feature: GYAE6OF01D1GHY.49.35.D02.1.454.CMB.1.raw
  modified_base (182)..(182): a, c, t, g, unknown or other
  misc_feature (182)..(182): n is a, c, g, or t
  modified_base (277)..(277): a, c, t, g, unknown or other
  misc_feature (277)..(277): n is a, c, g, or t
  modified_base (327)..(327): a, c, t, g, unknown or other
  misc_feature (327)..(327): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtntctgggtctcctggacagtcgatcacatctcctgcactgaaccaccaatgacgttgtacttatattctgtctctgtaccaacaactaccccgganaaacgtcccaaactcatgtattctttggaggtcagtgactccgggcccgngtaggggttttccacactcgtccttcgtcccggcttaccaagttcgtggacctaggccaccggtcccctcccgtcgaaccctagttccgttacgtcggggtcctacccgtacgggcttagggacggtacggaggtccgtagtaatttacgttactcggtactaggccttacgaattaacctaacaaaaactacttaaaaccttacgggtttgggttacggttaccgggacgggtacccgggaaacctaaaccggttaccgtaacccccggttaccgtaccgggttacccgaaccggtaccccgtaaacgggtccccgttaccccggttcccccccgttacggggttacccctaccggtttacccccgttcccggttccccccttaaccccccg

SEQ ID NO: 252243 - DNA, 758 bp, Homo sapiens
  misc_feature: GYAE6OF01EFTN4.49.35.D02.1.454.CMB.1.raw
  modified_base (206)..(206): a, c, t, g, unknown or other
  misc_feature (206)..(206): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctctcactcagggcacgagggtcctgggcccagtctcgccctgactcagcctgccttccgtgtcgtgggtcctccgtggacngtcgatccacctatcctctgcacgtacgaaccacagtcgtacgtttgtaacttatacttcgtcgtcctccgtacgtaaccaacctaaccgtaccccggaactaaaccgtaccccaaactctattacgtactttcgtttacggacggttacgtacgtcggtaaccgtcccgggacccggttacgggtttacgggttttccctacgttaccgttccggttccgtttcccggaccccggtacctaaccgttacggttaccggtcggaccgaccgtaccccggtacccggtccccttacccggtaccggtaacctccgtttcccggtcggtacccgggtaccctaccgggacggtccggtaacgggaacgggtacgtaacggttcgtagttaacttctacgtcgactgtacctaataactaacaaactaactaacgtaacgtgggttacggtacggtcggaaccggtacgaacctaggtccctaccgtacgtacgcgaaccggacgtacgtccgtcccacccggtcgtccttacccgtccttccccgtcccctccc

SEQ ID NO: 252244 - DNA, 856 bp, Homo sapiens
  misc_feature: GYAE6OF01BSL3F.49.35.D02.1.454.CMB.1.raw
  modified_base (642)..(642): a, c, t, g, unknown or other
  misc_feature (642)..(642): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtcgtgggtctcctggacagtcgatccacctatctcctgaccacgtacggaacccaacctaagtcggtacggtttacggttaactttaattaacgtttccttcggttcccttacccgttacgggttaaaccccaaaaccgtaaacccgttaaccccccggggaacctaaaaacccgttaacccccctaaaaccttaccgtaacgttacgtacgtttacgttttacggtaacgggttaccgtaggttacggtaccgttcccgggaccccggtacgggtttacgggttttccttacgtacgttccggtcctttaccgtccggtacctaccgtaacggtcgtcggacgtacgtaccgacccggttccctcccgtacggtaccctacgttccgttcggtccgggtcctaccggacggtcgtaacgggacggggtacgtacggtcgttaagttaactttacgttacngtacctcgtacgtaactaagtaacctaaacgaaacgtaacttaaaccgttcggggtttcgggttacgggttacccgggacggggttaacccgaaaccgttaaccgtccgggtaaccccgtttccgaacggtcccgaaccggtacccggtacgtcccgtccccggtccccgttcggttaccctaaccggtttccttcccccgttccctacccccg

SEQ ID NO: 252245 - DNA, 674 bp, Homo sapiens
  misc_feature: GYAE6OF01AIU0P.49.35.D02.1.454.CMB.1.raw
  modified_base (337)..(337): a, c, t, g, unknown or other
  misc_feature (337)..(337): n is a, c, g, or t
  modified_base (367)..(367): a, c, t, g, unknown or other
  misc_feature (367)..(367): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccattcctcctgcactacggaaccacaatgacgttgtacttatattctgtctcctgtaccaacactacccggcaaagtccccaaactcatgatctttgagtcagtgacgtccggccgcgtagggtttccncgatcgtcttcctccggtctccaacgttcnggcagccaccgcctccctcgtaccatccttcgcgggtcctccgacggccgttaggaaccgggtacgacgggtctacgtatttaacgttacgtgtaccgtacggtcccttataacgtaacttaacaaacctaacgttaaaccgttcgggttacgggttacggttcgggtaaccgggacggaaaccgtaacggtcgtaacccggtccgtaaccggttaccaaccgggtacccgtaacgggttccctcccggtacccccgttccgggtacccttacccgttaccccgttcccgttcccccgttacccccg

SEQ ID NO: 252246 - DNA, 581 bp, Homo sapiens
  misc_feature: GYAE6OF01AO0X6.49.35.D02.1.454.CMB.1.raw
  modified_base (330)..(330): a, c, t, g, unknown or other
  misc_feature (330)..(330): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccacaatgacgttggtacttataattctgtctcctggtaccaacaactacccggcaaagtcccaaactcatgatctttgagtcagtgatcggccgcgtagggttcncatcgctctccgctcaagtcnggcacgcacggcctcccngacctactcgtcgtagggcctccgaggtcgtaggacggacggaggtctagtattacgttacgtgcgagtctactatactaacaaactaactaaacgtacgttagggtcgttacgggccggacggaacctaacgtcgtacccgtaccgtacgtccaccgaccgaggtcccgtcccgccccgtcggtccaccgttcctccgttccccgtccccg

SEQ ID NO: 252247 - DNA, 887 bp, Homo sapiens
  misc_feature: GYAE6OF01CF97N.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctgggaggttcctctttgtggtggcagcagctacaggtgcccagtcccggtcagctggtgcatcgtggggctgaggtgagaagccgtggggtcgtggtgaacggtctccgtgacgaaggtcttcgtggacgacctaccttacaaacctaactttgctgtcgaggtcgtaggggtgacgacgacggtccccgtaggaacgaacggtccgttgggacgggttgggggtacgggaaggtactacccggtaaccccttacttaacccgttaaatagtaaccgacgtaaaacctagtacgtacaacgtaagtaacctaaccgttaacccgaccgtaaacgaacggtaaccgttacccgttaacccctttaagtacccgggtaaccggtaaacctaaaccgttaccccgaaaaccggtaaaaccctaaccgaacccggttaacccgttaaaccggtaacgtaaccggggtaaacccgtcgggtaacccgtaacccggtaaacgggtaaccccggttaacgggtaccgtttcccggtaaccccgggtacccgggtaaccccgtaaccccgggggttaccctttttaaagtttaacccgtttttccggtaacgggtaccgggttaaccgggaaaccgggtaaagggttagttaaacccggtttcggttttttaaccgtttttacccgtaaagggtttaaccgttaaacgtttaaccgggtttaaaacttccgggtttaaaccctttaggttttaaacggtttcccgg

SEQ ID NO: 252248 - DNA, 578 bp, Homo sapiens
  misc_feature: GYAE6OF01A9B43.49.35.D02.1.454.CMB.1.raw
  modified_base (325)..(325): a, c, t, g, unknown or other
  misc_feature (325)..(325): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctcctggtaccaacaataccccggcaaaacgtccccaaactcatgatctttgaggtcagtgatcggcccgngaggggtttctcatcgcttctccggctccaagtctggcagcacggcctccctgacctatctctgggcctccgaggtctggacggacgaggtctgtattattacgngacncgtctcgatactaacaaactaataaactgttgggtagttcgggcggacggaaccaacgtcgacccgttaccgtacgtcgaccgacccgtacggcctacccggcccccgttacggtccacttcccgttccgttcccctacccccg

SEQ ID NO: 252249 - DNA, 639 bp, Homo sapiens
  misc_feature: GYAE6OF01BDEH1.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctgggctgaggtgagaaagcctgggtcgtcggtgaaggtctcctgcaaggcttgtggagacaccttcaactactttgctgtcagctgggtgcgacgacggtccccgtggaccaaggtccttaggtaggtggggtagggaaggtactccgaaccccttattcctttaaatacgtacgaactaaactagtagccaacgacgactacgttaccacgacagtacgtacctacccttagtccgacgtaaccaacgtcccaaacggtaaccacgacgtacctaacacgtacggaacctcggaccgacctacgacccgttaggacttccggtacgacccggacgtaccgggtaccgtttagttaactttccgtaggtaccggtacggtagaacggtagtacgtttcgttactttacgtagtagttagtacttagttacgttacttagttgtcg

SEQ ID NO: 252250 - DNA, 858 bp, Homo sapiens
  misc_feature: GYAE6OF01ESJW7.49.35.D02.1.454.CMB.1.raw
tcagagtcgagagacacgaccggtgctcgatttagcacacgataggtttgggggtttgggggggggtctcgaggaggcagcgctcgtcgggacgtcctccaccagtggccgtgggctctgcttacttccctccaccctcctcactcgagggcacgacgggtccgtcgggccctagtctcgccctcgactcgacgtcctcgtccgtcgttcgttcgttcgggttcctccgtcggacgtacgtaccgtactacctacctacttcctccgtacgtaccgtaaccgtaaccggaaaccctaaccgtaacggttacggttaacggtttacgttaactttaattaactttcgttcgttccttaccgttaaccggtaaaccaaaccgtaacccgtaaccccgtaacctaaacccgtaaccctaaaccttactagttacgttactttacggttacggtacggtacgtacggtacggtaccggtcccggggtaccggtacgggttaccggtttctccgtacgtccgttccgttccgtccgtacctacgttacgtcggtcggacgtaccgccgtccgtacccgtacctaccgtactcgttccgtcggtccggtcctccggtacggtcgtaacgggaacggtacggtacggttacgttaacgttaacttacgttacgcgtaccgtacgtaacctaacgtaactaaacaaactaaacgttaaaccgttacggttacgggttaccggtacggggtacgggaaccggtaaccgtaaccgtaacgttacccggtacccgtacgtaccgccgtaccgaccgtccgtacccgtccccgtaccggtacgtaccttacgtccccttccgtcccctcg

SEQ ID NO: 252251 - DNA, 771 bp, Homo sapiens
  misc_feature: GYAE6OF01CZ5U7.49.35.D02.1.454.CMB.1.raw
  modified_base (345)..(345): a, c, t, g, unknown or other
  misc_feature (345)..(345): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaacccacaatgtacgttggtacttatattctgtctcctggtaccaacaactacccggacaaacgtacccaaactcatgtacttctttgagtcagtgacgtccggccgcgtacggggtttcncgtactcgtcttccgtcccggtctaccgtaagtccgtaggcctacggtccaccggtccctccccgtaggaccctagttccgtccggttcgggtaccctcccggacgggtccgttacgggaacgggtacggtacggtacgttacggtaacttttaacgttacgtacggtaccgtacgttaccttactaactttaaacgtaaacctaaaaaccgtaacttaaaaaccggttaccggttttaggggggttacccggtttaccggggggaacccggggtacccggggtaaaacccgtaaaccggttccggtaaaccccgttacccggtaaccggttacccgaacccggtaccccggaacggtccccgttcccggtccccccgtaccgggttacctacccgtttcccgttcccggttcccccctacccccg

SEQ ID NO: 252252 - DNA, 733 bp, Homo sapiens
  misc_feature: GYAE6OF01AU7FX.49.35.D02.1.454.CMB.1.raw
  modified_base (516)..(516): a, c, t, g, unknown or other
  misc_feature (516)..(516): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactcggaaccaccaatgacgttgtaacttataacttctgtctcctaggtaccaacaactaccccggacaaacgtccccaaactcatgtactctttgagtcagtcgatccgggccgcgtacgggtttctcacgtcgtcttcctccggtactccgtaacgtcgtcggacctacggccgaccggtccctccccgtacgtaaccctcgttccgttccggtaccggggtcctacccgtacggggaccgttcgggaacgggtaccggacgggtccgttaaggttaaacctttacgtttaaccgnggtacctacggtactacctaagttaaacctaaacaaaccgtaaagtaaaccgtacgggtttacggggttacggttaccgggaccggggtaaccggtaaccctaaaccggtccgtaacccggttacccgtacgtaccgtaacccggacccgtaacgggcccgttcccggtccccgtacggttccctaccttcccggttccccgttccccgttcccccg

SEQ ID NO: 252253 - DNA, 642 bp, Homo sapiens
  misc_feature: GYAE6OF01ATKO6.49.35.D02.1.454.CMB.1.raw
  modified_base (332)..(332): a, c, t, g, unknown or other
  misc_feature (332)..(332): n is a, c, g, or t
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
  modified_base (446)..(446): a, c, t, g, unknown or other
  misc_feature (446)..(446): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgtacgttgtacttatattctgtctcctaggtacctaacaactaccccggacaaacgtccccaaactcatgactctttagaggtcagtgacgtcggcccgnggtagggttctctatcgtctccgtccgctacagtctgcncgcaccggcctccgcgaccnctctcgtcggcctcgacggtcagggacggacgcggtcgtagtaactttactacgngacgacgtacctactaatacgtaaacaaactaacgttaaccgtacgggtttcgggtacggttaccggggaccgggtaacggtaaaccctaaacggtccgtacccgtaccgtacgtaccggaccgacccgggtaacgcccgtaccccggtaccccgtacggtccctacccgttcccgttccccgtcccccttccccg

SEQ ID NO: 252254 - DNA, 762 bp, Homo sapiens
  misc_feature: GYAE6OF01A123P.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgactcaccatcctcctgctacgtcggaacccacaatcggtacgttggttacttattacttctgtctctcggtaccaacaactacccggacaaacgtaccccaactccatagtacttctttaggacggtctagtgacgtccggcccgtcggttacgggtttctcgtactccgtcttccgtccggtacctaccgtaacgtcgtcggcacgccgaccgtccctcccgtacgtaccctacgtcctcggtacgggtcctaccggtacggtccgtaggacggggtaccgagggtcgttacgtaacgtttacgttacgtcggacctcgtaccgtacttaataacctaaactaaactaaacttaacgtacgggtttcgggttcgggttaccggggtaccggggtaccggtaaccccgttaacggtccccgttaacccggttacccgttaacccggtaccggtaaccccggtaaccccggtacgggttaccccctaccccgggttaccccccggttaccgttaccccgttacccgttccccgtttcccggttcccccccttaccccccgg

SEQ ID NO: 252255 - DNA, 1027 bp, Homo sapiens
  misc_feature: GYAE6OF01EK9CK.49.35.D02.1.454.CMB.1.raw
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcaccatctcctgcactagaaccacaatgacgttgtacttatactctgtctctacgtaccaacactacccgacaaacgtacccaactcatgtattcttggacggtcaggtgacgtccggcccggtcggtacgggtttctacgtacgtccgtaccgttcccgtccggtaccctaccgtaacgttccggtcggaccgacggacccgtacccggtccccttaccccgtacggtaaccccttacggttcccgttaccgggtccggggtacccgttaccccggtaacgggtaccggttaacggggaaaccggggttaacccgggtaacggggttaccgtttaaacggttaaacgtttttaacccgttttaaaccgtccgggtaacccgttacggtaacccgtttaaccgtaaacgtttaaaccgtaaaaccccgttaaaaacgtttaaaacccggtttaaaacccgggttaccgggggttttttaaccggggggtttaacccgggggtttaaccccgggggggaaccccgggggttaaacccccgggggtaaaacccggttaaaaaccccgggtttaccccggggtttaaacccccccgggtttaaaccccggtttaaccccggggttaaaccccgggtaaacccccggggtaacccccggggttaaaaccccggggggttccccccgttttaaccccccccggggggttacccccccccggtttttaaaccccgggggttaccccctttttaacccccccggtttttacccccgggttttaaacccccccggttttccccccccccgttttaaaacccccccccgg

SEQ ID NO: 252256 - DNA, 570 bp, Homo sapiens
  misc_feature: GYAE6OF01EMFS2.49.35.D02.1.454.CMB.1.raw
  modified_base (406)..(406): a, c, t, g, unknown or other
  misc_feature (406)..(406): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatcgtgggctgaggtgagaagcctgggtcgtcggtgaaggtctcctgcaaggcttcgtggagaccaccttcaactaactttgctgtcagcgtgggtgcgacacggcccctggacaacggtccgttggaggtggggtgggaaggatccgaccctataccttaatatacgacaaactatagacacagacactaccacgacagacgtctacccttacncgacgaacaacgtccgaacgaacacgacaccgtacatacggaactgacgcgacgcctaggactcgtcgacccgacgaccggtaccgtattacgtttcgtgtcgacgaaggtagagtcttcgttacttgtaagtgtaattacgtaacgttagtcttaagttgtac

SEQ ID NO: 252257 - DNA, 695 bp, Homo sapiens
  misc_feature: GYAE6OF01B2Z4V.49.35.D02.1.454.CMB.1.raw
  modified_base (357)..(357): a, c, t, g, unknown or other
  misc_feature (357)..(357): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatctcctgcactcggaaccaccaatgacgttggtactataattctagtctcgtagtaccaaactaacgtacccgacaaacgtaccccaaactcaactgacttcgtttagagtacgagtcgacgtccggccgtacggtacgggtttcncgtacgtcgtcctttccgtccggtccttaccgtaaaggtcgtacgggaccaacggccgtaaccggtccccttcccgtacggaccctacgttcctcggtcgggtcctaccggaggtccgtagggaacgggtacgaggtacgttagtaactttaacttacgtcgactacgtctaactataaactaacgaaactaaataaactacggttagggtacggttccgggacgggaccggaacctaaacgtccgtaacccgttaccgtacggtccgaagtaccccgaaggtccttaccccggaccccggttcgtactacccgttcgtaccccgtccccgtaacccc

SEQ ID NO: 252258 - DNA, 646 bp, Homo sapiens
  misc_feature: GYAE6OF01B1OIM.49.35.D02.1.454.CMB.1.raw
  modified_base (345)..(345): a, c, t, g, unknown or other
  misc_feature (345)..(345): n is a, c, g, or t
  modified_base (423)..(423): a, c, t, g, unknown or other
  misc_feature (423)..(423): n is a, c, g, or t
  modified_base (632)..(632): a, c, t, g, unknown or other
  misc_feature (632)..(632): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacgagggtcctgggcccaggtctgccctgactcagcctgcctccgtgtctgggtctcctggacagtcgatcaccattcctcctgctacgtacggaaaccaccaaatggtaacgtttagggtaacctttataaatttcgtgttccttccgtcggttaaccaacaactacccggacaacgtacccaaactcatagatctttgagtcagtnacgtcgccgcgtagggttctcgtatcgtcttctccggtctacgaagtcgtacggctacgcaccggcctccgacactanctcgtacggtctacgaggcacggacgacggacggtcgtaagtatttactaccgtgacgacacttacaattaacaaacgtaaaccgtaaataaaccgttaacggttcggtacgggtttcgggaaccggacggtaacctaacgcgtaaccgtcgtaaccgtacacggaccgtacggaccctccggtaccccctcggtaccaccctttaccnccgttaccctcccc

SEQ ID NO: 252259 - DNA, 737 bp, Homo sapiens
  misc_feature: GYAE6OF01BIJZT.49.35.D02.1.454.CMB.1.raw
  modified_base (211)..(211): a, c, t, g, unknown or other
  misc_feature (211)..(211): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacgagggtcctgggcccagtctgccctgactcagcctgcctcgtgtctgggtctcgtggacagtcgatcacctntctcctgccacgtggaacccacaagtcggtacgttgtacttatagttctgtctcctagaccaacacgtacccgacaaacgtacccaaactctacgtgtacttcgtttaggacggttctagtacgtacgtccgggccgtacggtacgggtttcacgtactccgtccgttccgtaccgccttaccgaacgttcgtcggaccgcgtaccgtaccgcccttacccgtcgtaaaccctcttcgtcggtccggtccgtaccggtacggcgtaggacgggtacggacggtcttaacgtactttaacgtacgtcgacgttacgtctaacctaacttaacgaaacctaaaactaaccgttaaacgttcgggttaacgggtttccggtacggggtacccgggaccggtaaaccggtaacccgtccgggtaacccttacccggtaacgtacccgaccgtaacccggaccgggtcccgtaccccggtacccccgtcggtacccttacccgtttcccgtaccccttccccgtacccccg

SEQ ID NO: 252260 - DNA, 708 bp, Homo sapiens
  misc_feature: GYAE6OF01BC43Q.49.35.D02.1.454.CMB.1.raw
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccaccaatcgacgttggtacttataattctgtctctggtaccaacaactaccccggacaaacgtccccaaactcatgatctttgaggtcagtgacgtccgggcccgtcgtacggggtttctcgtactccgtcttccgtccggtctaccaagttcgtggcacggcacggtccctaccctcgacccacttcctcgtcggggtactccgaggtccgtaggaacggaccggaggaccttagtaactttacgttaacgtcggtacacgtctacgtaattaacgtaaacaaaacctaaattaaaacgttacgggtttacggggttacggttaccggggtaccggggaacccgggtaaccgtaaaccggtacggtaaccccggttaccctaaccggttaccgaccggaaccccgtaacggtccccgtacccggtaccccccgttccggtacccgttacccgtttcccgttcccggttccccccgttccccg

SEQ ID NO: 252261 - DNA, 711 bp, Homo sapiens
  misc_feature: GYAE6OF01DRR81.49.35.D02.1.454.CMB.1.raw
  modified_base (199)..(199): a, c, t, g, unknown or other
  misc_feature (199)..(199): n is a, c, g, or t
  modified_base (341)..(341): a, c, t, g, unknown or other
  misc_feature (341)..(341): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctctcactcagggcacagggtcctgggcccagtctgccctgactcagcctgcctccgtgtctgggtctccgtggacngtcgatcaccatctcctgcactcggaaccacaatgacgtttgtacttatattctgtctcctaggtaccaacaactaccccggataaacgtccccaaactcatgattctttgaggtcagtgatcggcacgtcgtagggtttcncatccgtcttcctccggcctacgtaagtcgtaggtcgacgccgaccggtccctacccgtacgaccctagttccgttcggtcgggtcctaccggagggtccgtagggaacgggacggtacggtacgttacggtttaacttacgttaaccgtcgacacgttccaacttaacgtaactaaacaaaccttaaacgttaaaccgttacgggtttacggggttcggtttaccggggccgggtaacccgggtaaacctaaaccggttcccgtaaacccggtccgttaacccgtcgtaacccgcccgaaaccgggttccctaccccggtaccccccggttacgttaccctaacccttccgtttccccgttaccccccg

SEQ ID NO: 252262 - DNA, 667 bp, Homo sapiens
  misc_feature: GYAE6OF01A8026.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccacatgacgttgtacttatattctgtctcctggtaccaacaactaccccggacaaacgtccccaaactcatgatctttgagtcagtgactcggcccgcgtaggggtttcctcactcgcttcctccggtctacccgaaagttccgtggaccacggccgtaccgggtcccctaccccgtacggaaccctacgtccttcgtcggggccctaccgaggtccgtagggaacggaccggtaggccgttagtatttacgtttaacgtcgactacggtcctacgtaattaactaaacaaactaactaaacgtcgttagggttggtaccgggacgggaccggaacctaaacgtaccgtacccgtaccgtaccggtccaccgtacccgaacggtcccgtacccgtacccccgttccggtaccacccgttccttcccgttccccctacccccg

SEQ ID NO: 252263 - DNA, 645 bp, Homo sapiens
  misc_feature: GYAE6OF01EF4WA.49.35.D02.1.454.CMB.1.raw
  modified_base (287)..(287): a, c, t, g, unknown or other
  misc_feature (287)..(287): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctccgtgcacgtggaaccacaatcgtacgttggtacttaataattctgtctccgtggtaccaacaactacccgganaaacgtcccaaactcatgatctttgagttacagtgactcggccgtgtagggttctcatcgtcttcgtccggtctcaagtcgtgcagcacggcctccgagaccattcctgtgggcctaccgaggctaggaacggacgaggtctagtactttagtacgtgacacgtactacaataacaacaaacaactaaaacgtcggtttagggtacggttccgggaccgggaccgggtaaacctaaacgtccggtaaccccggttaccctaaccggtaccgaaccggaccccgtaaacggtcccgttaaccccggtccccccgtttcggaacccttacccgttccgtttccgggttccctacccccgg

SEQ ID NO: 252264 - DNA, 703 bp, Homo sapiens
  misc_feature: GYAE6OF01BVNU9.49.35.D02.1.454.CMB.1.raw
  modified_base (281)..(281): a, c, t, g, unknown or other
  misc_feature (281)..(281): n is a, c, g, or t
  modified_base (517)..(517): a, c, t, g, unknown or other
  misc_feature (517)..(517): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgtacgttggtacttataattctgtctcctgtaccaacaactaccccganaaaccgtacccaactcatgattcgtttggaggtcagtgacgtccgggcccgtcgtagggtttctcgatccgtcttccgtccggtctaccgtaagtcgtggaccacggccgaccggtccctacccgtgaaccctagtccttccggtcgggccctccggaggtccgtaggacgggacggacggtccttagtaatttagttacgttcgctttaggttacagttacgtcggaccgggttnaacggttagggtccggtaccgggtaaggggtttccggttacggggaccgggtaacgggtaaccgggtaacgggtaccgtaacccggttccggtaagggtacccgaacggcccggtaaacgggtccccgttaccccgggtcccccgttacgggtacctacccgttcccgttcccccggtttaccccc

SEQ ID NO: 252265 - DNA, 750 bp, Homo sapiens
  misc_feature: GYAE6OF01CL9EB.49.35.D02.1.454.CMB.1.raw
  modified_base (201)..(201): a, c, t, g, unknown or other
  misc_feature (201)..(201): n is a, c, g, or t
tcagagtcgagagacacgaccggtgctcgatttagcacacgatagttgggtttggggggggggtctcaggaggcagcgctctcgggacgtctccaccatggcctggctctgctattcctcaccctcctcactcagggcacagggtcctgggcccagtctgccctgacttagcctgcctccgtgtctgggtctccgtggacngtcgatcaccatctcctgcactggaaccacaatgacgttgtacttataattctgtctcctggtaccaacaactacccggacaaacgtacccaactacatcgatctttgaggtctagtgacgtccgcccggtcgtacggggtttctcagtcgtcgttccgtccggctccgaagtcgtagggcacgcgacccggtccctcccgtcgaacctacttccgtaccgtcgggtcctaccgtaggccgtaggaggacggtaggtctgttaacttactttacgtacgcgtacgtcctacgtaactaacttaaaccgtaaactaaaccgttaaaacttaaccgggtttcggggttacgggtttacccgggaccggggtaacccgggtaacccgtaaaaccggttaccggttaaccccgttacccgggttaacccgtacccggtaaccgtacccccggtaaacggttcccccgttacccggtacccccccgttaccccggttccgttaaccccgttacccgtttacccccgttaccccccttccccccggtttaccccc

SEQ ID NO: 252266 - DNA, 879 bp, Homo sapiens
  misc_feature: GYAE6OF01AEFWX.49.35.D02.1.454.CMB.1.raw
  modified_base (219)..(219): a, c, t, g, unknown or other
  misc_feature (219)..(219): n is a, c, g, or t
tcagagtcgagagacacgaccggtgctcgatttagcacacgatagttggggtttggggggggtctcaggaggcagcgctctcgggacgtctccaccatggcctggctctgctattcctcaccctctcactcaggcacagggtcctgggcccagtctcgccctgactcacgcctgcctccgtgtcgtgggtctccgtggacagtcgatcaccatcctccngcacgtacggaaccaccgaatcgtaacgttggttactttaacttaatttccgtgttcctccgtacggttaaccaaacctaaccgtaccccggactaaaaccgtaccccaaactcatacgtacttacgtttggacggttactacggttacggaccggtcccggcccggttacggttacggggtttacctacgtaccgttccggttacccttccggtcccggtaccgttaccgtaacgttccggtcggtaaccgacggtacccggtacccgtaccccgttaccccgtacgtaacccttacgttcccgtcggttccgggtcccgttaccggtcgggtaccggttaggaaccggggtacggtacggtacgttacgttaacgttttaccgttaccgtacggtacctaacggttcgtaaccgtaactttaaccgtaaacctaaaaccgttaaccgttaaacgggtttaccggtttacgggggttacgggttaccggggtacccggggtaacccgtaaacccgttaaccggttccggtaccccgttaaccgttacccggtacccgtaccggaaacccggttcccggttaaccccgtccccggttaccccgttacccgggtttaccccaccgggttttaccccttacccccggttccccttaaccccg

SEQ ID NO: 252267 - DNA, 657 bp, Homo sapiens
  misc_feature: GYAE6OF01AGNV5.49.35.D02.1.454.CMB.1.raw
  modified_base (289)..(289): a, c, t, g, unknown or other
  misc_feature (289)..(289): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactgaaccaccagtgtacgttgtacttatattctgtctctgtacacaactacccgacaacgcccaactcatnatctttgagtcagtgagtccggcccgtgtacggggtttctctatcgtccttcgtcccggcttaccaaggtctggtcacgccgaccggccctccctacgacctacttccgttacgtcgggtccctaccgagggtccgtagggaccgggtaacgggagtcgtagtaactttacttaccgtgcgtacgtcgtactactaactaaccaaactaactaaaccgtacggttagggttacgggttcgggtaccggggaccggaaaccgtaacgtaccgtacccgttactaccggtaccgaccggacccgtacggtccccgtaccgtcccccggttcgtcccgtaacccgttccgttcccggttcccccttccccg

SEQ ID NO: 252268 - DNA, 709 bp, Homo sapiens
  misc_feature: GYAE6OF01EO2L9.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctccaccctcctcactcagggcacagggtcctgggcccagtctgccctgactcagcctgcctccgtgtctgggtctctggacagtcgatcaccatctctgcactggaaccacaatgtacgttgtacttataatctgtctctggtaccaacaactacccggacaaacgtaccccaaactcatgtattcgtttggagtcaggtgtacgtccggcccgcgttaggggtttctctacgtcgtcttccgtccggtcctactaacgtcgtggctacgccgtaccggtccctccgtacgtacctacgttccgtccggtacggggtcctaccggtacggtcggtacggaacggggtaccggtaacggtccgttaaggttaacttttaacgtttacgtcgtaccgtacgtacctacgtaactaactaaacaaacctttttttaaacgaaacgttacgggttacggggttcgggttaccgggaccggggtaccggtaaccgtaaccggtaccggtacccgttacccgtacggtaccgtaccgaccggtacggtccgtcccgtccccgttccgtacctaccgttccttcccgtcccctccccg

SEQ ID NO: 252269 - DNA, 611 bp, Homo sapiens
  misc_feature: GYAE6OF01DMNF9.49.35.D02.1.454.CMB.1.raw
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacagggtcctgggcccagtctgccctgactcagcctcgcctccgtgtctgggtctcctggacagtcgatcaccatctctgcactcggaaccacaatgacgttggtacttataattctgtctctgtaccaanaatacccggnaaactcccaaatcatgatctttgagtcagtnatccggcccgngtagggtttctcactcgcttctcccggntacccaagtcgtcggacacgccgaccggccctaccctacgtaccctatccgtcgttcggggccctccgtaggacgtggaacgggacggtagggtacttaggtactttaataaccgtgaccagtacttacaataactaaacaaactaaactaaacctacgtttgggtcgttcgggacgggtacggaacaaacgtcgaacccgtcgtaacgtccagtacccaggcctaccgtcccctcggtcaccttctccgttccctacccg

SEQ ID NO: 252270 - DNA, 579 bp, Homo sapiens
  misc_feature: GYAE6OF01BDES6.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatctcctgcactggaaccacaatgacgttggtacttataattctgtctctggtaccaacaataccccggcaaagtccccaaatcatgatctttgaggtcagtgactcggcccgtcgagggtttctcatcgtacttccgtccggctccgaagttcctggacaggcacggccctccctacgaccactctctcgggctcccgaaggtctaggacggacgacggtcttaggaatttattactgcagcctcatataacaaacaataaacgcgtttgggtacgttcgggccggacgggaaccaaacgtcgaacccgtcctacgtcgacgacccgaggcctccgacccctcggtcacctctccgttcccctacccc

SEQ ID NO: 252271 - DNA, 773 bp, Homo sapiens
  misc_feature: GYAE6OF01EBXY8.49.35.D02.1.454.CMB.1.raw
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctctcactcagggcacgagggtcctgggccctaggtcctcgcccgtgactcacgcctcgcctcgtgtcgtggtcctcgtgacngtcgntacacctatcctctgcacgtacgaaccaacagtcgtacgttaggtaacttaagtacttcgtactcgtacgtaacgtaaccaaccgtaaccgtaacccgaaccgtaaaccgtaaccctaaactacgtatacgtacgttacgttagacgtacgtacgtacgtacgtccggtcggttacggttcggttcacgtacgtcgtccgtcgtccgtactacgtacgtcgacgtacgaccgaccgtccgtccgtacgtaccgtacctcgttccggtcggtaccggtacgtacgtacggtacggtacgggaacggtacgtacgtacgttaacgttacgttacgtacgtcgtacgtacgtactacgtaactaaactaaacgtaaacgttaacgttaacggttacggggttacgggtacgggtaaccgggtaaccgggtaaccgtaaccgttaaccggtacccgttacccgtaaccgtaacccgtaaccggtaccggtaacccggtaccggtccccgttacccggtacccggttaccgtacccttcccggttcccgtaccccgttccccgtacc

SEQ ID NO: 252272 - DNA, 648 bp, Homo sapiens
  misc_feature: GYAE6OF01B1MW6.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactggaaccaccaatgacgttggtacttataattctgtctcctggtaccaacaactacccggacaaacgtccccaaactcatgattctttggaggtcagtagacgtccggcccgacgtacggggtttctcgtactccgtcctttccgtcccggtacctacccgtaaagttccgtcggcctacggccgaccggtcccctcccgtcgaaccctactcctcgtcgggtcctaccggacggcgtggaacgggacggacggtctggttaatttacgttactcgacgtacgtctacaataactaacaaactaacgtaaccgtacgtttgggtcggttcgggaccggaccggaacctaacgtcgacccgtacctacgtccacggacccgacgcccgtccgccccgtcgacctacctccgttccgtccccgtacccc

SEQ ID NO: 252273 - DNA, 607 bp, Homo sapiens
  misc_feature: GYAE6OF01CXXZ1.49.35.D02.1.454.CMB.1.raw
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (336)..(336): a, c, t, g, unknown or other
  misc_feature (336)..(336): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccncaaatgacgtttggtacttatattcngtctcctgtaccaacaatacccggacaaacgtcccaaactcatgatcgtttgaggtcagtgacgtcggccgcgtagggtttcnctactcgtcttcgtccggctccgaagtcgtcggcacgcacggtccctccctgacctatctcgtcggctccgaggctggacggacgaggtctagtatttattacgtcgacagtctcaataacgtaacaaactaactaaacgtacgttgggtcgttcgggacgggacggtaaccgtaaaccgtcggtacccgtccgtacggtaccgacggacccgtaacggcccgtccgacccccgttcggtccctacgtttcctccggttccccctaccccg

SEQ ID NO: 252274 - DNA, 826 bp, Homo sapiens
  misc_feature: GYAE6OF01BMDXS.49.35.D02.1.454.CMB.1.raw
  modified_base (204)..(204): a, c, t, g, unknown or other
  misc_feature (204)..(204): n is a, c, g, or t
tcagagtcgagagacacgaccggtgctcgatttagcacacgatagttggggtttgggggggggtctcgaggaggcagcgctctcggggacgtcctccaccatggccctgggctctgctattcctcaccctcctcactcagggcacagggtcctgggcccagtctgccctgactcagcctgcctccgtgtctgggtctctggacngtcgatcaccgatctcctgcgaccgtcggaaccaccaatgacgttggtactagtattctcgtctcctaggtaccaacaactaccccggcaaacgtccccaaactcatcgtactctttggacgtcagtcggacgtccgggcccgtacggtgggggttttccacgtacgttaccgtaccttcccgtacccggtctacccgtaaacgtcgtacggtacaacggttccaaccccgggtcccttaccccgtaccgggtaaccctaccttacggtacccggtgggggtccccttacccggaaccgggtccttacggggaacgggaacggtacgggtacgttaccggtaatttaacgttaacgtcggacccgtacggtaccttacgaactttaaccgtaaaacaaaaccgttaacgtaaaaccggttaccgggtttacggggtttaaccggggtacccggggtaacccgggacccgggggaaaccccttaaccggtaccgggttaaacccccgttcccgaaccgggttaccacccgggtaccccggtaaagggtccccgttcccggtaccccccggttaccggttaactccccggttttcggtacccccggtttcccccgtacccccgg

SEQ ID NO: 252275 - DNA, 916 bp, Homo sapiens
  misc_feature: GYAE6OF01C6EXF.49.35.D02.1.454.CMB.1.raw
tcagagtcgagagacacgaccggtgctcgatttagcacacgataggttggggtttgggggggggtctcaggaggcagcgctctcgggacgtctccaccatggcctgggctctgctattcctcaccctcctcactcagggcacgagggtccgtcgggcccagtctcgccctgactcacgcctgcctccgtgtcgtgggtctccgtggacagtcgatccaccactctcctgccacgtacggaaccacaagtgtacgttcggtacttatattctgtcctccgtacgtaccaacaaccgtacccggaactaaaccgtaccctaaactctaagtacgtacttcgttaggtacggtacgtacggtgaccggtccggacccggtcggtacgggtttcctacgtacgtccgtctttccgtccggtcctaccgtaacggttcgtcggaccgacggtacccgtcccggttcccctacccgtacgtacccgtcgttcccgtaccgggtaccgggtcccttaccgggacggtaccgggttacggaaccggggttaacggtaccggtacggttacggttaactttaacgttacgtccggtacgtaacgtacccttaacttaacgttaaacccttaaaacctaaaaccgttaaaacgtttaaacccggttaccggggtttaaccggggtttccgggttaacccgggggtaacccggggtaaacccggggtaaacccccgttaaaccggttaaccccggggttaaccccggtttaccccggttaaaccggggtccccggtaaaacccgggttaaaccccgggtacccggggtaccccccgggttaccccggttaccccccggtaacccgggtttacccccgttaacccgttttcccccgggttaccccctttacccccccgtttccccccg

SEQ ID NO: 252276 - DNA, 741 bp, Homo sapiens
  misc_feature: GYAE6OF01AOJ5I.49.35.D02.1.454.CMB.1.raw
  modified_base (197)..(197): a, c, t, g, unknown or other
  misc_feature (197)..(197): n is a, c, g, or t
  modified_base (324)..(324): a, c, t, g, unknown or other
  misc_feature (324)..(324): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcaggcacagggtcctgggcccagtctgccctgactcagcctgcctccgtgtctgggtctcctggacngtcgatcaccatcctcctgcacgtcggaacccaccaatgtacgtttaggttaacttattaacttctgtccttcctacggtaacccaaacaactacccccggactaaaccgtacccccaaactacatnacttctttaggtaggtcagtgacgtcccggcccggacggtacgggtttctcacgttccgtctttccgtcccggccttaccgaacgttcgtcggctacggccgacccggtcccttaccccgtcgaacctacgttcctcggtcgggtccctcccgagggcgttacgggacgggacggtacggtcgtagttaatttaccttactcggacctacgtcctactaacttaactaaaccaaactaaacttaaaccggttacgtttgggggttacggttccggggacgggacccggtaaaccaacggtccggtaaacccgttcgtaaccggtccgaaccggacccggtaaccggtcccgtaccccggtaccccgttaccggttcccgttaaccttcccggttacccggttccccccgttaccccg

SEQ ID NO: 252277 - DNA, 807 bp, Homo sapiens
  misc_feature: GYAE6OF01CQT73.49.35.D02.1.454.CMB.1.raw
tcagagtcgagagacacgaccggtgctcgatttagcacacgatagttggggtttggggggggtctcaggaggcagcgctctcgggacgtctccacatggcctgggctctgctattcctcaccctcctcactcagggcacagggtcctgggcccagtctcgccctgactcagcctgcctccgtgtctgggtctcctggacagtcatccaccatctcctgccactacggaaacccacaagtcgacgtttgtacttaatattctgtctctggtaaccaacaactacccggacaacgtacccaactcatgacttacgttacggagtcgtagcgtacgtccggccgcggttacgggtttctacgacgttccgtcttccgtccggtacgtaccgtaaggttccgtcggacctacggcccgaccggttacccctcccgtacgtacctaacgttcctccggtcgggtccgttaccgacgggtcgttaacgggacgggaaccggtcggttaccgttacgttaacgtttaacgtttaccggtacgtacccgtaacggtaccttaacgtaacgtttaaaactaaaccctaaaaccgttaaaacgttaaaacccggttaacggggtttttccggggttaaccgggggttacccgggaacccggggtaacccgggttaaaacccgtaaaaccggtttccgggtaacccgtaccccggttaacgtacccgaacccgggaacccgtaaccgggtccccgttaccccggtccccgtcccggttaccttacccttccccgggttcccttaccccccgttacccg

SEQ ID NO: 252278 - DNA, 742 bp, Homo sapiens
  misc_feature: GYAE6OF01B10PW.49.35.D02.1.454.CMB.1.raw
tcagagtcgagagacacgaccggtgctcgatttagcacacgatagttggggtttggggggggtctcaggaggcagcgctctcgggacgtctccaccatggcctgggctctgctattccctccaccctcctcactcgagggcacgagggtcctgggcccagtctcgccctgactcagcctgcctccgtgtctgggtctcctggacagtcgatcactatctcctgacactcgaaccacatgacgttgtacttatatctgtctctgtaccaacacgtacccgacaacgtacccaactcatgattcgtttggacgtcagtcgtacggtccggcccgtggttacgggtttcctcgtacgttccgtccgtttccgtcccggtaccttaccgtaacgtcgtcggacgtacgccggtacccggtccccttcccgtacgacctacgttccgtaccggtcgggtacccgtaccggcggtaccggtaacgggaacgggaacggtacggttacgttagttaacgtttacttaacgtcgtaccgtactaccttacgtaattaaacctaaactaaacgtaaacttaaacggttccgggttagggttaccggttccgggaccgggaacccggtaaaccgtaaaccggtccgtaacccggtacctaccggtaccgaaccggtacccggtacggtcccgtaccccggtcccccgtaccggtacccttcccccgttacgtccccgttccccccgtacccg

SEQ ID NO: 252279 - DNA, 807 bp, Homo sapiens
  misc_feature: GYAE6OF01B0E0T.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgcactggaaccacaatgacgttgtacttatattctgtctctgtaccaacaactacccggacaaacgtcccaactcatgacttcttgagtcagtgacgtccggccgtcgtacggggtttctacgacgtcgtcctttaccaccggggtcctaccgtaacgttccgtacggccacggccgtaccggtccccttaccccgtacggtacccctacttccgtccggttcggggtccgttacccggacggtccggttaacgggaaccgggtaccgggtaaacgggtccttacggttaaacgttttacgtttaacccgtaggtacccgttaagtacccgtttaaccctaagttttaaaacccaaaaccgttaaaacctaaacgtttaaaaccgttaacggggttttcggggtttaccgggttaccggggacccgggtaaccgggtaaaccccgtaaacggtcccggtaaacccgttccccgtaaaccggtacccgtaaccgggacccccgtaacggtaccccgttaccccggtaccccccgttaccgggttacccttacccggttccccgtttccccggttcccccctttaaccccccg

SEQ ID NO: 252280 - DNA, 787 bp, Homo sapiens
  misc_feature: GYAE6OF01A09IT.49.35.D02.1.454.CMB.1.raw
  modified_base (200)..(200): a, c, t, g, unknown or other
  misc_feature (200)..(200): n is a, c, g, or t
tcagagtcgagagacacgaccggtgctcgatttagcacacgatagttgggtttggggggggtctcaggaggcagcgctcgtcgggacgtctccaccatggcctggctctgctattcctcaccctcctcactcagggcacagggtcctgggcccagtctgccctgactcagcctgcctccgtgtctgggtctccgtggacngtcgatcaccatctcctgcacgtgaaccacaagtcgacgttgtactatattctgtctctacgtacaacaccgtacccggactaaaccgtccccaaactctaagtgtacttacgtttaggacggttaccgtaggtacgaaccgtccggtcccggtacggttacgggttttccaccgtacgtccgttaccgtttcccggtcccggtacctaccgttaacggttccgtacggtaccgaccgtacccggtacccgtacccgtacccccggttaagaaccccttgtcccgttacgggccggtaccgttaccgggaagtcggttacggaaccgggacgtaccggtactggttaacttacgtaccgttgacgtacgtccttaacgtaactttaaccgaaactaaaactaacgttaaccggttacgggtttaacgggtgggttaacccggaccggggtaaccgaaaccgtaccggttaccgtacccggttaccgaccggtaccgtaacccgggccccggtaacggtccccgtaccccggttaccccgtccggtacctaaccccgttcggttttacccccggcccctttacccccg

SEQ ID NO: 252281 - DNA, 558 bp, Homo sapiens
  misc_feature: GYAE6OF01CBNOP.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtccccaaactcatgatctttgaggtcagtgatcggcccgcagggtttctcgatcgcttctccggctccaagtctggcagcacggcctccctcgaccactctctgggctccaggctgaggacgaggctgattattactgcagctcatataacaaacaataaacacttagggtgttcggcggccgggaaccaaactcgtacccgtacctacgtcctagccccgaaacggccgtcgtccccccgtcgggtaccacctcctcgttccccggtcccccc

SEQ ID NO: 252282 - DNA, 740 bp, Homo sapiens
  misc_feature: GYAE6OF01B3EXZ.49.35.D02.1.454.CMB.1.raw
  modified_base (316)..(316): a, c, t, g, unknown or other
  misc_feature (316)..(316): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatcgtggggctgaggtgagaagcctgggtcgtcggtgaggtctcctgcaggctgtggagcaccttacaactaactttgctgtcgagcgtgggtcgcgacgcggccccgtggacacggccgttggnggtgggtgggaaggactacccgtaccctataccttaatagtacgactaaactatcgacacagtactacttaccaaccgtagaacgtacgtacctacccgtttactccggaacccggtaaactaaactacccgaaccgtaaaccaaccgtacgtaccccgtaaagtaacgttaagggaaaacgttccggacgaacccgtaacggtacccgtaagggtaaccgttccgaaccgggtaaccccgtaaccgggaccgggtttacccgtttaaacttccggtttttaccgtcgggtacgggtacgtaacgggtaacggtaaggttccgttttacgggttttaccctttacggttaagttaagggtttaaaccggtttaacggttaacccgttttaagggtttaccttaaaagttttcggtttaacccgg

SEQ ID NO: 252283 - DNA, 685 bp, Homo sapiens
  misc_feature: GYAE6OF01BK4WN.49.35.D02.1.454.CMB.1.raw
  modified_base (215)..(215): a, c, t, g, unknown or other
  misc_feature (215)..(215): n is a, c, g, or t
  modified_base (430)..(430): a, c, t, g, unknown or other
  misc_feature (430)..(430): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatcctcngcactagaaccacaatgacgttggtacttataattctgtctcctggtaccaacaactacccggacaaacgtccccaaactcatgattctttgaggtcagtgactccggcccgcgtaggggtttctctagtcgtcttcctccggctaccagtcgtcgcacgcaccgcctcccgacacctatcctacgtcggtcctcgacggctaggacggaacggnggtctaggtaactttacgttctacgcgtacgtcgtactaacttaaataacctaaacaaacgtttaaaccgtacggttttacggggttaggtttacccggggccggggtaacccgggaaaaccctaaccggtaccggttaccccgtaacccgttacgtacccggaaccgtaaccccggaacggtcccgttaccccgtcccccgggttacctacccgtaaccctttcccggtttcccggttaacccccgttcccccc

SEQ ID NO: 252284 - DNA, 718 bp, Homo sapiens
  misc_feature: GYAE6OF01CO79A.49.35.D02.1.454.CMB.1.raw
  modified_base (196)..(196): a, c, t, g, unknown or other
  misc_feature (196)..(196): n is a, c, g, or t
  modified_base (442)..(442): a, c, t, g, unknown or other
  misc_feature (442)..(442): n is a, c, g, or t
  modified_base (491)..(491): a, c, t, g, unknown or other
  misc_feature (491)..(491): n is a, c, g, or t
  modified_base (706)..(706): a, c, t, g, unknown or other
  misc_feature (706)..(706): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctgggaggttcctctttgtggtggcagcagctacaggtcgcccgaacgtccccgggtccagctggtancaagtcgtgggctgaggtagagaaagccgtgggtcgtcggtgaacggtctcctgctaaggtcttacgtaggacgacacctttcaaactaactttgacgttgtaccgagtcgtgggtgaccggacgaccggtccccgacggtaacgaaggtccgttaggacgggttaggggtacgggaaaggtaccttacccgaacccccgtttaatacccgttaaaatacgtaacgtaacaaaagtttcgacgtanaaccgaagtacacgttaccgaacgtacgaaggacttaccacccgtttanccggaacggaactaaaccgtcaaccgaaacgtacacgaacgtaccagtcggaaactcgaacgtcgaacgacccgttaggaccgtagtaccggaccgaaccggtacccggtaccgtaatttaccgttacgtaggtacgtaacggacgtacggaaggtaacttgttaacgttttcgaatttaacgaaacgttacgtttaaacgtcgttaaacggttnttaaacggttcg

SEQ ID NO: 252285 - DNA, 790 bp, Homo sapiens
  misc_feature: GYAE6OF01EIIAU.49.35.D02.1.454.CMB.1.raw
  modified_base (240)..(240): a, c, t, g, unknown or other
  misc_feature (240)..(240): n is a, c, g, or t
  modified_base (333)..(333): a, c, t, g, unknown or other
  misc_feature (333)..(333): n is a, c, g, or t
  modified_base (374)..(374): a, c, t, g, unknown or other
  misc_feature (374)..(374): n is a, c, g, or t
  modified_base (419)..(419): a, c, t, g, unknown or other
  misc_feature (419)..(419): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacagggtcctgggcccagtctcgccctgactcagcctgcctcgtgtcgtgggtcctccgtggacagtcgatccacctatcctcctgccacgtcggaaaccncaagtcgtacgtttaggtactttaatattctgtctaccgtgtaccaacaacgtaccccgacaaacctcccaaactcatgtacttcgttacggngtacgagtacgtcgtccgggccgtacgggttacgggtttcnctacgtcggtaccttccgtccggtacctaaccggtaacgtccggnggtaccgacgcccgaccggtcccttaccctacggtacccagttccgttccgggtacgggtcctccggtacggtccggtagggaccggggtaacgtaagggttcttcggtaaacttttaccgtaacggctacggtactaccttaacgtaactaaacgtaaactaaagttacgtaaaccgtttcggggttacgggttaccgggtacggggtaccgggaacccgtaaacgtaaccgtaccggttaaccctacccggttaaccggtacccgaaccgggaacccggtcccgttacccgggtaccccccgttccccggggaaacccttccccgttaaacccgtttccccggttaccccccgtcccccggtttacccc

SEQ ID NO: 252286 - DNA, 791 bp, Homo sapiens
  misc_feature: GYAE6OF01ELP0P.49.35.D02.1.454.CMB.1.raw
tcagagtcgagagacacgaccggtgctcgatttagcacacgatagttggggtttgggggggggtctcaggaggcagcgctctcgggacgtctccaccatggcctgggctctgctattcctccaccctcctcactcgagggcacgagggtcctgggcccagtctcgccctgactcacgcctcgcctcgtgttcgtgggtcctccgtggactagtcgactccaacctatcctcctgcctacgtacgaaccacctagtcgtacgttgtactatattctgtctctacgtaccaactaacctacccggactaaccgtaccccaaactacactagtacttcgtttaggtacggtcgtaggtcgaccggtccgggtacccggtacggttaacggggtttcctacgtaccgttccggtccgtttcccggtcccgtaccgttaccgtaacggtccgtcggacgtacggacccggtacccggtcccttccccgtacgtaccctacttccgtaccggtccgggtacccgtccgtaccgggtcgtacggggtacgggaacggtacggtacgttagttaacgtttaacttcgtacgtacgtactcgttaactaagtaacctaaacgtaaacttaaacgttaaaccgttacgggtttagggttaccgggtaccgggaccgggtaacccgggaaaccgtaaccggttaccggtacccgtaccgtacgtccgaacgacccgtaccgggtccgtccccgtaccccggtcttacccgtaccgttcccgttcccggtcccccttaccccg

SEQ ID NO: 252287 - DNA, 734 bp, Homo sapiens
  misc_feature: GYAE6OF01BSQEW.49.35.D02.1.454.CMB.1.raw
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctgacagtcgatcacatcctctgcacgtacgaaccaacaagtcgtacgtttggttacttaattaactttcgtacgttccttccgtacggtaaccaaacaaccgtaaccccggaactaaaccgtaccccaaactcatagtacttcgtttggacgtcgtagcgtacgtccggccgtacggtacgggtttcctacgtacgtccgtcctttaccggtccggtacctaccgtaacggtcgtccggtaccgacgaccgacccggtcccgtcccgtacgacctacgttcctcggtccgggtacctccggtacgtcgtacgggaacgggtacggtacgtcgtagttaacttttcgtttacgtcgacgtacgtcgttactagtacgtcgacgacgtacgaacgtaactaacgtttagtttacgtagttacgttacgggtaccgggacgggtaacggtaaccgtaaggtcccggttaccggaacccggttaccgtacggacccgttaccggacccggtaacggtcccgtccccggtacccccggttacccgg

SEQ ID NO: 252288 - DNA, 614 bp, Homo sapiens
  misc_feature: GYAE6OF01AK8R1.49.35.D02.1.454.CMB.1.raw
tcagagtcgagagacacgaccggtgctcgatttagcacacgatagttggggtttggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcacatctctgcactgaaccacatgacgttgtacttataattctgtctcctggtaccaacaataccccggcaaacgtccccaaactcatgatctttgagtcagtgatcggcccgcgagggtttctcatccgtctctccggctccagtctggcagcacggtcctcccgtgacctatctcgtcgggcctccgaggctcggaggacgaggtctagtattacttacgtgacagctctaataactaacaaacctaataaaccgtcgtttacggggttcgtttacgggaccgggtaccggaaaccgtaaaccgtcggtaacccgttaccgtaaccgtccgaccggtacccgaagggtcccgtacccgtcccccgttacggttacccaccgttccgttcccggttccccgtcccccc

SEQ ID NO: 252289 - DNA, 653 bp, Homo sapiens
  misc_feature: GYAE6OF01C8EZN.49.35.D02.1.454.CMB.1.raw
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtcccaaactcatgatctttgagtcagtgatcggccgngtagggtttctcatcgtcttctccggctcaagtctggcngcaccggtccctcccgtagacctattcctcgtcgggtcctaccggaggtccgttagggaacggacggtaacggcttagtaacttttacgttacttcgcctaagtcctacaattaactaaactaaaactaactaaaacgttacgtttggggttacgttccgggacgggtaccggtaaccaaacggttccgacccgttccgtaccgtacgaaccgtacccgaaacgggtccctacccggtccccccgttacgggtaccctaccgtttcccgttcccggttcccccggtccccc

SEQ ID NO: 252290 - DNA, 705 bp, Homo sapiens
  misc_feature: GYAE6OF01B75DQ.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcacgcctgcctcgtgtcgtgggtctcctggacagtcgatccacctatctctgcactcggaaccacaatggtacgttgtacttatattctgtctctcgaccaacaacgtacccgacaactcccaactcatgtactcgttgagtctagtcgacgtccggcccgcggttacggggtttcctacgtacgtccgtaccgttcccgtaccggtcctacccgtaacgtccgtcggacgtacggacccgaccggtccccttaccctacgccctacgttcgtccgtacgggtcctccgaggtcgtaggtaacggtcggtacgtacgttagttaactttacgttagtacgtacgtacgtctacttaacgtaaactaacctaaattaaccgtaaacgttacgggttagggttcggttaccgggaccgggtaaccggaaccgtaaccgtccgtaccgttacccgtaccggccgtacccgtaacccggaccggtcccgtaccccgtaccccgtcgttacccgtaccttcccgttaccccgttcccgtcccc

SEQ ID NO: 252291 - DNA, 759 bp, Homo sapiens
  misc_feature: GYAE6OF01BWVPB.49.35.D02.1.454.CMB.1.raw
  modified_base (345)..(345): a, c, t, g, unknown or other
  misc_feature (345)..(345): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactgaaccacaatgacgttgtacttatattctgtctctgtaccaacaactacccggacaaacgtccccaaactcatgacttcgtttaggaggtacaggtcgacgtccggcccgtacggtaggggtttcncgtacgtcgtccttccgtcccggtacctaccgtaaaggttccgtacggtcgaacgccgtaacccgggtccccttcccgtacggtaaccctacgttccgttaccggtcgggtacctaccggacggtacgtacgggaacgggtacggtaacgggtcttacggttaactttaacgtttacgtacgaccgtaacgtaccttacctaacgttaaacctaaaccgtaaaactaaacgttaaaacgttacgggttttacggggttacggttaccgggggaccgggtacccgggaaaccgttaaacccgtaccggtaccccgtaacccggttaccgtaaccgtacccggacccggtaacggtcccgtacccgtcccccgttcggtaccctaccgttcccgttcccgttcccccgttaccccg

SEQ ID NO: 252292 - DNA, 721 bp, Homo sapiens
  misc_feature: GYAE6OF01D6IM4.49.35.D02.1.454.CMB.1.raw
  modified_base (126)..(126): a, c, t, g, unknown or other
  misc_feature (126)..(126): n is a, c, g, or t
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
tcagagtcgagagacacgaccggtgctcgatttagcacacgatagttgggtttggggggggtctcaggaggcagcgctctcgggacgtctccaccatggcctggctctgctatcctcaccctcctnactcagggcacgagggtcctgggacccagtctgccctgactcagctgcctcgtgtctggtctcctggacnggtcatcacntccgtcngcactgaccactagtcgacggtttgtaactttataacgttcgtacgtcctaccgtcggtaacctaaccgtaaccgtaacccccggtactaaaaccgtaccccctaaactactactacgttacgtacgttttggtacggtactaaggtcggaacgttccgggtcccgacgttacggggtttcctcgtagttccgtcgttcccgtaccggtcctaccgtaagtcgtacggcgtacggccgaccgtaccttcccgacaccgtctccgtcggtcgtcctcgacggtcgacggtaacgggaacgtcggtaccgtagtttaacgttacgttaacgtcgtacgcgttacgtactaactaacgtaacaactaaacgtaacgtccggttaggtcgttacgggccggtacgtaaccgacgtccgtaccgtccgtaccggtactaccggacccgtaacggtcccgtacccgcccgttaccgtaccgttaaccttccccgttccccgtcccttacccccg

SEQ ID NO: 252293 - DNA, 639 bp, Homo sapiens
  misc_feature: GYAE6OF01CLUYX.49.35.D02.1.454.CMB.1.raw
  modified_base (340)..(340): a, c, t, g, unknown or other
  misc_feature (340)..(340): n is a, c, g, or t
  modified_base (475)..(475): a, c, t, g, unknown or other
  misc_feature (475)..(475): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcaggcacagggtcctgggcccagtctgccctgactcagcctgcctcgtgtctgggtctcctggacagtcgatcaccatctcctgcacgtgaaccaccaatggacgtttgtacttatattctgtctcctgtaccaacaactaccccggcaaactccccaaactcatcgtattcgtttgagtcagtgactccggcccgtcgtagggtttcncgtactcgtccttccgtccggtctccgtaacgtcgtcggccagccgacggtccctcccgtcgacctctccgtcgtcgggcctccgaggtccgtaggacggacgacggtctagtactttacgtacgtcgaccgtanccgtactataaaccgtaaactaaaccaattaaccgtacggtttggggttacgttaccggggaccggtaccgggaacctaaccggtcgacccgtcgtaccgtcgaccgtaccgacgtccctacccggccccttacggtccaccgttcctcccgttccccgtaccc

SEQ ID NO: 252294 - DNA, 930 bp, Homo sapiens
  misc_feature: GYAE6OF01CLYW5.49.35.D02.1.454.CMB.1.raw
  modified_base (104)..(104): a, c, t, g, unknown or other
  misc_feature (104)..(104): n is a, c, g, or t
tcagagtcgagagacacgaccggtgctcgatttagcacacgatagttgggtttgggggcatcacataacaaccagattcctcctctaaagaacgcccctgggancacagctcatcaccatggactggacctgggtaggttcctcgtttgtggtggcagcagctacgaggtcgcccgacggtccccgggtccaggtcgtgggtcgacaaacgttcggtggggtcgtaggtagggtagaaggtaaacgtccggttagggggttccggttacggggtacggtaacgggttcccttccggtacggaccggtaaacgggtcccgtttacggtaggggaaacctaaacccgttaaccccttttaaccgtaaaacccgttaaccgttttacggtaccgttccggtaaccgtacgggttcgggttcggggtaccggaccggtaaccggacccggggtcccccggtaaggtaaccggtaccgggtaccggtttacggggtaggggtacggggggtaagggaaccggtaaccgttaacccccgtaacccgttaacgttaaccgtttaaacgtaagtaaaccggtaaacctaaaaccggttactaaccggacccgtaaagaaaccgtaaccctaaccgtaacccggtaaccggtaacgaaaccggttaaaccttaccccgtaacccgttaccggtaaccggaaccgtaaacctaaaccgtaaccgtaaaccggaaacccaaccgtaacgtaacccaagtaacgtacgactcgacgactaccggtactacggactaccgtaccggaaccgtaacccgtaccgggtttaattaccgtttaacgttcggttaaggacggtaacgtagtaaggtccgttagtttaacgttactttagtagttaaacgtcgttaaacgttattaaggttccttaaagttgttaccg

SEQ ID NO: 252295 - DNA, 796 bp, Homo sapiens
  misc_feature: GYAE6OF01CHVI5.49.35.D02.1.454.CMB.1.raw
  modified_base (314)..(314): a, c, t, g, unknown or other
  misc_feature (314)..(314): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcaccatcctcctgcacgtaggaacccacaatgtacgttggtacttatattctgtctcctagtaccaacaactacccgcaaacgtacccaaactcatgatcttgacgtntagtgacgtccggacccgcgtacggggtttctcgtactcgtccttcgtccggtcctaccgaagttccgtaggtcacggccgaccggtcccgtccctacggaacccacttccgttccgtacgggtccctccggaacgggtctacggtacgggaccggacggtcgtaggtaactttaacgttaccgtacgtacgacgtaccttacgtaacttaaacctaaaactaaaaccaaacggttaaaacccgtttaacggggtttttacggggttacggggtttaccgggggtacccggggtacccggggaaaacccgttaaaacggtaccccgggttaaccccggtttaccccggttaaccggtacccgtaaccgggaacccccggtaaaccggggtaccccggttcccccggtaacccccccggttaccgggttacccctaacccggttttccccggttccccggttttaccccccgttccccccccg

SEQ ID NO: 252296 - DNA, 804 bp, Homo sapiens
  misc_feature: GYAE6OF01EOKZX.49.35.D02.1.454.CMB.1.raw
  modified_base (665)..(665): a, c, t, g, unknown or other
  misc_feature (665)..(665): n is a, c, g, or t
tcagagtcgagagacacgaccggtgctcgatttagcacacgataggttggggtttgggggggggtctcagggaggcagcgctcgtcgggacgtctccaccatggcctgggctctgctattcctcaccctcctcactcgagggcacgacgggtccgtcgggccagtctcgccctgactcgacgcctcgtccctccggtgtcgtcgggtcctaccgtacgggactacgtccgtaactaccgacctaacttcctccgtacggccgtaacggtaaccggaaaccctaaccgttaagtacggttaccggtttacggttaaacttttaacttaacttccgttacggttaccttaccggtacggtaaaaccctaaaccggttaaaccggttaaccccggaaccgtaaaaccgttaaccccaaaagttcctagttaacggtactttcgtacggacgttacgacggtagaccggtccggtaccggtacgggttaccgggttactaccgtacgttccgggtcccttaccggtccggacttaccgtaaggtccggtaacggaccgacggacccgtacggtacccttacccgagtaacctagttccgtacgggccgcgtacccgtgaccgtagacgggtacggtacgtgtaacgttctttaagtctacgcgtactanaacgtataaacaactaaacaacgtaacgtggtacggttacggcggtacgacgtaaacgacgtccgacgtacacgtccgagaccggacgtcccgaccgttccggtaaacctcgtaccttccgtccccgtacccttacccg

SEQ ID NO: 252297 - DNA, 641 bp, Homo sapiens
  misc_feature: GYAE6OF01AU2EE.49.35.D02.1.454.CMB.1.raw
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
tcagagtcgagagacacgaccggtgctcgatttagcacacgatagttgggtttgtggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctgtaccaacaactaccccggcaaacgtccccaaactcatgattctttagaggtcagtgactccggcccgngtacgggtttcncagtcgcttcctccggctaccagtctggcacgccaccggtccctccctgaccctactcctcgtcgggtcctccgaggcgttaggacgggacgaggtctagtactttacttacgtgccagtcctataattaactaaaccaaactaacttaaaccgtcggtttaggggttacgttccgggaccgggtaaccgggaacctaaaccgtccggaacccgttccgtaccgtaccgaccggtaccccgaacggtccgtccccggtacccccgttcggaccctacccttccgttcccgttacccccc

SEQ ID NO: 252298 - DNA, 671 bp, Homo sapiens
  misc_feature: GYAE6OF01DQ5VR.49.35.D02.1.454.CMB.1.raw
  modified_base (429)..(429): a, c, t, g, unknown or other
  misc_feature (429)..(429): n is a, c, g, or t
  modified_base (470)..(470): a, c, t, g, unknown or other
  misc_feature (470)..(470): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtcctccgtggacagtcgactccaccagtcctcctgccactggaaccacaatgacgttgtacttatattctgtctcctaggtaccaacaacgtaccccgctaaacgtacccaactcaatgacttcgtttaggaggtcaagttcgacgtccggcccgtcgtacggggtttctctacgtccgtactttccggccgtaccgtccgaaagttcgtaggcaagtccacggtccctccgtacaccgtntacgtcgtacggctaccggtagcgttaggacggtacgtagngtacgtatttacgttacgcgtacctagtcttacgaattacaacgtaaacgtaagtaaaccttcgggttagggttaccgttcgggaccgggtacggaaacccgtaagtcccgtaaaccgtcgtaaccgtacgtacgacccggtaggtccccgtaccggtcccccgttcgtaccctacttccccgttcgtccccccttacccg

SEQ ID NO: 252299 - DNA, 726 bp, Homo sapiens
  misc_feature: GYAE6OF01A9NWG.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcacatctctgcactggaaccacaatgtacgttgtacttatattcgtgtctcctagtaccaacaactacccgacaacgtacccaaactcatgacttcgtttagagtcagtgacgtaccggccgtacggtacgggtttcactacgtccgtacttccgttccggcctaccgtaaacggttccgtagggtaccgacggaccccggtaccgggtacccccttcccccggtaacggtaacccctacgttcccgtttccggtaccgggggtcccttacccgtagttccggtacggtccgggaaagggtacgagggtctttaggttaaattttaactttacgacggacaacgtacctacgtattacgacggacgacggacacgtaaactaaactttagtttacggaacgttaggttaccggttacggggaccgggtaacggtaacccgtaaggtcccggtacgggacccgttccggtaacggtccggaaccggtaacccgaccggtcccgttaccccggtaccccccggg

SEQ ID NO: 252300 - DNA, 910 bp, Homo sapiens
  misc_feature: GYAE6OF01CPPAC.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtcgcccacggtcccgggtccaggcctggtgcaagtcgtggggctggagggtgagaagccgtgggtcgtggtgaacggtctccgtgacgaggcttcgtggacgactaccttaccaactacgtttgccttggtacaggtcgtaggggtcgccggtacgccggccccgtaggaaccgacgggtacccgttagggagggtacggggtacgggaaggtccgtacccgtaacccccgttagttacccgttaaagtaacgtaacggtaacctaaaacgttacgtaccgaaccgaacaacggtaaccaacgtttacccgaaaccggtaaccgtaacggtaccgttaacccgtaaccccgtttacggtacccggtaacccgggtaaaacctaaaccgttaaccccggaaacccgtaaacccgtaaccgtaacccgggtaacccttaaaacccggaacgggtttaaaccggggaaacccgttacccggggtaaacccgtacccgggtaaaccggttaaccccgggttaacgggtaacctttcgggtaacccgggaaccccccgggttaacccgggaaccggggggttttaaccccctttaaagtttttccggttttccggtaaccgggttaccgggtaacgggttaaacggtaacggtaacgggtttacgtttacgttttacccgtttaacggtacggtttaagtaaacggttttaccgttaaacgttacgtttaaccgttacgtttcgttaccgg

SEQ ID NO: 252301 - DNA, 758 bp, Homo sapiens
  misc_feature: GYAE6OF01B8B8Z.49.35.D02.1.454.CMB.1.raw
  modified_base (167)..(167): a, c, t, g, unknown or other
  misc_feature (167)..(167): n is a, c, g, or t
  modified_base (717)..(717): a, c, t, g, unknown or other
  misc_feature (717)..(717): n is a, c, g, or t
tcagagtcgagagacacgaccggtgctcgatttagcacacgatagttgggtttgggggcatcacataacaaccagattcctcctctaaagaagcccctgggagcacagctcatccaccatggactggacctggaggttctctttgtggtggcagcagctacaggtcncccgtacgtcccgggtccagtcgtaggtcgctaatccgtggggctggaggtagaagtaacgtcgtggggtaccggttcggtaggtaacggtcctcctggacaacggtcttacgtaggacgacctaccttacgaaacctacgtttcgcttacggtacacgggtcgtaggggtcgtaccggacgtacccggtcccgtagggaacccgacgggttccgttagggtacgggtacgggggtacgggaacggtacccgtacccttaaccccgttacgttacctttaaagtacgtaacgtaacccgtaacgttaacgcggtaacaacgtaacggaccttaccgtaaccgaccgtaagaacggtctaacccgttaccttcggaccgaacgtaaacaccgtaaccgaactacgaaccgtacgaccttacgaacggttaggtacccgtagcccgttaaccggacgtaccgtaacgtgtacccgtagacccgggtacctcgggttacttattacgtccgtaaggtccgaagttcggaagttcgtacgtttgtttaaccgtnttaaggccttaggttaaccgatttagtacctagttctaccg

SEQ ID NO: 252302 - DNA, 683 bp, Homo sapiens
  misc_feature: GYAE6OF01BRAFP.49.35.D02.1.454.CMB.1.raw
tcagagtcgagagacacgaccggtgctcgatttagcacacgatagttgggtttgggggggggtctcaggaggcagcgctctcgggacgtctccaccatggcctggctctgctattcctcaccctcctcactcagggcacagggtcctgggcccagtctgccctgactcagcctgcctccgtgtctgggtctccgtggacagtcgatcaccatctcctgcactcggaaccaccaatcggtacgtttggtacttatattctgtctctaggtaccaacaacgtacccggacaaaccgtaccccaaactcatgtacttctttaggagttcagtgacgtccggcccgtggtacgggtttctctacgtccgtcgttaccgtccggtcctaccgtaacgtcgtggcctacgccgtaccggtccccttcccgtacgtaccctacgttccgtcgtcgggtcctaccgaggttacgacgggaagggtaccggaaggtcgtagtactttacgtatcggactacgtctactaacgtaactaaacctaaagtaacgttaaacgtgggtttcgggtacggttccgggaccgggaccgtaaccgtaacgtccggtacccgtacgtaccgcgaccgtaccgcggtaccctacccggtccccgttacgtacctaccggttccctcccgttccccctaccc

SEQ ID NO: 252303 - DNA, 732 bp, Homo sapiens
  misc_feature: GYAE6OF01DFBAQ.49.35.D02.1.454.CMB.1.raw
  modified_base (361)..(361): a, c, t, g, unknown or other
  misc_feature (361)..(361): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
tcagagtcgagagacacgaccggtgctcgatttagcacacgatagttgggttggggggggtctcaggaggcagcgctctcgggacgtctccaccatggcctgggctctgctattcctcaccctcctcactcagggcacgacgggtcctgggcccagtctcgccctgactcacgcctcgcctccgtgtcgtgggtctccgtggacagtcgatcaccatctcctgcacgtacgaaccaccaagtcgtagtttacgtactatattcgtgtctccgtacgtaccaaacacctacccgacaacgtcccaactcatgtatcgttgtacggtcagtacgacgtccggcccgtaggttacgggtttccnctacgtccgtcgttccgccggtcctacgtacgtgtcggacacggcccgaccggtccctacccgtacgaacctacttccggtccgttcgggccgtaccggagggtcgtacgggaacggtaccggtagacggtttaacttagtttacgtaccgtnaccgtnacgttactaagtaaccttaaccgaaattaaccgtaacgtttagggtcgggttaacggtcgggtaacccgggaaccgtaaccgtaaccgttccggtaaaccccgttacgtaacccgtccggtaacccgaaccggttaaccggcccccgttaaccccgtccccggttaccgtaaacctcccggttccctttaaaccccgttcccccttcccccg

SEQ ID NO: 252304 - DNA, 567 bp, Homo sapiens
  misc_feature: GYAE6OF01E3M9I.49.35.D02.1.454.CMB.1.raw
  modified_base (447)..(447): a, c, t, g, unknown or other
  misc_feature (447)..(447): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgagtcagtgatcggcccgcacggggtttctcatcgtcttctccggctccaagtctggcagcacggcctccctgaccatctctcgggctccgaggctggaggacgaggctgtattattactgcagctcatacaacaactaanaaactacgttgggttacgttcggaccggacggaaccaacgtcgacccgtaccgtacgtcgagacccgaaggtccgtacccgcccccgtcggtacctaccttccttcgttcccccgtcccc

SEQ ID NO: 252305 - DNA, 551 bp, Homo sapiens
  misc_feature: GYAE6OF01D0QU8.49.35.D02.1.454.CMB.1.raw
  modified_base (200)..(200): a, c, t, g, unknown or other
  misc_feature (200)..(200): n is a, c, g, or t
  modified_base (276)..(276): a, c, t, g, unknown or other
  misc_feature (276)..(276): n is a, c, g, or t
  modified_base (342)..(342): a, c, t, g, unknown or other
  misc_feature (342)..(342): n is a, c, g, or t
  modified_base (429)..(429): a, c, t, g, unknown or other
  misc_feature (429)..(429): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccacaatgacgttgtactatattctgtctctgtaccaacaataccccggnaaacgtcccaaactcatgatctttgaggtcagtgatcggcccgctaggggtttctcattcgcttcnccggctccaagtctggcagcacggcctccctgaccatctctgggcctccgaggctggaggacgaggctagtattatactgcagctanaatataacaaactaataaacgacgttgggtcgttcggacggacggacctaaacgtcgaaccgtcctagtccagacccgaggcctcgcccccgttggtacctactccgtccgttccccgtccc

SEQ ID NO: 252306 - DNA, 886 bp, Homo sapiens
  misc_feature: GYAE6OF01B7WC6.49.35.D02.1.454.CMB.1.raw
  modified_base (298)..(298): a, c, t, g, unknown or other
  misc_feature (298)..(298): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttatattctgtctctggtaccaacaactacccgacaacgtcccaaatcatgatntttgaggtcagtgagtccggcccgtcggtacggggttttctctacgtccgtccgtttccgtcccggtccttaccgaaacggttccgtacggggccaacggtacccgtaacccggtccccgttacccccgtaccggtaacccctaacgttcccgtttccggttaccgggggtcccttaccccgggtaaggggtcccgttaagggtaaccgggggtaacccggtaccgggggtaccgttacgggttaaacgttttaacgttttaacccgttcgggacccgttaaccggtaccgtttaacctaaacgtttaaacttaaaaaccgtaaaacccttaaaacgttaaaaacccggtttacgggtttttaccgggggttaaccgggtttaccgggggaacccggggtaacccggggtaaaaccccttaaaaaccggttcccgggtaaaccccggttaccccgttaacccggttaccccggaaccggtaaacccccggtaaacgggtccccgttcccccggttaccccccccggttaccgggttaccccgtaccccgttttcccggttccccggtttaccccccgttcccccccgg

SEQ ID NO: 252307 - DNA, 687 bp, Homo sapiens
  misc_feature: GYAE6OF01EK1DL.49.35.D02.1.454.CMB.1.raw
  modified_base (201)..(201): a, c, t, g, unknown or other
  misc_feature (201)..(201): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctctgcactgaaccacaatgacgttgtacttatattctgtctctgtaccaacaacgtacccgacaaacgtaccccaaactcatgtacttcgtttggacggtcaggtgacgtccggcccggtcgtacggggttttctctactcgtcttccgtccggctaccaacgttcgtcggacacgccgacccggtcctccccgtacgtaaccctactccgttccggtcgggtcccgtccgacgggtcgtagggaacggggacggacggtacgttagttaacttttacgttacgtcgaccgcgttacctactaacttaactaaaccaaactaacttaaacgttacggttgggttacggttaccgggccggtaaccgggtaacctaacgtcggtacccgtaccgtacgtaccgacgtacccgacggtcccgtccgcccccggttacgtaccctacccgttccgttccccgttcccctacccccg

SEQ ID NO: 252308 - DNA, 658 bp, Homo sapiens
  misc_feature: GYAE6OF01DPSE7.49.35.D02.1.454.CMB.1.raw
  modified_base (195)..(195): a, c, t, g, unknown or other
  misc_feature (195)..(195): n is a, c, g, or t
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctgccctgactcagcctgcctcgtgtctggtctctggacngtcgatcaccatctccngcactcggaaccacaatgtacgttggtacttatattcngtctcctgtaccaacatacccggacaaacgtacccaactcatgtattctttgagtcagtgctcggccgtacgtagggtttctacactccgcttcgtccgacctcgtaacgtcgtcgactacggcacccgtcctcccgtgaccctacttcctcggtcgggtccctaccggtcggtaccgttgggaacgggtacggacggtaccgttaatttaacgttaccgtaggtaaccgtaacgtaggtacggtacgttacccgacgggtcctagggtacgtgggttacgtagggtgggttggttccggggacgggtaaggaccgaggtccgtacgtacccggtcgtaggaccgaccgtacccggtaggcccgtacgggtcccccgttaccggcccgttacgttcccgttcccccgg

SEQ ID NO: 252309 - DNA, 724 bp, Homo sapiens
  misc_feature: GYAE6OF01CB90G.49.35.D02.1.454.CMB.1.raw
  modified_base (326)..(326): a, c, t, g, unknown or other
  misc_feature (326)..(326): n is a, c, g, or t
tcagagtcgagagacacgaccggtgctcgatttagcacacgatagttgggtttggggggggtctcaggaggcagcgctctcgggacgtctccaccatggcctggctctgctattcctccaccctcctcactcagggcacgagggtcctgggcccagtctcgccctgactcagcctgcctccgtgtcgtgggtctccgtggacagtcgatccaccagtcctctgcacgtcggaaccacaatcgtacgttggtacttagtaacttctcgttcctaccgtcggtaaccaaacaaaccgtacccggaaccaaacgtaccccaaactcatnactcttgacgtcaggtcgacgtacggccgtacgttacgggttctacgtactcgtccttccgtccggtcctaccgtagtcgtcgcgacgccgtaccgccctcccgtacacctacgttccgtcgcgggtcccgactacggccggtaggtaacggacgggtacgacgttaggttaacgtttacgttactcggtaccgacttctacgaacttaaactaacaaactaaagtacgttacggggttacggggttcgtacccggggtaggtaacccggaacccgttaagtacccgggttaccgtaccgtacccggtaccgtacggtaacccccggacggttacccctccccgggtaccccgttacccggtctacccgttcccgttcccggtcccccggttaccccc

SEQ ID NO: 252310 - DNA, 674 bp, Homo sapiens
  misc_feature: GYAE6OF01EIAWL.49.35.D02.1.454.CMB.1.raw
  modified_base (221)..(221): a, c, t, g, unknown or other
  misc_feature (221)..(221): n is a, c, g, or t
tcagagtcgagagacacgaccggtgctcgatttagcacacgatagttgggtttgggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcacnggaaccaccaatcgtacgttgtacttataattctgtctctgtaaccaacaactacccgcaaacgtaccccaaactcatagtatctttgaggttcagtgacgtccggcccgtcgtaggggtttctcgacttccgtcttccgtccggtcctaccgtaacgtcgtggtacacgaccgacccggtcccttcccgtacgtaccctacttcccgttccgtacggggtcccttccgtacggtcgtaggaacgggacgtaggtctagtaactttactttacgtgaccgtagtactacaacttaactaaacaaactaactaaacgtacgtttacggggtcgttacgggaccggtaccggaaacccttaacggtacccgtaccgttaccgtaaccgtcgacccggacccgtacggtccctacccgccccgttaccgtctacccttcgttcccgtccccgtccc

SEQ ID NO: 252311 - DNA, 838 bp, Homo sapiens
  misc_feature: GYAE6OF01CKTOI.49.35.D02.1.454.CMB.1.raw
  modified_base (220)..(220): a, c, t, g, unknown or other
  misc_feature (220)..(220): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacgagggtcctgggccctagtctcgccctgacgtcacggcctgcctccgtgtcgtcggtctcgtgacagtcatcacatctcngcacgtacggaaccacagtagtacgttgtacttatattctcgtctcgtacgtacaacgtaacgtacccggaacaaccgtacccaaagtcctaagacgttacgttacgttaggacgttacgtacggtacgtacggtcccggaccgttacgggttacggtttctacttccgtcgggttccttccggtccgtacgtaaccggtaacgtcggtaccgacgtaccggaccgtacccggtcccgtaccgacgttaaccctcggttccggtcggttaccggtccgtaccggtacggtacggtacggaacgggacggtacgttacggttaagtttaacgttaacgttacacgttaacgactaccgttaactaaacgttaaacctaaaccttaaaacgtaaaccggtttaacggtaaccgggtttacggggttacccgggttaacggggtacccggggtaaacccgtaaacccgggtaaacctttacccgggacccggttaaccgtaacccggtaacggtacccgggttaaacccggtcccgggttaccccgtaaccccggttccccggtttaacccggttacccttacccggtttccccgtaaccccgtttcccccctttaaccgg

SEQ ID NO: 252312 - DNA, 584 bp, Homo sapiens
  misc_feature: GYAE6OF01CFGBJ.49.35.D02.1.454.CMB.1.raw
  modified_base (253)..(253): a, c, t, g, unknown or other
  misc_feature (253)..(253): n is a, c, g, or t
  modified_base (291)..(291): a, c, t, g, unknown or other
  misc_feature (291)..(291): n is a, c, g, or t
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
  modified_base (545)..(545): a, c, t, g, unknown or other
  misc_feature (545)..(545): n is a, c, g, or t
  modified_base (565)..(565): a, c, t, g, unknown or other
  misc_feature (565)..(565): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccgagtcccgggtccagctgggtgcaatcgtgggctggaggtgagaaagccgtgggtcgtcggtagaggtctcctgcgagtcttgnggacgacaccttcaactaactttgctgtcagcgtgggngcgcacggccctggacaggccttggnggtgggaggagactacccaccctataccttaanactacgacaaactagcacacaacgacctacgtaccacgaacagaccttaccacccttagtaccgacgtaacaacctcccgaacgtaaccacaacgcctaacgacgttacggctccgacctcgacgtacgtacgtagtctacgccgtaccggaccgtaccgttactagtttactcggtgacgtagagtacgtagtntttcttctagtatacgttanacggttatctagttatccg

SEQ ID NO: 252313 - DNA, 704 bp, Homo sapiens
  misc_feature: GYAE6OF01CHQ8M.49.35.D02.1.454.CMB.1.raw
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
  modified_base (360)..(360): a, c, t, g, unknown or other
  misc_feature (360)..(360): n is a, c, g, or t
  modified_base (434)..(434): a, c, t, g, unknown or other
  misc_feature (434)..(434): n is a, c, g, or t
  modified_base (499)..(499): a, c, t, g, unknown or other
  misc_feature (499)..(499): n is a, c, g, or t
tcagagtcgagagacacgaccggtgctcgatttagcacacgatagttggggtttggggggggtctcaggaggcagcgctctcgggacgtctccacatggcctggctctgctattcctcaccctcctcactcagggcacgagggtcctgggccagtctgcctgactcagcctgcctcgtgctgggtctccgtggacagtcgatcaccgatctccngactacgcggaaccacaaagtcgaacggtttggtaactttataacgtttcgngttccttccgtacggtaaccaacgaaacgtaccccggactaaaacgtacccaaactcatgattcgtttagacgtcgaagtcgacgtccggccgnggttacggtttcacagtcgcttcgccggtctaccgtaagtcgtggcacgacgaccggtcctaccctgtaccctntccgtcgtcgggtcctccgaaggcgtcggaacgggaccgtaggcttacggtaatttacgttacgngttaccgagtaccttcgtaaataactaacgaaacgtaaactttaaacggtacggtttacggggttcgttaaccggggcgtaacccgggaaactaaccggttacggtaccctaccggtaccggtaccaccgggtacccgtaaacggggccctcccggtaccccgtccgggtaccttcccggttacctccggttaccccctaccccg

SEQ ID NO: 252314 - DNA, 606 bp, Homo sapiens
  misc_feature: GYAE6OF01EXD4C.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctgggctgaggtgagaaagctgggtcgtcggtgaaggtctcctgcaaggcttcgtggagacaccttacaactaacttgctgtcagctgggtcgcgacgacggccccgtaggacaaggccttaggaggtggggtgggaaggtactaccgacccctatccttaatatagacaaactatcgacacagactactccacgacagacgtctacctacgtcgaccgaacaactccgaacgaacacacgtaccctaacagtacggaacctgaccgacgtaacgcccgtaggacttcgtacgacccgacgtaccggggtacttacttacgtttacgtggtcgacggtaagacgtaaggttacttacgtttcgttttacgtagttaggaactttacggtacttaaggttcttaaattagtccg

SEQ ID NO: 252315 - DNA, 768 bp, Homo sapiens
  misc_feature: GYAE6OF01DF7SV.49.35.D02.1.454.CMB.1.raw
  modified_base (119)..(119): a, c, t, g, unknown or other
  misc_feature (119)..(119): n is a, c, g, or t
  modified_base (216)..(216): a, c, t, g, unknown or other
  misc_feature (216)..(216): n is a, c, g, or t
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
tcagagtcgagagacacgaccggtgctcgatttagcacacgatagttgggtttgggggggggtctcaggaggcagcgctctcgggacgtctccaccatggcctgggctctgctattccnccaccctcctcactcagggcacgagggtcctgggcccagtctcgccctgactcagcctgcctccgtgtctgggtcctcctggacagtcgatccaccntctcctgccacgtcggaaacccactaatcgtacgttggtacttatattctntctctacgtaccaacaactcccganaacgtcccaactcatntattcgttgagtcagtcgacgtccggccgacgtcgggtttcactatccgtccttctccggctaccagttcnggtacacgccnccggtccctccgtacgacctcgttcctccggtcggccctcggtacggtcgtacgggaccgggtacggcggtacttaagtttactttacgttacgtacgacctaggtacccttaacgtaaacttaacctaaaccggtaaaaccttaaaggtttaaccgggtacgggttttacgggggtacccgggttaaccggggtccccgggttaacgggaaccccgttaaaacccgggttcccggttaaaccccgggtttaccctaacccggggtacccgaacgggttacccccggtaaaccggttccccggttaccccccggtaccccggtttaccggtaaccttaccccgttttacccggtcccccgtttccccccggtaacccc

SEQ ID NO: 252316 - DNA, 738 bp, Homo sapiens
  misc_feature: GYAE6OF01AOYTT.49.35.D02.1.454.CMB.1.raw
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctgggcccagtctcgccctgactcagcctgcctccgtgtcgtcgggtctccgtaggacaggtcgactccacctactcctcctgacaccgtacggaaccaccaagtcggtaccgttagttacttattaattctcgtctccgtacgtaccaacaacctacccgacaacgtacccaactctatgtattcgttagacgtcgagtacgacgtccggccgtcggtacgggttctactacgtcgtccgttccgccgtacctaccgtaacgtcgtcgacacgtccgaccggtccctccgtacgtaacctctccgttacgtccggcgtaccggacggtacgtaccgggaagggtaccggacgttacgtaacgttacgttacgttaccgtgaccttacggaccttaacgtagtaaacctaactaaacgtaacgttaacggttacgggttgggttaccggttccgggaaccggaccggaaccgtaaacttccgggtaccccttacggtaacccggttacgaacccgtaaccggtaccggttccccgtacccgttccccggtacttacccgtacccgtttacccgtccccgtttccccgtaccccg

SEQ ID NO: 252317 - DNA, 773 bp, Homo sapiens
  misc_feature: GYAE6OF01CTJKW.49.35.D02.1.454.CMB.1.raw
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (525)..(525): a, c, t, g, unknown or other
  misc_feature (525)..(525): n is a, c, g, or t
tcagagtcgagagacacgaccggtgctcgatttagcacacgatagttggggttgggggggggtctcaggaggcagcgctctcgggacgtctccaccatggcctgggctctgctattcctccaccctcctcatcagggcacgacgggtcctgggcccagtctcgccctgactcacgcctcgccctcgtgtcgtgggtactccgaggacagtcgactcaccnctctccgnccgaanacgaacccactaagtcggttacgttacggtaacttagtaacttctcgtcctacgttaccggaaccaactaacccgtaccccgaactaaacccgtacccaactactagtacgttactttcgttagacggtacgtacggcgtaccggtccccgggtccgtacggttacgggtttaccacgtccgttaccggtccgttacccgtccggttaccaccgtaacggtcgtacggtacgccgtaccgacccgtcccgtcccgtaactaccgtcctccggttacggtcggtactccggnggtacggtcggaacggtagtacgtagtagttacttacgtacgtcgaccgtaacttccaaccggttaactaaaccgaaacgttaaacgaaaccgtttaaggtacccgggttggggtaccggttcggggaaccggtaccgaaacgtacccgggtagtaccccgaggtacccgaaacggtcccgtaacccggccggtccctccccggttccgtacccttactccccttacccgtcccctaccccgtccccc

SEQ ID NO: 252318 - DNA, 721 bp, Homo sapiens
  misc_feature: GYAE6OF01BEZXK.49.35.D02.1.454.CMB.1.raw
  modified_base (249)..(249): a, c, t, g, unknown or other
  misc_feature (249)..(249): n is a, c, g, or t
  modified_base (637)..(637): a, c, t, g, unknown or other
  misc_feature (637)..(637): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtcgcccaggtcccgggtccagctggtgcaatcgtgggctggaggtgagaagcgtgggtcgtcggtgagtctctgcaggtcttcgngagactaccttacaaccttacttgcttgtcgagtcggtggtcgccgacgaccggtccgtaggaccgtacggtccgttaggagggttggggtagggtaacggtacgtacccctacccgttaatttaccgttaaatacgttaacgaaccgtaaacttactacgaacctaacgacgtaaccctaacttacccgaaacgacgtacggtaccttacccgtaacccgttacgtacgaacccgtaaaccaaccgtaaccgaaaccaaccaaccgtaccgtaaccctaagtaccgttaacgggaccgttacgacccgtacgtaacccggttaccgtaacggaccgttcggaaccggtacccggtaaccgtaccggtacgttactttacggtttcgnggtaccgaggttacgagtacgttcgtttcgttactttcgacgttaaggttaactaggtaccgtttaatcttttaggtcttacgg

SEQ ID NO: 252319 - DNA, 741 bp, Homo sapiens
  misc_feature: GYAE6OF01C0MIK.49.35.D02.1.454.CMB.1.raw
  modified_base (205)..(205): a, c, t, g, unknown or other
  misc_feature (205)..(205): n is a, c, g, or t
  modified_base (269)..(269): a, c, t, g, unknown or other
  misc_feature (269)..(269): n is a, c, g, or t
  modified_base (576)..(576): a, c, t, g, unknown or other
  misc_feature (576)..(576): n is a, c, g, or t
  modified_base (728)..(728): a, c, t, g, unknown or other
  misc_feature (728)..(728): n is a, c, g, or t
tcagagtcgagagacacgaccggtgctcgatttagcacacgatagttggggtttggggggggtctcaggaggcagcgctctcgggacgtctccaccatggcctggctctgctattcctccaccctcctctactcagggcacgagggtcctgggcccagtcctagccctagacctcacgcctgccctccgtgtctagggtctccgnggacagtcatcaacctctctcctagcacgtacgaaccacaatcgaacgttagtacttatattcngtctacgtacggtaaccaacaaaccgtaccccggtacaaaaccgtacccctaaacgccgtaatcgtaacttcttaggaagtcgagtcgacgtaccgccgtacgtacgggtttccacgctacgtcctaccgtccgggtacctccgtaacggtctcggacaacgccgaccgtcctacctacgtacccaactttcggcgtacggaccgtaccggtaacggcggttacgaaaccggacgggtacggtaactaggttaaactttacgtttaacgcgtaaccgacttaccgtaaccttaaataaccgttaaanaaaaccttaagaacccggttaggttcggggttacccgtacgggacccgggttaacgaacctaacgggttaccgaccgttaccgggtaacctacggaacccgaccgtacggtacccgtcccgacccgttacgaccctacccgtccgttccccncccccgttccccg

SEQ ID NO: 252320 - DNA, 880 bp, Homo sapiens
  misc_feature: GYAE6OF01AND14.49.35.D02.1.454.CMB.1.raw
tcagagtcgagagacacgaccggtgctcgatttagcacacgatagttggggtttgggggggggtctcaggaggcagcgctctcggggacgtctccaccatggcctgggctctgctattcccttccaccctcctcactcgaggcacggtacggtccggtcggaccgctctccgtcctacgactcgcgtcctcgtccgtcgtcgtcggtcggttctcgtggactcgacgtactccaactcttcctcgtcactaccgtaacgaaccctacgtagtcggttacgtttacgtaactttacttacttcgttcgtaccttaccgggtaacctaaacctaaccgtaaccccgtaccggaaacctaaacccgtaaccctaactacgtactacgtactttacggttacggacgtttagacggttcggtaccggtacccgggccggttacgggttttaccggttacctaaccgtcgttacccgttcccttcccgtaccgtaaccgtaaccgtccgttacggcctacggggacccgtacccgggcccgttacccgttaaccgaacgttcctcccggttccggtacggtacccgtccgtacggtcggtacggacgggtacggtacggtacgtacgtacgttacgttacgtacggtacgacgtacgtacctaacgtaactaacttaaacgtaacttaaacggtaccggtttacggggttacgggttaccgggtaccggggtaaccggtaaccggaaacccggttaaccggttaccggttaccccggttaccggtaaccggtaccgggtacccgacccgttaacccggtcccgggtaccccctaccggttcccgttacccttacccggttcccgttccccgtccccgttcccccg

SEQ ID NO: 252321 - DNA, 761 bp, Homo sapiens
  misc_feature: GYAE6OF01D2X5M.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactacggaacccaccaatcgtacgttggtacttataattcgtgtctacctcggtaccaacgaactaccccggacaaacgtacccaaactcatgtacttctttaggagtcaggtgacgtccggcccgtcgtaacgggtttctacgtacgtccgtcttccgtccggcttaccgtaacgtcgtcggcgaacgtccgaccggtcccctccccgtcggaacctacgttccgtaccggttcggggtaccgtccgtacgggtcgttacgggaaacgggtacgggacggtacgttaggttaactttacgtttacgtacgacgtacggtacctactaacttaaactaaacctaaaactaaaccgttaaaccgttacgggtttaggggttaccgggttacggggaacccggggtacccggtaaaccgtaaaccgtaccggtaccccgttaccgtacggtacccgtaaccgacccggtaacggccccgtccccggtaccccccgttccgggttaaccctcccgtttccccgttcccgttcccccgtaacccccg

SEQ ID NO: 252322 - DNA, 801 bp, Homo sapiens
  misc_feature: GYAE6OF01ETE98.49.35.D02.1.454.CMB.1.raw
  modified_base (607)..(607): a, c, t, g, unknown or other
  misc_feature (607)..(607): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctcgcctgactcagcctgcctcgtgtctgggtctccgtggacagtcgatccaccatctcctgctacgtacggaaccaaccaagtggtacgtttggtaactttaattaacttcctgttccttaccgtcggtaaccaaactaaccgtaccccggtaactaaaccgtaacccctaaactacactacgttactttacgtttggacggttacgtaggttacggtacggtcccgggcccggtacggttacggggttttactccgtacgtccgttcctttcccggtaccggtacctacccgtaacggtccgtacggtacgacccggtaccgtacccggtcccctttacccgaccggtacctacgttcccgttcgggtaccgggtccttacccgggaacgggtcgggtaacggtaacggggtacggtaccggtacgtaagttacttttaccggttacncggtactacgtactactaacttaaactaaacctaaacgtaaacttacggttacggtttcggggttaccggtaccggggacgggaccgaaaccgtacgtaccgtacccgtaccgttaccgacgtaccgacccggtacggtcccgtcccgggtacccctcgggttacctaccttcccgttccccgtccccgttccc

SEQ ID NO: 252323 - DNA, 683 bp, Homo sapiens
  misc_feature: GYAE6OF01BPQJ6.49.35.D02.1.454.CMB.1.raw
  modified_base (210)..(210): a, c, t, g, unknown or other
  misc_feature (210)..(210): n is a, c, g, or t
  modified_base (460)..(460): a, c, t, g, unknown or other
  misc_feature (460)..(460): n is a, c, g, or t
tcagagtcgagagacacgaccggtgctcgatttagcacacgataggttgggtttgggggggggtctcaggaggcagcgctctcgggacgtctccaccatggcctgggctctgctattcctcaccctcctcactcagggcacgacgggtcctcgggcccagtctcgccctgacctcacgcctcgcctccgtgtcgtcggtcctcctggacngtcgactcaccatctcctgacactacgaaccaacagtcgtacgttagtacttatacttctgttcctacgtacgtaaccaacgtaaccgtaccccggaactaaaccgtacccaaactcgatgtacttcgtttaggacgtcagtcgaccgtccggccgtcggttaggttctacgtacgtccgtcgttaccgccgtctacgagttcacgacacggtccgaccgtccctctacgaccctgtccgtgaccgtccncggagtcgacggaggacgtacgtacttagtatttacgtactgactcgtacaatataaccaaatacgtaaatcggttacgggttcggtaccggtaggaaccggtaccgaaacctacggtccgaccccgttaacgtcgaacggtcccgaaacccggtcgacccgttcccccggacccgttaccggttacctaacccggttccccttcccggtttccccctacccg

SEQ ID NO: 252324 - DNA, 721 bp, Homo sapiens
  misc_feature: GYAE6OF01C0A6U.49.35.D02.1.454.CMB.1.raw
  modified_base (143)..(143): a, c, t, g, unknown or other
  misc_feature (143)..(143): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacgngggtcctgggcccagtctcgccctgactcacgcctcgcctccgtgtcgtcgggtctccgtggacagtcgataccaccacttcctcctgcacgtacggaacccacaagtgtacgttacgttacttaatattcgtcgtcttccgtacgtaaccaactaaccgtacccgaacaaaccgtacccaactactactcgattcgttacgaggtcagtcgacgtccggccggtacggtacggtttcacgtactcgtacctcgtccgctacgagtcgacggcacgaccgccggtccctccgtacactactccgtcggtcggtaccgtccgacgggtacgtacggacgggaacggtacggtacgttaacgttacgttaccgttacgtacggtacctacgtacctagtaacctaaacgtaactaaaactaaacgttaacggttacgggttacgggttccggttaccggggtaccggtaccggaaccgtaaaccgtacccgtaccgttaccgtaccgtaccgaccgtaccggcgtccccgtacccgtcccgtacgtacccgtaccttacccgtccccgtccccgtacccc

SEQ ID NO: 252325 - DNA, 868 bp, Homo sapiens
  misc_feature: GYAE6OF01DLICS.49.35.D02.1.454.CMB.1.raw
  modified_base (220)..(220): a, c, t, g, unknown or other
  misc_feature (220)..(220): n is a, c, g, or t
  modified_base (468)..(468): a, c, t, g, unknown or other
  misc_feature (468)..(468): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcgagggcacgaggtccgtgggcccagtctcgccttgactcacgcctgccctcgtgtcgtcgggtctccgtggactagtcgactcaacctntcctcgtacgacctacgaccgaaccaactaagttcgtacggtttacgtacttaacttaatttcgtacgttccctaccgtacggtaaaccaaacgtaaaccgtaacccccggaactaaacccgttaacccctaaactccgtaattacggttacgttaccgtttaggacggttaccgaggttacgtaccgtccggcccggtacggttacgggttcctacgtcgtcgtccttcgtccgactaccgtagtcncggcaccgaccgtccgtaccctccgtacgacctacttccggttcgccggttccgacggacggtccgagggtacggacggtgtacgttaacggttatttactaccgtacgtacgtacgtcccttaaagttaactaaacctaaacgtaaaccgtaaaaccgtttaaacgggttacgggtttaccgggggtttaaccgggtcccgggggttaacccgggggaacccggtaaaacccccggttaaagggtaacccccggttacccggttaaaccccgtaccggtaacccgggtacccgggttaaccccgaacccggggttccccgtaacccccggttccccgggttacccggttaaccctcccggttttaacccccgtttcccccggttaacccccttcccccg

SEQ ID NO: 252326 - DNA, 648 bp, Homo sapiens
  misc_feature: GYAE6OF01CQUQK.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttatattctgtctcctgtaccaacaatacccgcaaacgtccccaaactcatgattctttgagtcagtgatcggcccgcaggggtttctcatcgcttctccggctccaagtctggcagcacggcctcccgtcgacccatcctcgtcggggcctcccgacgggtcttcggaacgggacggacgggtctacgtaactttattaacttcggaccaagtcctactaactaataacaaaaccaacttaaaacgtacgttggggttcgttccggggacgggaccgggtaaacctaaccgtacgaccccggtacccgttaccggtaccacgggaccccgaacgggtaccgttcccggccccccgttacccgggtaccctaccgttcccttccggttccccccttaccccccg

SEQ ID NO: 252327 - DNA, 786 bp, Homo sapiens
  misc_feature: GYAE6OF01A5R4B.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttatattctgtctcctggtaccaacaactaccccggacaaacgtccccaaactcatgtattctttagaggtcagtgacgtccggcccgtcgtaggggtttctacatccgtaccttccgtccggccttaccgaagtccgtggcacgcgacccggtccctcccgtacgacctacttcccgtacgtcggggtccttaccgacgggtccgttagggaacgggaaccgggtaggtaccgttagggttaacttttaacgtttaccgtacggtaccgtacggtaccttaactaacgttaaaccttaaaacctaaaactaaaccgtttaaaacgtaccgggttttacgggggttaccggtttacccgggggtacccggggtaacccggggtaaaaccccgtaaaccggttaccggtaaccccggttacccggttaaacccggtccgaacccgggtaccccgtaaacgggttcccccgtaccccggtacccccccgttacgggttccctaaccccgttcccgtttaccccgggttccccccgttaccccccg

SEQ ID NO: 252328 - DNA, 906 bp, Homo sapiens
  misc_feature: GYAE6OF01CQ0NF.49.35.D02.1.454.CMB.1.raw
  modified_base (229)..(229): a, c, t, g, unknown or other
  misc_feature (229)..(229): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgagtcaccatctcctgcactggaaccngcagtgaagttggttagggatttactaaccttttctcctggtaccaacaacacccaggacaaacgaccccaaactcatcgtattactgacgccgatcacgtccggaccctacgaacgggggtctcgtcgaacgttcggtcttccgtcgttacggccttcccgtaacggttctacgggtacacgacccgtaaccgggccccttacccgttcgaacctaacgtttaccgttccggtccggggtacccctttacccgggaacggtaccgggtttcggggggaaaccggttaacgggtaccgttacgggttaaaactttacgtttttaaacgtttaccggttaccgttttacggtttaaccttaacgttaaacggtttaccgggtaccccggggtttaagggtaaaccggggtttacgggtttaccgggggtaaacccggggtttaacggggggtttccggggtttaaaccggggggtaccggggggttaaaccgggggaaaaccggtaaaaaccgggggtttacggggtaacccccggttaacccggggtttaaccgggttaccccgggtttaaacccgggaacccccggttaaaacccggggtccccggttaaccccggggttacccccccccggtttaaccggggtaccccgtttaaaccccggtttacccccccggg

SEQ ID NO: 252329 - DNA, 695 bp, Homo sapiens
  misc_feature: GYAE6OF01CFFHG.49.35.D02.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (377)..(377): a, c, t, g, unknown or other
  misc_feature (377)..(377): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctctcactcagggcacagggtcctgggccagtctgccctgactcagcctgcctcgtgtcngggtctcctggacngtcatcaccatctccgtgctactgaaccactaancgtacgttgacttaatacttctgtctctcgtacaacaacaccgacaaacgtcccaaacncatanattctttgagtcgagtagacgtcggtccgtagtggttactctacgtcgtcgttctccgtactacctaagtcgtcggacgtacnccgtacggtccctaccgttcgacctgtacgtcggtcggtactacgtacgtcgtaggaacggacgacggtatacgtagttacgtactgacgactacctaactaagttaaaccttaaaacaaaccgttaaacgttaaacccgtttaacgggttaggggtttaccgggttacggggaacccggttaaccgggaaacccgttaacccggtacggtaaccccgttaccgtaccgggttaaactacccggaaccgtacggtacccgttaccccgtaccccggttacgtacctaccgttccctttaaccgtcccccgtttacccc

SEQ ID NO: 252330 - DNA, 698 bp, Homo sapiens
  misc_feature: GYAE6OF01EOSC1.49.35.D02.1.454.CMB.1.raw
  modified_base (250)..(250): a, c, t, g, unknown or other
  misc_feature (250)..(250): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactgaaccacatgacgttgtacttatatctntctctgacaacactacccgacaactacccaatcatgtacttcttgacgtacagtgacgtccggcccgtacgtacgggtttctactacgtcgtcttccgccggtctaccgtagtccgtggcgacgccgaccggtccctcccgtacgacctacgtccgtcgtcgggcctccgtacggtcgtagggacgggtacggacggtcgttagtaagtttacttacgttcgaccgtacgtcctaactaagttaactaaaccgtaaaactaaacttaaaccggttacgggtttaggggttaccggttacccggggacgggtaacccgggtaaacccgtaaacggtaccgttacccgttaacccgtacggtaccgaccggtaacccgtacggtaccccgttacccggtcccccgttacggtacccctaccgttcccgttccccgttccccctacccccg

SEQ ID NO: 252331 - DNA, 695 bp, Homo sapiens
  misc_feature: GYAE6OF01DWYC2.49.35.D02.1.454.CMB.1.raw
  modified_base (211)..(211): a, c, t, g, unknown or other
  misc_feature (211)..(211): n is a, c, g, or t
  modified_base (254)..(254): a, c, t, g, unknown or other
  misc_feature (254)..(254): n is a, c, g, or t
tcagagtcgagagacacgaccggtgctcgatttagcacacgatagttgggtttgggggggggtctcaggaggcagcgctctcgggacgtctccaccatggcctggctctgctattcctcacccctctcactcagggcacgagggtcctgggcccagtctgccctgactcagcctcgcctcgtgtctgggtcctcgtggacagtcgatcacntctctgcacgtacgaaccacaatcgtacgttgtattatatctntctctgacaacaacacccgacaacgtacccaactcatgtattcgttagtagtcagtgtacgtccggaccgtcgtacgggtttctctacgtcgtccttcgtccggtcctaccgtaacgttcgtcggacgacgcccgtacccgtcccgtccccgtacgtacctacctccgttcgtcggtccctccgacggccggtaggaccggaacggaggtacgttagttaacgtttacgttaacgtcgtaccgtagtacctaactaacgtaactaaaaccgtaaaacgtaaacttaaaaccgttcgggtttacgggttacgggttaccgggacgggtaccgtaaaccggtaaccgtacggtacccgtaccgtacgtcgaccgaacccgacgtcccgtacccgtcccccggttacgtacccgtaccgttcccgtcccgttccccgtcccccg

SEQ ID NO: 252332 - DNA, 762 bp, Homo sapiens
  misc_feature: GYAE6OF01ANHNH.49.35.D02.1.454.CMB.1.raw
  modified_base (189)..(189): a, c, t, g, unknown or other
  misc_feature (189)..(189): n is a, c, g, or t
  modified_base (305)..(305): a, c, t, g, unknown or other
  misc_feature (305)..(305): n is a, c, g, or t
tcagagtcgagagacacgaccggtgctcgatttagcacacgatagttgggtttggggggggtctcaggaggcagcgctcgtcgggacgtcctccaccatggcctggctctgctattccctccaccctcctcactcgagggcacgacgggtcctcgggcccctagtcctcgccctagactcacgtcctcnccctccgtgtcgtggtcctaccgtggacagttcactccacactcctcagccacgtacggaacctacatcgtacgttcgtactattatctgtcctcgtgtaaccaacacctacccanactaacccgtacccaatcgtatcgtactttcgttaggacgtacaggtacgcgtcccggtccgtacgttgggttctacgcttccgtccttaccgtcccggtactaccgtaaggtccgtacggtaccgaccggtacccgtacccccggtaccctccccgttaaacggtacccttccggttcgtccgggttacccggcgttaccggacgggtaccggtaacgggacggaccgttacggtctttaggtaccgtttaactcggacctaccgatactaacacgttaaatacctaaaaccgttacgtaagtttccgggttagggttccggtaccgggaaccggtaccgtaacccgtgtaaccccgggtaccgtacccggtacccgtaggaccccggtacgtcccccgggttaccgtccccgtaccgtccgtaactttccccgtaccccgttccccgtacccccg

SEQ ID NO: 252333 - DNA, 683 bp, Homo sapiens
  misc_feature: GYAE6OF01BCOMC.49.35.D02.1.454.CMB.1.raw
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
tcagagtcgagagacacgaccggtgctcgatttagcacacgatagttgggtttggggggggtctcaggaggcagcgctctcgggacgtctccacatggcctgggctctgctacttcctcaccctcctcactcagggcacgacgggtcctcgggccagtctcgcctgactcagcctcgcctcgtgtcgtcggtctcgtcggcagtcgactcacctactcctctcgctaacgtacgaaccaacgatacggtacgttagtaacttatacttctcgtctcgtacgtaacaacgaacgtacccgaactaaccgtaccaactcacgtacgtactttacgtggaggtctacgtcgtaccgcggccgtcgttacggttctactcgtcgtcttccgcgtacctagtacgtcncggtacncgtacgacgtccctctacgactcgcgttacggtcgtcctacgcgtacgcggtacggacgtacggtacgtacgtacgtttaacgtcgtcggactacgtactacgtaactaactaacaaacgtaacgtaacgttacgggtttcgggtacggttaccggggacgtaccgggtaactacgtaccgttaccgacccgttacggtacgacccgtacggtaaccggtcctacccggtcccgtacgttacccggacctttcccgtccgttccccgtccccg

SEQ ID NO: 252334 - DNA, 726 bp, Homo sapiens
  misc_feature: GYAE6OF01CW32G.49.35.D02.1.454.CMB.1.raw
  modified_base (364)..(364): a, c, t, g, unknown or other
  misc_feature (364)..(364): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacgagggtcctgggcccagtctgccctgactcagcctgcctccgtgtcgtggtctccgtggacagtcgatcaccatcctcctgcctactacggaaaccactaagtgacgtttaggtaacttaatatttctcgtcctccgtacggtaaccaacaacgtacccggacaaacgtacccaaactcatgtattcgtttagagtcagtcgacgtcggccgtgtacgggttcncgtactcgtccgttccgtccggctacgtaacgtcggtgaccacggaccgaccggtccctaccgtacgtaacctcgtccgtcgggtccggtccgtacgacgggtaccgtacgggaacgggtacggtacgtacgtacggttaactttacgttacgcgacgtacgtctaacctaattaaccgtaaacaaacgtaacgttaaaccgtacgggttttgggtaccggttaccggggaccgggtaacccggaaacctacggtaccgtaccccggttaacgaccgtaccgacccgggacccgtacgggttcccctacccggtacccccgtcgtaacccttaccggttccctcccggttccccttaccccg

SEQ ID NO: 252335 - DNA, 856 bp, Homo sapiens
  misc_feature: GYAE6OF01D6CKR.49.35.D02.1.454.CMB.1.raw
  modified_base (753)..(753): a, c, t, g, unknown or other
  misc_feature (753)..(753): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacgaggtcgccccacggtccccgggtccagccgtggtgcaatcgtggggctggaggtgagaagccgtgggtcgtggtaggacgtctctggcagcttcgtggagacctaccttacaacttaagtttcgcgttgtacacggtcgtgggtacgaccggtaaccggaccggtacccccgtaggaaccggtaacgggttcccgttaggggtacgggggttagggggtacggggaaccgtaccgttacccctaacccccttaacgttaaccgtttaagtaacgtaacgtaacctaaaccgtacgtaccgtaacccaaacgtaccgtaaaccttaacgtacccgaaaccggtaaccgtaacggtaacccgttaccccgttaaacccccgtttacgggtaacccggaacccggtaaaaccgaaccccttaacccggaaaccgtaaacccccgaccgttaacccgtaacccgttaaccggtaacggtccggaaaccgttcggacccgttaccggaaccggtaccggttaccggtaacgttaccgtaccccggaccggtaaacccgtacccgggttaacgttttaacttccgttttaaccgggngggtaccggtaacgggtacggtaaacggttacgtacgttttaccgttacttaaggttacgttaaggtaacgtttaacgtacgttaattacctttgtacttcgg

SEQ ID NO: 252336 - DNA, 698 bp, Homo sapiens
  misc_feature: GYAE6OF01EGHEM.49.35.D02.1.454.CMB.1.raw
  modified_base (196)..(196): a, c, t, g, unknown or other
  misc_feature (196)..(196): n is a, c, g, or t
tcagagtcgagagacacgaccggtgctcgatttagcacacgatagttgggttggggggggtctcgaggaggcagcgctctcgggacgtctccaccatggcctggctctgctattcctccaccctcctcactcagggcacagggtcctgggcccagtctgccctgactcagcctgcctccgtgtctggtctctgganagtcgatccacatcgtctgcactgaacccacatcgacgttgtaacttatatctgtctctaggtacctaacaattaccccgagaaactacccaaactcatgaattcttagagtacagtgaatcggaccgtggtaggttctcgagttcgtcttccgtccggctacctaagtctggacacgccgacgcccgtcacggtacccagtccgtacgttcgggacctaccgtacgtccgtaggaacggtacgtacggacttaggaactttaagtaccgttgaccgtaacgttcctaagtaactaacttaaacaaaacgtaacttaaaactcgggttacgggttaagttcccggggaacggtacccggtaaaccctaaacggttcccgtaacccgttaccgttaaccggtccgtaacccggacccgtaaacgggcccccgttaccggtaaccccccgttcgggttaaacccaccgttttaccccgttacccggttacccccgtaacccccc

SEQ ID NO: 252337 - DNA, 782 bp, Homo sapiens
  misc_feature: GYAE6OF01B64UL.49.35.D02.1.454.CMB.1.raw
  modified_base (200)..(200): a, c, t, g, unknown or other
  misc_feature (200)..(200): n is a, c, g, or t
tcagagtcgagagacacgaccggtgctcgatttagcacacgatagttgggtttggggggggtctcaggaggcagcgctctcgggacgtctccaccatggcctgggctctgctattcctcacccttcctcactcagggcaacagggtcctgggcccagtctgccctgactcagcctgcctcgtgtctgggtctcgtggacngtcgatcaccatctctgcacgtagaaccacaatcgtacgttaggtacttaataattcagtctcgtaggtaccaaacaagtaaccccggacaaacgtcccaaaactcctaattcgaacgtttctttacggtaaggttaccaagggttacgacgttaccggcgtacgggtacgggttttaacctccgtaagtaccgtcgtttccgtaccgggtaccctaacgtaaacggtcttaacggggactaaggccgtaacggtccctacccgttacggaaccttaacgttcttccggacggggtacccttaccggaacggtcgtaaacgggtacgggtaacgggtaacggaacctttaggtttaaattacggttaaacgttccggaacgtaacttactacgtaaactttaacaaaaccggttaaaacctaaataaaaccggttcgttacggggtttacgggttacggacccgggaacgggtaaacctaaacgggtaacccgtacccttacggtaacccgccgtaacgacccgtacggacgtacccctcccggtcgtaaccttccgttaccggtaccttcccccgtaaccc

SEQ ID NO: 252338 - DNA, 870 bp, Homo sapiens
  misc_feature: GYAE6OF01BBVCN.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctctgcacgtggaaccacaatgacgttgtacttatattctgtctctgacaacactacccggacaacgtacccaaactcatgtattctttagagtcagtgacgtccggacccgcgtacggggtttctacgtacgttccggtcctttcccgtcccggtaccgttaccgtaaacggttccgtacgggtaccgtaccggaccgtaacccgggtccccttaccccgtacgtaacccctaacgtcccgttcggtaccggggtacccgtaccggtacggtacgtacggggaaaccgggaacggtacgggtaccgttaacggttaacgtttaacgtttacgttacggtcgtaaccggtaccttaaccgtaactttaaacctaaaaccgttaaaaaccgtaaaaccgtttaaaaacccggttaaccgggtttttacgggggttaaccgggttttaacccgggggtaaccccggggtaacccggggtaaaaccccttaaaaccggggttacccgtaacccccgggttaaccgttaaccccgggtaaccgtaacccggaacccccgggtaaaccggttccccggtaccccccgggtaccccccggttacccggtttccccgttaaccccgtttacccggtttcccccgtttaacccccccgttacccccg

SEQ ID NO: 252339 - DNA, 707 bp, Homo sapiens
  misc_feature: GYAE6OF01BJEXR.49.35.D02.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
tcagagtcgagagacacgaccggtgctcgatttagcacacgataggttgggtttggggggggtctcgaggaggcagcgctctcgggacgtctccaccatggcctgggctctgctattcctcaccctctcactcagggcagagggtcctgggccagtctgccctgactcagcctcgcctcgtgtctggtctccgnggacagtcatccacntcctacctgctacgcgaaccactaagtcggtacgttagtacttaatacttcgtcgtctccgtacggtacctaacaacgtacccgactaaaccgtacccaacgtcctatagtacttcgttcgaggtctagtgacgtccggaccgtcggttacgggttcacgtacgtcgtaccgttccgtccggtctaccgtacgtccgcgcgtacgaccgtccggtccctcccggtacacccgtcgtcccgttcggtacgggtcctaccgggtacgttacggtacgggacggtacggtacgggtcttaacgtaactttacgtaacgtcgacggtactacctaagtaacttaactaaacgaactaactaacggtaggttacggtcgggtacggaccggtacggaaccctacggtaccgtacccggttacgtacgccgtaacccgggtaccacggcccttcccggtcccgtaccgttactacccgttcgttaccccgtcccccgtttaccc

SEQ ID NO: 252340 - DNA, 740 bp, Homo sapiens
  misc_feature: GYAE6OF01BHMW2.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgcactgaaccaccaatgacgttgtacttatattctgtctctgtaccaacaactacccgcaaacgtccccaatcatgacttctttgacggtctagtgtactccggcccgacgtacggggttttctcgtacgttccgtccgtttccgtcccggtaccttaccgtaacgttcgtcgggtaccacggacccgtacccggtccccttaccccgttacgaacccctagttcccgttaccggttccggggtacccgttacccgacgggttccgtagggaaccgggaccgggtacgggtcttacggttaatttacgtttaaccgtcggaccgtacggtaccttactaacgttaaactaaaccaaacctaacgttaaacctacgggtttcgggttacggttaccggggaccggacccggtaaacctaaccgtccgtacccgttaccgtacgtcccgaacgaccccggtaacggtcccgtacccggtcccccgttacgttaccctacccttccgttcccgttccccctaccccg

SEQ ID NO: 252341 - DNA, 834 bp, Homo sapiens
  misc_feature: GYAE6OF01CU7ZD.49.35.D02.1.454.CMB.1.raw
  modified_base (102)..(102): a, c, t, g, unknown or other
  misc_feature (102)..(102): n is a, c, g, or t
  modified_base (828)..(828): a, c, t, g, unknown or other
  misc_feature (828)..(828): n is a, c, g, or t
tcagagtcgagagacacgaccggtgctcgatttagcacacgatagttgggtttggggcatcacataacaaccagattcctcctctaaagaagcccctgggancacagctcatcaccatggactggacctggtacgttccttcgtttgtcggtggcagacagctacgaggtcgacccgtacggtcccccgggtccaggtccgttgggcgtactaacgtccggtgggggtaccttaggacggggtaggaacggtaaacggtcccggttgggggttccggttacggggttaggtaaccggttacccgttccgacggacggtaacgggttcctttacggaggaccgaaccttaacccgtttaccaaaacgttttaacgtttccgaccgtttcgtaccgacgttaccgggttggggtacccgacccggacccgtaccgggtaccccgtttggaaacccgtacggttccgttacggggtaggggtttacgggggtagggtaacggtaacccgtttccccaaaccccggttttcctaaaccgtttaaagtacgtaaccgtaacttaaactcgtacgtaccgaaccgtacgtacctaaccgttccgaacacgtaacgtcctacccgtacttcgacgtacgaacctaactaccaacgtaacacgtacgtacctagtcgtacggtactacgtccacgtaacgcgtaaccgtacgttacccggcctacccggtaccggtaacgtccggttaactttacttccgtaggtcaaccggagtaccggtagttacgttacgttacgttatacgtacttacgttattaacgttgtaataccgttnttaccg

SEQ ID NO: 252342 - DNA, 836 bp, Homo sapiens
  misc_feature: GYAE6OF01BCF9D.49.35.D02.1.454.CMB.1.raw
  modified_base (143)..(143): a, c, t, g, unknown or other
  misc_feature (143)..(143): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacgngggtcctgggcccagtctcgccctgactcagcctgcctccgtgtcgtgggtctccgtggacagtcgatcaccatcctctgccacgtacggaacccaccaagtcgtacggtttggttaactttaattaacgtttctcgttccttccttacggtaaccctaaaccaaccgtaacccccggacaaaacccgtaccccaaaactccatacgtactttcgtttacggaaggttcaaggtcggtacgtcccgggcccggtacgggtttacggggtttcctacgtcgttccgttccgtttcccgtccgggcctaccgtaagtccggtacggacgtccggcccgtacccggccccttacccgtacgaccctacgttcccgttcggtacggggtcccgtaccgtacggggcccggtaagggaaccggggaacggtcggtacgttaggtttaaacttttacgttacgtggtaccgtaagtccctaataagtaacctaaaacccgtaaaaccgtaaacgttaaacgtttcgggtttaggggttaccgggttccggggaacccgggtaacgggaaccctaaaccgggtccgtaacccggttacccgtaaccgtcccggaccgaccccggtaacggtcccgtacccccggttacccccgttcgggtacccttaccgtttcccctttccccgtccccccttcccccg

SEQ ID NO: 252343 - DNA, 691 bp, Homo sapiens
  misc_feature: GYAE6OF01C9T6H.49.35.D02.1.454.CMB.1.raw
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
tcagagtcgagagacacgaccggtgctcgatttagcacacgatagttggggtttgggggggggtctcaggaggcagcgctctcgggacgtctccaccatggcctgggctctgcttattcctcaccctcctcactcgagggcacgagggtcctagggcccaggtctcgccctgacctcgacgcctcgcccttccggtgtcgtcgggttctccgtggacaggtcgactcacntcgtctncacgtcgaacaccaagtgacgttgtacttatacttctcgtctacgtcgaaccaaacaccgtaacccgacaaccgtaaccctaactnactagtaccttgtttacgcggtactacgngtaccggcggtaccggtcggtgggttccactcgtctccgtccgtcgcctacgatcgngcagaccnccgtcctaccncgactctccgtagtcgcctcgcggcgagtacgggacgtacggtctagttactacgttacgtcgaagtcgtaactccgaaataacgaaaccgtaaactaacggtaccgttaggttaccgggttacgggtaccggaccgggaacgggtaacctaacggttacgtacccgtaaccgtaccgggtcctaaaccggacccggtcgtaccccgtaccggttccccgtacggttaccctaccccggtttacaccccggttcctacccccg

SEQ ID NO: 252344 - DNA, 668 bp, Homo sapiens
  misc_feature: GYAE6OF01BLTPL.49.35.D02.1.454.CMB.1.raw
  modified_base (257)..(257): a, c, t, g, unknown or other
  misc_feature (257)..(257): n is a, c, g, or t
  modified_base (492)..(492): a, c, t, g, unknown or other
  misc_feature (492)..(492): n is a, c, g, or t
  modified_base (523)..(523): a, c, t, g, unknown or other
  misc_feature (523)..(523): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactcggaaccacaatgacgttggtacttatattcgtntctcctgtaccaacaactacccggacaaacgtacccaaactcatgacttcgtttaggaggtacacgtcgtagtccggcccgtacgtacggggtttctctacgtccgtccttccgtccgtctaccgtaacgtcgtcggcagaccgaaccgtcccgtccgtacgacctacttccgtaccgtcgggtacctcccggaggtctacggacgggtacgacggtcttagtactttaagtacnggactgacctacgaactaactaaacctaaanaacgttaaacgtcggtttcgggtacgtccgggaggacccgggtaacctaacggtcggtaccccgttcaaccgtccgaccgaccgtacgcccgtccccgtaccccgtcggtaccctaccttcccgttacccgttcccgtacccccg

SEQ ID NO: 252345 - DNA, 743 bp, Homo sapiens
  misc_feature: GYAE6OF01BK4CP.49.35.D02.1.454.CMB.1.raw
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctctggtaaccaacaactacccggacaaacgtccccaaactcatacgattctttaggacgtcagtcgactccggaccgtcgtacgggtttctcagtccgcttccgccggtactaccgaagtcgtggaccaggcccgaccggtccctcccgacgaacctacgtcctcgtccggggctaccggtggaccgtggtaacgggaccgaggttctaacggttaatttaactacggtacgtacgtaacgtaccgttactaagtaaacctaaaccgtaaaacgttaacgtaaaaccgttagggttttccgggggttagggttaaccccggggaccggggttaaccggaaaacccttaaccgtaccgggtaccccgtttaaccgtaaccggtcccgtaaacggacccccgggtaaacggtcccgttacccccgggaccccccgtttcggtaaccccgttaacgttccccctttacccggttaacccccctacccccg

SEQ ID NO: 252346 - DNA, 751 bp, Homo sapiens
  misc_feature: GYAE6OF01EXHHH.49.35.D02.1.454.CMB.1.raw
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcgaaccaccaatgtacgttggtacttatattctntctctgacaacactacccgacaaacgtcccaaactcatgtatcttgnggtcaggtgactccggcccgtcgtaggggtttcctctatccgcctttccgtccggtccttaccacgttctggccacggtcgaccggtcccttcccgcgacccgtactccgttcgtcgggtaccctcccggacggtccgtagggtacgggacgtacgggtaccgttacggttaagtttacgtttacgttcggactacggtctaacctaagttaaacctaactaaaaaccgtaacttaaaacccgttccggggtttaaggggttccggggtttaaccgggacccggggttaacccggggtaacccctaaaaccgggttcccggttaaccccggttaaccccgttaacccgtccggaaacccggacccggttaaacgggccccgttaccccgggtccccccgttaccgggttcccctaaccgtttcccgttcccggttccccccgtcccccg

SEQ ID NO: 252347 - DNA, 709 bp, Homo sapiens
  misc_feature: GYAE6OF01CGEEA.49.35.D02.1.454.CMB.1.raw
  modified_base (200)..(200): a, c, t, g, unknown or other
  misc_feature (200)..(200): n is a, c, g, or t
  modified_base (666)..(666): a, c, t, g, unknown or other
  misc_feature (666)..(666): n is a, c, g, or t
tcagagtcgagagacacgaccggtgctcgatttagcacacgatagttggggtttgggggggggtctcaggaggcagcgctctcgggacgtctccaccatggcctggctctgctattcctcaccctcctcactcagggcacgagggtcctgggcccagtctcgccctgactcagcctgcctcgtgtctgggtctctggacngtcgatcacatctctgcactacggaaccacagtgtacgttggtacttatacttctcgtctcctggtaccaacaacgtaccccgacaaacgtccccaaactctatgtacttcgtttggtacggtctaggtgacgtccggcccggacggttagggtttctcctacgtcgtaccttccgtcccggcgttccgaaggttccgtggactacgccgtaccgggtcccttcccgtacggtaccctacgttccgtacggttccggggccttaccggacgggtacgtacgggaacgggacggtaaacggtacgttagtaactttacgtttacgtacgccgtaagtccttaacgacttaacgtaaacgaaacctaacttaaacgtcggttagggttaccggttccgggaccggtacggaaaccctagtaccggacccttaccgtacccgtcgaacgacccggaagcccggttcccnccccgttacgcccgttacccttccgtcccgttcccccgtcccg

SEQ ID NO: 252348 - DNA, 704 bp, Homo sapiens
  misc_feature: GYAE6OF01E2UEP.49.35.D02.1.454.CMB.1.raw
  modified_base (290)..(290): a, c, t, g, unknown or other
  misc_feature (290)..(290): n is a, c, g, or t
tcagagtcgagagacacgaccggtgctcgatttagcacacgatagttggggtttggggggggtctcaggaggcagcgctctcgggacgtctccaccatggcctggctctgctattcctcaccctctcactcaggcacagggtcctgggcccagtctgccctgactcagcctgcctccgtgtctgggtctcctggacagtcgatcaccatctcctgctacgtggaaccaacaatcggacgttggtaacttataactcgttgtctctcggtaaccaactaacgtacccgganaaacgtccaaactcatgtatcgttgagtctagtggtacgtccggccgtacggtacggtttctctacgttcgccttcgtaccggtactaccgtaaacgtcgtacggccgtacggaccgtaccggtacccgttaccccgtcgaaccgtaacttccgttcggtacgggccctaccgaagggtcgtaggaacggacggtacggtctaaggtaccttaattcgtagaccgacgttacctacgtaactaaacgtaacaaaacgtaataaaaccgtcgggtttaggggttaccggtacggcccgggaaccggtaaccctaaaaggtcccaaaccgtcccgttacgtaccgaaccggtaccgaacggtccgttcccgaccccgtccggtactacttacccgttccccgttaccctacccccg

SEQ ID NO: 252349 - DNA, 730 bp, Homo sapiens
  misc_feature: GYAE6OF01DFYK6.49.35.D02.1.454.CMB.1.raw
tcagagtcgagagacacgaccggtgctcgatttagcacacgatagttgggtttggggggggtctcaggaggcagcgctctcgggacgtctccaccatggcctggctctgctattcctcaccctcctcactcagggcacagggtcctggcccagtctgccctgactcagactgcctccgtgtctgggtctcctggacagtcgatcaccatctcctgcactggaaccaccaatgacgttggtacttatattctgtctctagtaccaacaacgtaccccgacaaacgtacccaaactcatgtacttcgtttgacggtcagtgacgtccgggccgcgtacggggttttccacgtacgtccgtcctttccgtaccggtccttaccgaacgttcgtcggcgacggaccgacccggtccctcccgtacgaccctattccgtacgttcgggccttacccggaggtccgtaggacgggtaacggcgggtacttagtacttttaacgttacgtcgacgtacgtacttacgaacttaacgtaaacaaacttaactaaacgttacggtttacggggttccggttacgggaccggggtaccggtaaacccgtaaacggttaccggaacccggtttaccgtacccggtaccgaaccggtaccccggtaccggtacccgttccccggtaccccccgtacggttaccctacccgtttcccggtacccgtttcccccgtaacccccg

SEQ ID NO: 252350 - DNA, 687 bp, Homo sapiens
  misc_feature: GYAE6OF01ETARU.49.35.D02.1.454.CMB.1.raw
  modified_base (254)..(254): a, c, t, g, unknown or other
  misc_feature (254)..(254): n is a, c, g, or t
  modified_base (303)..(303): a, c, t, g, unknown or other
  misc_feature (303)..(303): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctcgggtctccgtggacagtcgatcaccatctcctgcactgaaccaccaatgtacgttgtacttatatctntctctgtaccaacactacccggacaaacgtcccaaactcatagtacttntttggaggtacgtagtcgacgtccggccgtcgtacgggtttctcacgttccgtcttcctcggtacctacgtaacgttctcggtacgacggcccgtacccggtcccctccccgtaccgtacccctacgttccgtccgggtaccgggtccgtcccgtaacgggccggttacggaacgggacggtacggtcgtaggttaaactttacgttacttcgacgtacgtactactaacgtaactaacaaactaactaacgtacgttgggtacggttcggcgggaccgaaccgaacgtccgtacccgttaccgtaccgtcctaaccgacccgaggcccgtcccgtacccccgtcggtaccctaccgttccgttacccgttcccgttccccccg

SEQ ID NO: 252351 - DNA, 655 bp, Homo sapiens
  misc_feature: GYAE6OF01ENZQA.49.35.D02.1.454.CMB.1.raw
  modified_base (292)..(292): a, c, t, g, unknown or other
  misc_feature (292)..(292): n is a, c, g, or t
  modified_base (395)..(395): a, c, t, g, unknown or other
  misc_feature (395)..(395): n is a, c, g, or t
  modified_base (463)..(463): a, c, t, g, unknown or other
  misc_feature (463)..(463): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatcgtggggctggaggtgagaaagccgtgggtcgtcggtgaaggtctcctgcaaggcttctggacgacaccttacaactaactttgctgtcagcgtgggtncgacgacggcccctaggacgaaggtccgtggacggtggggtagggaaggactccgaccccttacgtaccgtttaaatatacgaacgtaaactagtacgacaanacgactactaccaacgacagactacctaccttacgccgacgaacaactccaacgaacacacgacctanagtacggaacctggaccgcgacgtaccgtagtactccgtacgacccggacgtaccgggtaccttaatttaccgttacggttggtacggacggaacggtaggttacgttaacgttcggtttacttttacggtaagttacggttaaacgttaacgttttaaccgtaacggtttacttaaccgtttaaggtaccg

SEQ ID NO: 252352 - DNA, 842 bp, Homo sapiens
  misc_feature: GYAE6OF01AYNYR.49.35.D02.1.454.CMB.1.raw
  modified_base (315)..(315): a, c, t, g, unknown or other
  misc_feature (315)..(315): n is a, c, g, or t
  modified_base (500)..(500): a, c, t, g, unknown or other
  misc_feature (500)..(500): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggacggttcctctttgtggtggcagcagctacaggtgcccagtcccgggtccagctggtgcaatcgtggggctggaggtgagaacgccgtgggtcggtcggtgaaggtctcctgcaaggcttcgtggacgacctaccttacaactaacttttgctgtcagcgtgggtcgcgtacacgggtccccngggaacctaacgggtccttaggagggtcggggtagggaacggtactacccgtaacccccttaattaccccgtttaaaataacgtaaggtaacctaaaacgttacgtcggaccctaaacgacgtaaaccgtaacttacccgaaacggtacctaaaggtaaccgtacccctaaccccggttttaaanaccccgggtaaccggaaaacctaaaccgttaacccccgaaaaccgtaaaccccgtaaacgacccggtaaaccctaaaccggtaaccgttaacggggttaaaccctacgggtaacccgtaacccgaaaccgggttacccgttaaacgggtaacttaccccggtaacggaaccccccgggtaagtaaccccggggttacgtttaaacgtttaccgttttacggtacggttacgggaccggttaagaacgggttaacgttacgtttacgggtttaccttttaactacggtttaagggaaactttaaacgtaaccgtttaagtacgtttaaagtttcgtaacccgg

SEQ ID NO: 252353 - DNA, 759 bp, Homo sapiens
  misc_feature: GYAE6OF01A9QFS.49.35.D02.1.454.CMB.1.raw
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (243)..(243): a, c, t, g, unknown or other
  misc_feature (243)..(243): n is a, c, g, or t
tcagagtcgagagacacgaccggtgctcgatttagcacacgatagttgggttggggggggtctcaggaggcagcgctctcgggacgtctccaccatggcctgggctctgctattcctcacctcctcactcagggcacagggtcctgggcccagtctgccctgactcagcctgcctccgtgtctgggtctcctggacagtcgatcacatcnctgcatgacacaatnacgtgtactatattcntntctggtaccaacatacccgcaaacgtcccaaactcatgatctttgaggttcacgtgactcggcccgtcgacggggtttctcgatccgtccgttccttccgggcttaccgaaggtccttacggctacggaccgtacggcccttacccgtcgacccgtaacgtccttacgtcggggccttcccgacggttctacgggtaacggacggacgggtacgttaggtaactttagtttaaccgttacgccgtaacggtccttaccgtagttaaccttaaccaaaactaacgtttaaaaccgtaccgttttaacgggggttaccgggttttaccgggggacccgggttaacccgggggaaccctaaaaccgggttacccggtaacccgtttaacccggttaacccggttaaccggtacccgggttaccccggtaaaccggggacccttaccccgggtcccccccgttaaccggggtacccctaaccgggtttcccgttcccgttaccccccgttaacccccccg

SEQ ID NO: 252354 - DNA, 696 bp, Homo sapiens
  misc_feature: GYAE6OF01EI4CH.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcatcgtgggctgaggtgaagaagccgtgggtcagtcggtgaaggtctcctgcgaggtcttcgtggagaccaccttacaactaactttcgctgtcagtcgtggtcggccgacgcggtccccgtaggaccggtaacggtccgttagggtacggttcgggggtaggggaacggtacgtacccgtaaccccttacgttacccgtttaaagtaacttaacggaactaaaactacgttacgaactaacgaacgtaactacgttacccgaacgacgtaacgtaacgtacctacccgtttactccggaacgaactaaactacccgaaacgaaccacgtacgaaccctaagaacgtacgacgtcgacgacgtacaccgtagacgttcaccggacgtacgtaccgtacttattactgtacggtacgtacggaaggacggtaacgttagtttccgttttacgtttacgttaagtagttaaacgtaacgttaaaccgtttacggtttctaagttttacg

SEQ ID NO: 252355 - DNA, 724 bp, Homo sapiens
  misc_feature: GYAE6OF01AUBMK.49.35.D02.1.454.CMB.1.raw
  modified_base (206)..(206): a, c, t, g, unknown or other
  misc_feature (206)..(206): n is a, c, g, or t
  modified_base (676)..(676): a, c, t, g, unknown or other
  misc_feature (676)..(676): n is a, c, g, or t
tcagagtcgagagacacgaccggtgctcgatttagcacacgatagttgggtttgggggggggtctcaggaggcagcgctctcgggacgtctccaccatggcctggctctgctattcctcaccctcctcactcgagggcacgagggtccgtgggccctagtctcgccctgactcagcctcgcctccgtgtcgtcggtctccgtgacngtcgactcaccatctccgtcgcaccgtacggaaccaactagtcggtacgttacggttacttaagttacttcgttaccgttactaccggttacggtaaccaaccgtaaacccgtaccccggaaccgtaaaaccgtacccctaaacgtctacgtagtactttacggttaggtacggttcgtacggtcgtaccggtccggtccggtacggttacgggtttcctacgtacgttccgttccgttccgtaccggtacctaccgtacgtcgtacggcgaccgtaccgccgtccctaccgactaccgtacgtcgtacggtcgaccgtcgacgtacggtacggcggtaagtacgtacttagttaccgttaatcggacacgtacgtctaatacgtaacaactactaagttacgtacgttcggggtcaccgggtacgaacgcctaaccgtcgtaccgtaccgtacgaccgcgaccggtccnccggtccccgtaaccgtcgtacccttacgtccctaccctcccgttacc

SEQ ID NO: 252356 - DNA, 980 bp, Homo sapiens
  misc_feature: GYAE6OF01DTZO8.49.35.D02.1.454.CMB.1.raw
  modified_base (255)..(255): a, c, t, g, unknown or other
  misc_feature (255)..(255): n is a, c, g, or t
tcagagtcgagagacacgaccggtgctcgatttagcacacgatagttgggttggggggggtctcaggaggcagcgctctcgggacgtctccaccatggcctggctctgctattcctcaccctctcactcagggcacgagggtcctgggcccagtctgccctgactcagcctgcctcgtgtctgggtctcctggacagtcgatcaccatctctgcacgtcgaaccaccaatcgtacgttaggtaacttataattcncgtctcgtacgtaaccaacaactaccccggactaaaccgtacccaaactcatcgtacttcgtttaggacggtcgagtcgacgtccggaccgtcgttaggggtttcctacgtacgtccgtccttaccgtccggtaccttaccgtaacggtcgtcggtacgaacgcccgaccggtcccctcccgtacgaccctacgttccgtcggtacggtcctccgtacggtacgtcgggaacggtacggtacggtacgttacgtaagtttaacgtttacgtacgtacgtcggtaaaaaaaccgttctaacgtttaaaccgttaaaaccgtaaaaccgttaaaccgtttaaaaaccggtttaaccggggttttacgggggtttacccggggtttacccgggggtaacccggggggttaacccggggtaaaaccccggttaaaaccccgggttaccccgggttaaacccccggggttttaaccccccgggttttaaaaacccccgggggttaaccccggggttaaaaacccccccgggggttaaaccccccgggtttaaaacccccggggggtttaaccccccggggtttaaccccccccggggttttaaccccccccccgggttttaccccgggggttttaaaccccccgttttaaccccccggtttttaacccccgggtttttaaaccccccccggttttttcccccccccggttttaaaacccccccccccggg

SEQ ID NO: 252357 - DNA, 691 bp, Homo sapiens
  misc_feature: GYAE6OF01DXHSX.49.35.D02.1.454.CMB.1.raw
  modified_base (196)..(196): a, c, t, g, unknown or other
  misc_feature (196)..(196): n is a, c, g, or t
  modified_base (309)..(309): a, c, t, g, unknown or other
  misc_feature (309)..(309): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctctcactcagggcacagggtcctgggcccagtctcgccctgactcagcctgcctcgtgtctggtctctggacngtcgatcacatctcctgcactcggaaccaccatcgacgttgtacttatattctgtctcctgtaccaacaacgtacccgacaaacgtacccaaactcatgtatctttagacgtnagtgtacgtccggccgtcgtacgggtttctacgtacgttccgtcgttccgtccggtccttaccgaacgttcgtacggacaccggccgtaaccggtccctacccgtacgaccctacttccgtcgtcgggcccttaccggacggccggttacgggaacgggtacggtaggtccgttagttaacgtttacgttacgtcgacgtacgtactacgaattaactaaacaaacgtaaacttaaccgtacgggtttacggttacgggttcgggaccgggtaccggaaaccgtaaccgtacggtacccgtaccgtaccgtaccgacggtacccgacggtcccgtcccgtaccccgtcgtaccctaccgttccttcccgtccccttaccccg

SEQ ID NO: 252358 - DNA, 908 bp, Homo sapiens
  misc_feature: GYAE6OF01E44M7.49.35.D02.1.454.CMB.1.raw
tcagagtcgagagacacgaccggtgctcgatttagcacacgatagttgggtttgggggggggtcacaagaggcagcgctctcgggacgtctccaccatggcctgggctctgctgctcctcactctcctcactcaggacacgaggggtcctcgggcccagttctcggcccctgacctcgacgcctcgtccctccggttgtcgtcgggtcctccgtggactagtccgactccaccgtacttcctccgtgtaccacgtacgaaaccacggcgtaggtagtacgttagggttacgggttaactttaacgtttaaccctttttccgttaccgttaccggtaacctaaaccaaccaacccgtaacggaaccaaacccgtacccccaaaccttcctaacttccgttaattttacgtacggacggtaccgtacgtaccgaccggcccggtcccgtacgggtacggtccttacgtcgtacgtccgtcttccgtacgtcgtccctacgtacgtcgtcgacgcgtaccggtacccgtccctaccgtacgtaactaccgttcgtcggtccggtaccgtaccgggtcggtcgggtacgggcgtacggtacttaggttaacttttacgttagttccgttacgtttacgttacgggtacgtttacgggtacgggttacccgggtttaacggtaggggtttacccggggttacggggtaaccgggggtttacgggggtttaccgggggtacccggggtaaaccggggggtaaaccccgggtttaacgggggaaccccggttttacccgggggtaacccccggtttaacgggttacccggggaaccccggttaacccgggaaccccggttacccggggttacccccggtccccccgggttacccccgggttaacccggttccccg

SEQ ID NO: 252359 - DNA, 690 bp, Homo sapiens
  misc_feature: GYAE6OF01CKPF7.49.35.D02.1.454.CMB.1.raw
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
  modified_base (351)..(351): a, c, t, g, unknown or other
  misc_feature (351)..(351): n is a, c, g, or t
  modified_base (501)..(501): a, c, t, g, unknown or other
  misc_feature (501)..(501): n is a, c, g, or t
  modified_base (521)..(521): a, c, t, g, unknown or other
  misc_feature (521)..(521): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacagggtcctgggcccagtctcgccctgacctcagcctgcctccgtgtcgtgggtctccgtggacngtcgatcaccatctccngcactacggaaacccaccaatcggtaacgtttacggtacttaattaattctcgttcctacctacggtaaccaaactaactaaccccggacaaaccgtccccaaactcactgtacttccgtttagaggtnaggtagacgtccgggcccggtcggttacggggtttccactactcgtccttccgtccggtacctaccgtaacgtcgtggccgacgtccgacccgtcccgtcccgtacgtacctctccgtcgtcgggcctaccgcggcgtacggaggacggnggtactagtatttacgtacncgtgacgtctaactacgaataaaccaataaacgtaacgtcggttcggttacggttcggaccgggaccggaaaccgtaaccgtaccgtacccgtaccgttacgccgtaacggacccgtacggccccgtaccgtccccgtacgctaccgttccgtcgtaccccgtcccccg

SEQ ID NO: 252360 - DNA, 755 bp, Homo sapiens
  misc_feature: GYAE6OF01BMJT0.49.35.D02.1.454.CMB.1.raw
tcagagtcgagagacacgaccggtgctcgatttagcacacgatagttggggttggggggggtctcaggaggcagcgctctcgggacgtctccaccatggcctgggctctgctattcctcaccctcctcactcagggcacgagggtcctgggccagtctgcctgactcacgcctcgcctcgtgtcgtcgggtctcgtggactacgtcgactcacactcctctgactacgtacgaaccacctaagtcgtacggttacgtacttaataacgttctcgtcctcgtacgtaaccaacgtaccgtacccgaactaaccgtacctaactctactacgtacgttacggttacggtacgtacgtacgtacgtaccggtccggtccggtcggttacggttctacgtacgtccgtccgttccggtccgtacgtacgtacgtcggtacggaccgtacgtcccgtccgtcccgtaccgtacgtaccgtaccgtccgttccggtacggtccgtaccggtacggtcggtaacgggaacgggtacggtacgttacttacgttaacttacgtcgtcgtacgtacgtactaacgttaactaacgtaaacgtaacgtaaccttaacggttacgggttacgggtaccgggtaccgggaaccggtaccgtaaaccgtacggtaccgttacccgtacggtaccgccggtaccgaccggtaccggtcccgtacccgtcccggttaccgtcccgttaccttccgttcccgtccctaccg

SEQ ID NO: 252361 - DNA, 648 bp, Homo sapiens
  misc_feature: GYAE6OF01BPZBY.49.35.D02.1.454.CMB.1.raw
  modified_base (316)..(316): a, c, t, g, unknown or other
  misc_feature (316)..(316): n is a, c, g, or t
  modified_base (331)..(331): a, c, t, g, unknown or other
  misc_feature (331)..(331): n is a, c, g, or t
  modified_base (356)..(356): a, c, t, g, unknown or other
  misc_feature (356)..(356): n is a, c, g, or t
  modified_base (388)..(388): a, c, t, g, unknown or other
  misc_feature (388)..(388): n is a, c, g, or t
  modified_base (430)..(430): a, c, t, g, unknown or other
  misc_feature (430)..(430): n is a, c, g, or t
tcagagtcgagagacacgaccggtgctcgatttagcacacgatagttggggtttgggggggggtctcaggaggcagcgctcgtcgggacgtctccaccatggcctgggctctgctattcctcaccctcctcactcagggcacacgggtcctgggcccagtcctgccctgactcagcctgcctccgtgtcgtgggtcctcctggacacgtcgactccacctactcctcctgccacgtcgaaccacaagtcgacggttgtaacttatattctgtctactcgtaccaacaccgtacccgacaaccgtacccaatcactnacttgttaggacgtntgtcgacgccggccgtgtcggttcngtactcgtcctcgtccgctacgtagtcgcgcncgccgaccgtccctacgcgactctcgtcgcgtcgacgtcggngtacgaacggcggagtctagtacttactacgtcgactcgtcaaccttataacctaaacaacttaacgttaacggtcgggtttacgggtcgggacccgggaacgggtaaccgaaacctaccgggtacctaaccggtacctacggtaccgacccggtaccgtcggtcccctccccggtacccgtccgtacccttaccttcccgtcccgttaccccgtccc

SEQ ID NO: 252362 - DNA, 706 bp, Homo sapiens
  misc_feature: GYAE6OF01AT1ZG.49.35.D02.1.454.CMB.1.raw
  modified_base (149)..(149): a, c, t, g, unknown or other
  misc_feature (149)..(149): n is a, c, g, or t
  modified_base (153)..(153): a, c, t, g, unknown or other
  misc_feature (153)..(153): n is a, c, g, or t
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (441)..(441): a, c, t, g, unknown or other
  misc_feature (441)..(441): n is a, c, g, or t
tcagagtcgagagacacgaccggtgctcgatttagcacacgatagttgggtttgggggcatcacataacaaccagattcctcctctaaagaagcccctgggagcacagctcatcaccatgactggactggacgttctcttgtggtggcngacngactacaggtcgcccagtcccgggttccagcgtggtancaatcgngggtctggagtgagaagtccgtgggtcgtcggtagtaacggtcctcctaggaccgaaggtccgttttacgaggggtacgtaaccttacccttaccgaaacttaacgttttccggccttaacggtcgtaacgttcggtaggggttcggaaccgtaccgaccggcccccgttgggaaccgtacggttccgtagggtacggtgggggtacgggaagtccgtacccgtacccttacgtaccgttaanacgtagaaccctaatgtacgatacaacgctaactccgtacgacctagtaccgcttaacctacgccgtacggaacaaccgttaccgaaccgtaaacacgtaaccgtacctaactacgtagtaacgacgtcgacgacgtacgtacgtctacgacgaccgaccgtaccgtacgttcgttattcggtacgtgtaccgagtaacggagttacctaggtttaccttaggtaattcggaaagtttcgtaacgttacgaactttgtagttacg

SEQ ID NO: 252363 - DNA, 765 bp, Homo sapiens
  misc_feature: GYAE6OF01BSWX8.49.35.D02.1.454.CMB.1.raw
  modified_base (215)..(215): a, c, t, g, unknown or other
  misc_feature (215)..(215): n is a, c, g, or t
tcagagtcgagagacacgaccggtgctcgatttagcacacgatagttggggtttgggggggggtctcgaggaggcagcgctcgtcgggacgtctccacagtggcctgggctctgctattcctcaccctctcactcagggcacaggtcctgggccagtctgtcctgactcagcctgcctccgtgtctggtctcgtgactgtcgatcaccatctccngcacgtagaaccacaatgtacgttagtaacttataattctcgtctaccgtacggtaaccaactaaacgtacccggaacaaaacgttaccccaaaatcctaatacgtaatcgtttagtaacggtactaggttacgaaccgtccgggtacccgtcggttaacggggtttacctacgtaacgttccgtaccgttacccgttcccggactaccgttaaacgtccgaggtacacggtacgaaccgtcccgtaccgtagaacctactcgttacgtcgggtacctcggtaaacggtctaaggaaccgggacggaacgtacgtaagttaactttaacgtccgtagcgtaacgtactacgtaattaaacaaaaccaaacgtaacgtaaaacggtacgtttaaggggtacgtttaaccgggccgtaacccggggtaaacctaacccggaaccggttacccgtaaacgtaacccgttacgaaccggaccctaaacgggtcctaaccccggaccccgttgggtaaacccctccgttaaccgtccccgttaacccgttacccc

SEQ ID NO: 252364 - DNA, 715 bp, Homo sapiens
  misc_feature: GYAE6OF01A3UV6.49.35.D02.1.454.CMB.1.raw
  modified_base (428)..(428): a, c, t, g, unknown or other
  misc_feature (428)..(428): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctctgcactggaaccacatgacgttgtacttatattctgtctcctggtaccaacaactacccggacaaacgtcccaaactcatgatctttgagtcagtgtattcggccgtcgtagggtttctcgtactcgtcttacctccggctccgaagtctcggcacgtcgaccggtccctccctgacccatctcgtcgggtcctcgacggtctggacggacgnggtcttagtactttagttacgtcgcgtacgcttcaacgttaacaacgtaaactaacgttaaaccgtaacgggttttacgggttacggttaccggggaccggggtacccgggtaaacccgtaaaccggttaccggtaaccccggttacccgttaaacccgggtaccgaacccggtaacccccggtaacggttaccccggttaccccggttacccccccggttccggggttaaccccctaacccggtttaccccgtttccccgggtttacccccccggtttcccccccg

SEQ ID NO: 252365 - DNA, 578 bp, Homo sapiens
  misc_feature: GYAE6OF01ETM74.49.35.D02.1.454.CMB.1.raw
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
  modified_base (567)..(567): a, c, t, g, unknown or other
  misc_feature (567)..(567): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatcctcctgcactggaaccacatgacgttgtacttatattctgtctctgtaaccaacaactacccgctaaacgtacccaaacncatnattcttgaggtcagtgactccggccgngtagggttcnctatcgcttctccgcctctagtcnggcacgcaccgcctccngacctntctcgtcggctcgaggcnggaggacgaggtctagtatttactacgngtcacgcttagaataactaacaaacgaactaacgtacgttgggtcggtacggcgggtaaccggactaacgtaccgtccgttacctcgtaccagacccgacggtcctacccgccccgttcgtacctacctccgttcccnccccgttcccg

SEQ ID NO: 252366 - DNA, 818 bp, Homo sapiens
  misc_feature: GYAE6OF01EBKI1.49.35.D02.1.454.CMB.1.raw
  modified_base (170)..(170): a, c, t, g, unknown or other
  misc_feature (170)..(170): n is a, c, g, or t
  modified_base (493)..(493): a, c, t, g, unknown or other
  misc_feature (493)..(493): n is a, c, g, or t
tcagagtcgagagacacgaccggtgctcgatttagcacacgatagttgggtttggggggggtctcaggaggcagcgctctcgggacgtctccaccatggcctgggctctgctattcctcacccctcctcactcagggcacgagggtcctgggcccagtctgccctgactnagcctgcctcgtgtctgggtctccgtaggacagtcgatcaccatcctcctgccacgtagaacccaccgaatcgtacggttgtactttaatacttcgtcgtctccgtacggtaaccaaacgaaccgtaccccggacaaaccgtccccaaacgtccatcgtattcgttaggacggtacaggtacgacgtccggccgtacggttacgggtttccactacgtcctccgttacccgtccggacctacgtaacggtcgtacggacgaacgtccgacccggtcccttacccggtcaaccgtcttcccgtagtccgggtacccttaccggnggtacgtacgggaccgggtaacggtcggtaacgttacggtaactttttaacgtaccggtaccgtaacgtaccgttacgtaacaactttaacctaaaaccgtaaaccgtaacgtaaacccggttcgggttttaggggttacccgggttacccgggaaccgggtaaccccgggtaaaccgttaacggttacccggtaaacccccggttaccgttaaacccggacgttaaccccggacccgttaacccgggacccttacccccgggtccccccgttacgggtaccccttaacgtttcccgttaccccccgggtcccctttacccccgg

SEQ ID NO: 252367 - DNA, 719 bp, Homo sapiens
  misc_feature: GYAE6OF01BTEEF.49.35.D02.1.454.CMB.1.raw
  modified_base (201)..(201): a, c, t, g, unknown or other
  misc_feature (201)..(201): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcgagggcacgacgggtcctgggcccagtctcgccctgactcagcctgcctcgtgtctgggtctcctggacngtcgatcaccatctccgtgcctactcgaaccacaatcgtacgttgtacttatattctgtctctaggtaccaacaactacccggacaacgtacccaagtcatacgattcgttacgaggtctaggtacgcgtccggcccgtcggtacgggtttctacgtacgtccgtccgtttcccgtccggtcctaaccgtaacgttcgtcggctacggaccgtaccggtccctcccgtacgtaacctacgtccgttaccggtcgggtcctaccggacgggttaacgtacgggaacgggtaccggtaaggttacttacggttaaatttaccttacggttacgacctcgttaaccaacttaacgttaacctaacggtaaaacctagttaaaaccgttgggttacgggttacggtcgggaccgggtaaccggaacctaacgtacggtacccgtaccgtaccgcgaacccgaccgcggtaccctccccgtacccgtcggtaccctcgttacccgtcccgtcccgtacccccg

SEQ ID NO: 252368 - DNA, 845 bp, Homo sapiens
  misc_feature: GYAE6OF01AQDBZ.49.35.D02.1.454.CMB.1.raw
  modified_base (217)..(217): a, c, t, g, unknown or other
  misc_feature (217)..(217): n is a, c, g, or t
  modified_base (653)..(653): a, c, t, g, unknown or other
  misc_feature (653)..(653): n is a, c, g, or t
  modified_base (816)..(816): a, c, t, g, unknown or other
  misc_feature (816)..(816): n is a, c, g, or t
tcagagtcgagagacacgaccggtgctcgatttagcacacgatagttgggtttggggggggtcgtcgaggaggcagcgctctcgggacgtctccaccatgcctggctctgctattccctcaccctcctcactcaggcacgaggtcctgggccagtctgccctgactcgagcctgccttccgtgtccgtgggtctccgtaggacagttcgatccaccngttcctccgtgccacgtcggaaacccacgtaatcggtaccgtttggtaaccttatttaacttcttacgtccttaccgtacggttaaccaaaccgtaaccgttaccccggaacctaaaaccggttaccccctaaaacgttccgaaacgttacggtaacgtttactttacggtacggttacgtacggtacgacggttcccggaccggtaacggttcggggtttccctacgtacgttccgtcgtttccgtccggtactaaccgtacgtacccgtcgggtaccacggtacccgtaccggtccccttaacgtaccgacccgttacttcgggtccggttaccggtacccggttccgacggttccggttaaccggacgggaaccgggtaacggtcgttacgttaacgtttacgttaacgtccggactacggtactaccgttanaaaaccgttactaaaaccctaagttaaaccgtacgggttttacgggtttaacggtaccgggtacccgggtaaacccggggtaacgtaaaccgttaccggtaccccgtaacgttaccgtaccgaaccgttacgccgtaccgtccccgtaacccgttcggtaccncgtttccctacccgttcccgttaaccccg

SEQ ID NO: 252369 - DNA, 758 bp, Homo sapiens
  misc_feature: GYAE6OF01ESBW8.49.35.D02.1.454.CMB.1.raw
tcagagtcgagagacacgaccggtgctcgatttagcacacgatagttgggtttggggggggtctcaggagcagcgctctcgggacgtctccaccatggcctgggctctgctattcctcaccctctcactcagggcacagggtcctgggccagtctgccctgactcacgcctgcctccgtgtcgtgggtctcgtggactgtcgactcactatcctacctgacacgtacggaacccaccgtaagtcgtacgtttggtaactttataacttcgtcgttccttaccgtacgtaacccaactaaccgtacccggaacctaaaccgtaacccaacgtctacgtgttaacttcgtttaggacggttacgtggtacgacggtcccggccggtacggttacgggttctacgtacgttcgtccgttccgtccggctacgtacgtcgttacggcgacgaccggtaccgtccctacccgtaccgacctacgttccggtcgttaccgggtcctacgggtacggtccgggtaggggaccgtaggtcttagtacgtttattaacgttgttcttacgttacgtacttggtaccggtggttacgtagggttacgggtacggggtacggggttaacgggttcgggtaacggggacggggtaacgggtaaccggacgggttaccggtacccgttacggacggtaccgacggaacccgtacgtcccgtacccgtccccggtcgtaacccttcgtccccttccgtaccccgttaccccg

SEQ ID NO: 252370 - DNA, 678 bp, Homo sapiens
  misc_feature: GYAE6OF01CB2Y8.49.35.D02.1.454.CMB.1.raw
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
tcagagtcgagagacacgaccggtgctcgatttagcacacgatagttgggtttgggggggggtctcaggaggcagcgctctcgggacgtctccaccatggcctggctctgctattcctcaccctcctcactcagggcacagggtcctgggcccagtctcgccctgactcagcctcgcctccgtgtcgtgggtcctccgtggacagtcgactcacctactcctcctgccacgtacggaaccacaatcgtacgttgtaacttatattctcgtctaccgtgtaaccaacaaccgtacccggactaaaccgtaccccaactcatnacttcgttggacgtcaggtgacgtccggccngtagttcgttctctatcgtccttccgtccgctacgtagtcgtcggcagaccgtccgccttcccgcgtacctacgttcgtcggtcgggtcctccggacggtccgtagggacggtaacggtcgtacttacggttaactttaacgttacgtacggacctacgtacctacgtaactaactaaacaaacctaactaaacggttcggttagggtcggtacgggacggaccggtaaacctacgtaccgttaccgtcccgtaacgtacggcccgtaccggaccgtcctacccggtaccccgtaccgttactcccgttccgtcccgttccccccg

SEQ ID NO: 252371 - DNA, 640 bp, Homo sapiens
  misc_feature: GYAE6OF01EODSM.49.35.D02.1.454.CMB.1.raw
  modified_base (203)..(203): a, c, t, g, unknown or other
  misc_feature (203)..(203): n is a, c, g, or t
  modified_base (439)..(439): a, c, t, g, unknown or other
  misc_feature (439)..(439): n is a, c, g, or t
  modified_base (598)..(598): a, c, t, g, unknown or other
  misc_feature (598)..(598): n is a, c, g, or t
tcagagtcgagagacacgaccggtgctcgatttagcacacgatagttggggtttgggggggggtctcgaggaggcagcgctcgtcgggacgtctccaccatggcctgggctctgctattcctcaccctcctcactcagggcacagggtcctgggcccagtctgccctgactcagcctgcctccgtgtctgggtctccgtggcngtcgatcaccatcctctgcactaggaaccacaatgacgttgtactttatacttctactcttctcggtaaccaacaactacccggaactaacgtacccaaactccatgtattctttgaacggttcagtcgacgtccggccgtacgtagggttctcgtactcgtcttccgtccggtctccgaacgtcgtcggcagccgaccggtcctccctacgacctactcctcggcggtccaccgngacctgggaacggacggcggactgttaattacttacgtcgcacgtctactaataacaaactaaccttaactaacgtcgtttagggttaccggtacgggccggaccggtaaaccgacgtaccggtacccgtccgtacgaccgaccggaccaccggtaccncccggtccccttacgccttaccgtccttaccgtccctacccc

SEQ ID NO: 252372 - DNA, 713 bp, Homo sapiens
  misc_feature: GYAE6OF01E26F5.49.35.D02.1.454.CMB.1.raw
tcagagtcgagagacacgaccggtgctcgatttagcacacgatagttgggttggggggggtctcaggaggcagcgctctcgggacgtctccaccatggcctggctctgctattcctcaccctctcactcgaggcacgagggtcctgggccctagtctcgccctgactcagcctgtcctcgtgtcgtggtctccgtggactgtcgactccacctctcctcctgcaccgtacgaacccacgtaatggtaccgtttagtaactttatacgttccgtgtccgtcgtacgtaacctaaccgtaaccgtacccgaacctaaccgtaccctaactactacgtacgtacttcgttacggtacgtcgagtacgtaccgtccggccgtacggttacgttctcgtactcgtccgtccgccgtactacgtacgtcgcgacacgccgtccgtctccgactactctcgtcgtcgtctcgtcgtcgtaggacggtacggtgtacgtagtacttacgtacgtcgtacgtactaccgtaacgtaactaactaaacgtaaactaaccgttaacggtttacgggttcggttaccgggtaccgggtaaccggtaaccggtaacctaaccggtaccgtacccgtaccgtaccgtacgtacccggaacccgtccggtacccgttcccgtaccccgtaccgtaccctacccgttccccgtccccgttaccctcccg

SEQ ID NO: 252373 - DNA, 937 bp, Homo sapiens
  misc_feature: GYAE6OF01DLJK3.49.35.D02.1.454.CMB.1.raw
  modified_base (223)..(223): a, c, t, g, unknown or other
  misc_feature (223)..(223): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcagggcacgagggtcctgggccctagtctgccctgacctcagcctgtcctccggtgtcgtcgggtcctccgtggacagttcgactccaacctntcccgtcctgacctacgtacgaaccctacaatcggtaacgtttcggtaacttagtaactttccgtagtccttaccgtacgtaacccgaaacgtaaccgttaaccccggaactaaaaccgtacccctaaacgttcaagttcgtaactttcgtttaggtacggtacgtagtcgtacgtaccggcccggtcggttacgggtttcctaccgttacgtccgtccgttaccgtcccggtccttaaccgtaaccggttccgtacggtaccgtacggaccctaccccgggtacccctaccccgtacgtaaccccgttcgttacccggtttcggtaccgggtaccccgtaccgggtaaccgggtaccgggtacgggaccggggtaacgttaaccggggacgtttacggttaacttttaacgggttaccgttacggtaccgtacggttaccgttaaccctaagttaaaacccttaaaacttaaaccgttaaaccgttaaaaaccggttccggggtttcgggtttaccggggttacccggggtaacccgggtaacccggggtaaaccctaaaccgggttacccgtacccccggggttaaaccgttacccgaaccggtaaccccggtaaccggtaacccggttacccggttcccccgtaacccccgggttaccgttacccgttaccccggtttacccgttacccccggttcccgttaccccccccg

SEQ ID NO: 252374 - DNA, 682 bp, Homo sapiens
  misc_feature: GYAE6OF01BC7IO.49.35.D02.1.454.CMB.1.raw
  modified_base (425)..(425): a, c, t, g, unknown or other
  misc_feature (425)..(425): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
tcagagtcgagagacacgaccggtgctcgatttagcacacgatagttggggtttggggggggtctcaggaggcagcgctctcgggacgtctccaccatggccgtggctctgctattcctcaccctcctcactcgagggcacgacgggtcctgggccagtctcgcctgactcagtcctgcctcgtgtcgtcggtctccgtaggactagtacgtactccacctattcctacgtcgactaccgtacgaaccactagtagtacgttagtacttatatcgtatcgtcgtacgtaccaactacgtacccgataaaccgtaccaatcgtatcgtacgttgttacggagtcgagtcggtactccggaccgtacggtcggttactcgtacgtctcgttaccggccgtactcgactggtcatcgaccgtcgtccnctacgctacgtctcgcgactggcgatcgggactacgntntacgtatctacnccgngtacgactagtaactaaccgtaacaaacgttaccgttaacgcgggggtttacgccgggtttacccggacggtacccggtaaacccttagggccgttaccttaccgggaccgtacggaccccgttaaacggggccttaaccccgccccggtttaccccgacgttaccctacccgtttacccgttccccggtacccctttcccg

SEQ ID NO: 252375 - DNA, 783 bp, Homo sapiens
  misc_feature: GYAE6OF01D5Q2W.49.35.D02.1.454.CMB.1.raw
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacgagggtcctgggcccagtctcgccctgactcacgcctcgcctccgtgtcgtgggtctccgtggacagtcgatcaccatcctcctgcactaggaaccaccatcgtacgttaggtacttagtattctcgtctcctaggtaaccaacaacctaccccggtacaaaccgtaccccaaacncatntacttctttaggacggtcagtcgacgaccggccgtagtacgggtttctcgacgtcgtcttccgtaccggctaccgtaacgttcgtcggcgacgtaccgccgtcccctcccgtacgacctaacgttccgttacggtccgggtcccttaccggacgggtacccgttaggtaacggggtaacggaccggtacgttaggttaaacgtttaacctttcgttaaccggactacgttaccgttaaactaagttaaaaccaaaaccaaaacgtaaaaccgttaaaccgttacggggtttaggggttacccgggttaaccggggaccgggtaacccgggaaaccctaaaccggtacccggtacccggtaccgttacccggtaaccgtaccgggaccccgtacggttcccccgtccggttaaccccccgttcggtaccctccttcccgttcccgttacccccgttacccccg

SEQ ID NO: 252376 - DNA, 803 bp, Homo sapiens
  misc_feature: GYAE6OF01B2FDZ.49.35.D02.1.454.CMB.1.raw
tcagagtcgagagacacgaccggtgctcgatttagcacacgatagttggggtttgggggggggtctcaggaggcagcgctctcgggacgtctccaccatggcctgggctctgctattcctcaccctcctcactcgagggcacgagggtcctggggcccagtctcgccctgactcagcctgcctccgtgtctgggtctccgtggacagtcgactcaccatctcctcgcaccgtacgaaccaccaagtcgtacggttgtaactttatattctgtctctcgtaaccaactaacctacccgaacaacctacccaaactctatacgtattcgtttaggacggtacgaggtcggtcggtaccgggtccggtacggttacggggtttcctacgtacgtccgttaccttccggtcccgtacctaccgtaagtcggtcgggacaccgggccgtaccggtcccctaccctacgtacctacgtccgttcggtcgggccgtccgtacggtcgtagggacggtacggacggtacttagttaactttactacgtcgaccgtactacctactaactaactaaactaaaacctaacgttaaacggttcgggtttacggggttaccgggtttaccggggaccgggtaaccgggaaacccgttaaaccggtacccgggttaaacccgtacccggttaaccgggtaacccggtaacccgggtacccggtaccgggttaccccggttacccccggtacccccgttacccggttacccgttaaccccggtttcccggttacccccggttccccccgttaccccg

SEQ ID NO: 252377 - DNA, 747 bp, Homo sapiens
  misc_feature: GYAE6OF01BKGML.49.35.D02.1.454.CMB.1.raw
  modified_base (521)..(521): a, c, t, g, unknown or other
  misc_feature (521)..(521): n is a, c, g, or t
  modified_base (543)..(543): a, c, t, g, unknown or other
  misc_feature (543)..(543): n is a, c, g, or t
  modified_base (555)..(555): a, c, t, g, unknown or other
  misc_feature (555)..(555): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcaggcacgtagggtcctgggcccagtctgccctgactcagcctgcctcgtgtctcgggtctcctggacctagtcgatcaccactcgtcctgcacgtacgacctacatgtacgttgtaacttatattctcgtctaccgtacggtaaccaaacctaaccgtaccccgggaactaaaccggtacccctaaaactctaatgtactttacggtttacggacgttccaggttacgtccgttaccggcccggtacggttacgggtttcactacgtccgttcttccgtaccgtctactaacgtcgtcgacgacgccgacggacctaccgtccacgtacctacgttccgtccggtcggaccctccggagggtccttacggggaacgagggaccggttanacgttaaactaccgtttaccgngaacgtaccgtntaacctacgtaaacgttaaaccaaactttaactaaacggtttcgggtttacggacccgggttacggggaccggtaaccggtaccctaacggtaccccggtacccgtagttaacccgccgaaaccgggtcccgaccggtacccgtccccgtaccggttaccgaactccccggttacgttcccccgttaccccg

SEQ ID NO: 252378 - DNA, 874 bp, Homo sapiens
  misc_feature: GYAE6OF01ESR2A.49.35.D02.1.454.CMB.1.raw
  modified_base (213)..(213): a, c, t, g, unknown or other
  misc_feature (213)..(213): n is a, c, g, or t
  modified_base (339)..(339): a, c, t, g, unknown or other
  misc_feature (339)..(339): n is a, c, g, or t
  modified_base (641)..(641): a, c, t, g, unknown or other
  misc_feature (641)..(641): n is a, c, g, or t
tcagagtcgagagacacgaccggtgctcgatttagcacacgatagtttgggtttggggggggggtctcaggaggcagcgctctcgggacgtctccaccatggcctgggctctgctattccctcaccctcctcactcagggcacagggtcctgggcccagtctgccctgacctcagccctgccctccgtgtcctgggtctcctggtacagtcgntcaccatctcctagcactacggaaccacaagtgtagttgtaactatacttactgtctctcgtaacctaacaaaccgtacccgactaaaccgtacccaaactcagttagatttcgtagtacgtacgnaaagttcggaacccgttccgaccggggtttccttaccggggttacttccgactttccgtaccgtaccgttcccgaaacgttaccctaggggtacccgtaacgggtacctaccgggtaccccttaacccgggttcccgttaaccccgtaaacggttacccgtaacccggttttcccggggacttttaacccccgggtaacgggggttacccctttacggggtaaaccggggtaacccgggtaaacggggaacccgttacggggaaaccggttttaaccgtttaaccggtacggttaaccctancgtaccgtaaccgtaaccgtaaccgtaaaccgtaaaccgtaaaccgttaaaacctaaaccgttaacggtaaaccggttaaccggtaccggggtaccgggtaacccggtaaaccggtaccggtaaccccgtaacccgtaaccgtcccgtacccggaacccgtaaccggtaccgtacccgtacccccgtacccggtaccgtaccccgttacccgttaccgttaccccgtaccccg

SEQ ID NO: 252379 - DNA, 749 bp, Homo sapiens
  misc_feature: GYAE6OF01CXJGR.49.35.D02.1.454.CMB.1.raw
  modified_base (652)..(652): a, c, t, g, unknown or other
  misc_feature (652)..(652): n is a, c, g, or t
tcagagtcgagagacacgaccggtgctcgatttagcacacgatagttgggtttgggggcatcacataacaaccagattcctcctactaaaagaacgcccctgggagcacagctcatcaccatggactggacctggaggttcctctttgtggtggcagcagctaacgaggtcgcccacgtcccgggtccagcgtggtgacaagtcggtggggtctggaggtagaagaaacgccgtgggtcgtcggtagaacggtctcgtgacgaaggtcttcgtaggacacctaccttacaaacttaacgtttgctagtcgaggtcgttgggacgccgaacgaccggtaccccgtaggaaccgtaacggtccgttaggaaggggtggggtaacgggaaacggtaccttacccgtaaccccttaagttaacccgttaaaagttaacgtaacggaaaccgtaaaacttacgtacgaccgaactaacgtaactaacgttaacccgaacgacgtaagtacgtaccgtaacccgttagaccggaacgtaaacaaaccgtaccaaacgaaacccacgaaccgtactaaagaacgttacggaaactcgacgaacgacgacgtaacggtactccgacgacccgacggtaccgtacgttattacgtttacgnggtacgacggaagtacggtaacgttacgtttagttaccctttagtaacgttaggttaaacttaacggttaaacgtagtaacctttaagttcgttacg

SEQ ID NO: 252380 - DNA, 813 bp, Homo sapiens
  misc_feature: GYAE6OF01C5VIC.49.35.D02.1.454.CMB.1.raw
  modified_base (105)..(105): a, c, t, g, unknown or other
  misc_feature (105)..(105): n is a, c, g, or t
  modified_base (289)..(289): a, c, t, g, unknown or other
  misc_feature (289)..(289): n is a, c, g, or t
  modified_base (610)..(610): a, c, t, g, unknown or other
  misc_feature (610)..(610): n is a, c, g, or t
tcagagtcgagagacacgaccggtgctcgatttagcacacgatagttgggttggggcatcacataacaaccagattcctcctactaaagaagcccctgggagcanagctcatcaccatgactggactggagttcctcgtttgtggtggcagcagctacgaggtcgcccgacggttcccgggtccacgtcgtggtgactaagtcgtggggtctggtaggtagaagaaccgtccggttcggggttccggttaggtacggacggttcctccgtaggtacgacggtcttacgnggacgtaacctaccttaccaaacgttacgtttcgcgttcgtctaggtcgttcgggtcggaccgtaccggtaccggtaccccggtaaggaaccggtacggttaccggttagggacggggttacggggtaacggggaaccgttaccctaccccgtaaacccgttttacgtttaaccgtttaaagtaacgtaaccgttaaccgtaaacgttactacggaaccgtaccgtaacgtacctaccgttaacccacggtaacctacggtaaccttacccgttaacccttacggaaccgtaccgaaaccctaaccgtcccaaacgtaacnccgtaacgacctagtacggtacgtaccggacgtccggacgtacgtacggtaacgtacgtccgaaccgggtcccgtaaccgtccgggtttacttacggtttcttcgggacgtaccgacgggttaagagtttaaccgtctttaacgttacttacggttagttaaggtaaccgtttcctaagtacgtttaacttcgtttaggtccg

SEQ ID NO: 252381 - DNA, 722 bp, Homo sapiens
  misc_feature: GYAE6OF01DNEOU.49.35.D02.1.454.CMB.1.raw
  modified_base (277)..(277): a, c, t, g, unknown or other
  misc_feature (277)..(277): n is a, c, g, or t
  modified_base (368)..(368): a, c, t, g, unknown or other
  misc_feature (368)..(368): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacacgggtcctgggcccagtctcgccctgactcacgcctcgccttccgtgtcgttgggtcctccgtggacagtcgatccaccacttcctcctgccacgtacggaacccacaatcggtacgttgttaacttatattctntctcctagtaccaacactacccggacaaaccgtacccaaactcatgtattcttgtagtcagtgacgccggccgtcgtagggtttcactacncgtcttcgtccgtacctcaacgttcgtggacgacgccgaccggtccctccctacgcctactccgtcggtacgggcctaccgagggtccgtaggaacgggaggtacggtcgtaagttacgtttaacgttcgtacgcgtactacgttaactaacttaaacctaacaaaaccgttaattaaaccgttacgggtttcgggttacgggttccgggaaccgggtaccgggaacctaaacggtcccgtaacccgttacccttaacggtacccaccggaaccccggtaccggcccgttacccccggtacccccgttcggtacccttacccggtccccgttccccgttccccctttacccccc

SEQ ID NO: 252382 - DNA, 878 bp, Homo sapiens
  misc_feature: GYAE6OF01BFFLJ.49.35.D02.1.454.CMB.1.raw
tcagagtcgagagacacgaccggtgctcgatttagcacacgatagttggggtttgggggggggtctcaggaggcagcgctctcgggacgtctccaccatggcctggctctgctattccctcaccctcctcactcgagggcacgacgggtcctgggcccagttctcggccctgacctcagcctgccctccgtgtcgtgggtctccgtggacagtcactcaccatctcctgccacgtcggaacccactaagtcgtacgtttgtactttatacttctgtctcctaggtaaccaaccaactacccgacaaacgtaccccaaactctatgtacttcgtttaggacgttcgaggttacgtacggtccggaccggtcgggttacgggtttctcgtacgttccgtcgttaccggtccggtaccttaccgaacgtcgtacggacgaccggccggtacccgtcccgttacccgtaccgtaacctcgttacccgtccgggttccgggtacccgttacccgggacggtaccgggtcgggaaccgggaacgggtacgggttcctaaggtttaaccgttttaacggttaaccggtacggtacgtaccgttaacccgttacgtaaactaaacgttaaaaccctaaaacgttaaacgttaaacccgtttacggggtttaccgggttacgggggtttaccccgggtaacgggggtaacccggtaaaccggtaaccggttaacccggttaaacccggttacccggttaaaccggtaccccgtaaacccgggtaccgttaacccccccccgggtacgttaccccccggtacccccgggttaaccgggttcccccttacgggttccccctttcccgggttaacccccccggttccccc

SEQ ID NO: 252383 - DNA, 698 bp, Homo sapiens
  misc_feature: GYAE6OF01C6BHS.49.35.D02.1.454.CMB.1.raw
  modified_base (400)..(400): a, c, t, g, unknown or other
  misc_feature (400)..(400): n is a, c, g, or t
  modified_base (435)..(435): a, c, t, g, unknown or other
  misc_feature (435)..(435): n is a, c, g, or t
  modified_base (458)..(458): a, c, t, g, unknown or other
  misc_feature (458)..(458): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
tcagagtcgagagacacgaccggtgctcgatttagcacacgatagttggggtttggggggggtctcaggaggcagcgctcgtcgggacgtctccaccatggcctggctctgctattcctcaccctcctcactcgagggcacgacgggtccgcgggcccagtctcgccctgactcagcctcgcctccgtgtcgtggtctccgtgacgtagcgctccactactcctcctgacacgagaaccacgaactggtacgtttgtaacttaataacgttctacgttcttaccgacggtaaaccaaacgtaaacccgtacccggaactaaaaccgtacccctaaatacatacgtacgttacgtttagaacggtactagtacgaccgtccggccgtacggttaggtttcncgtactaccggtctacgtccgactaccgaagtcgnggacacggtccaccggtcctacncgaactctcgcggacggctacgagcgaggaagcgagtctagtaatttacgacngtacngaactacttaaanaaactaactaaacgtaacgtaaccgttgggttacgggtaccggtacgggaaccgggaaccggaaaccgtaccgtaccgtacccgaacgtacccggacgaacccgaccggcgttaccccgtccccggtacccgttactacccgttacctcccttaccccgtcccctcccg

SEQ ID NO: 252384 - DNA, 703 bp, Homo sapiens
  misc_feature: GYAE6OF01BHHIB.49.35.D02.1.454.CMB.1.raw
tcagagtcgagagacacgaccggtgctcgatttagcacacgatagttgggtttggggggggtctcaggaggcagcgctctcgggacgtctccaccatggcctggctctgctattcctcaccctcctcactcagggcacgagggtcctgggcccagtctcgccctgactcacgcctgcctccgtgtctgggtcctcctggacagtcgatcaccatcgtcctagcactggaacccactaatcgtacgttgttactatattctgtctcgtacgtacaacaacgtacccgacaaacgtacccaaactcatagaacttctttagtacggtcagtacgacgtccggcccgtacggtacggggtttcctacgtactccggtccttcccgtaccgggtcctaccgtaaggttccgtggacctacggccgaaccggtccccttcccgtacgtaacctacctccttcgtacgggtcctaccggacggtactacgggaacggccggtaagggtcttacggtaagtttacttaccgtacggacctacgtctacgtaactaactaaacctaataaacttaaccgtaggtttcggggttcgtaaccgggtaccggggaccgtaaccgtaaacggtcctaacccgtacgtaccggtcaaccggccgaacgtcgtaccccgacccgtcggacctacctccgtcccgttaaccctccccg

SEQ ID NO: 252385 - DNA, 784 bp, Homo sapiens
  misc_feature: GYAE6OF01B1TC7.49.35.D02.1.454.CMB.1.raw
tcagagtcgagagacacgaccggtgctcgatttagcacacgatagttggggtttggggggggtctcaggaggcagcgctctcgggacgtctccaccatggcctgggctctgctattcctcaccctctcactcaggcacagggtcctgggcccagtctgccctgactcagcctgcctccgtgtctgggtctccgtggacaggtcgatcaccatcctcctgccacgtacggaaccaaccaatgtacgttggtaacttataattcttgtcctctacggtaaccaacaacgaccccgacaaaccacccaaactcatcgtactcgttcgagtctagtgtacgtccggcccgtacggtcgggtttctacgtacgtccgtccttccgtcccgtcgtaccgtaacggtcgtcggtaccgacgaccgtcccggtaccccttcccgtacaacccgtacttccgtaccggtcggggtcccctaccggcggtacggcgggaacgggtaacggcggtacttggtaatttaacttccgagtccgagtccttagtaactaaccgttaaacaaaaccctaacgttaacgttaacggggttttcgggtaccgggttacgggggaaccggtaacggggtaacccctaacgggttaccgttaaccgggtaccccgttaacgggtaaccgggttaccgaacccggtaaccccgggaacgggttcccccgtcccccccgggtttaaacccggttccgggttaaacccttcccgtttaccccggtttccccgttaaaccccccccg

SEQ ID NO: 252386 - DNA, 869 bp, Homo sapiens
  misc_feature: GYAE6OF01ER4Q4.49.35.D02.1.454.CMB.1.raw
tcagagtcgagagacacgaccggtgctcgatttagcacacgatagttggggtttgggggggggtctcaggaggcagcgctctcgggactctccaccatggcctggctctgctattcctcaccctcctcactcagggcacgagggtcctgggccagtctgccctgactcagtcctgcctcgtgtctcggtctcgtggacagtcgatcaccactctccgtgcctacgtacgaaccactagtcgtacggttgtacttatacttctcgtctccgtagtaaccaacaaccgtaccccggataaaccgtaccccaaactctagtcgtacgttcgtttacggaggttaccggtggtacgtacggtcccggtacccggtaggttacgggtttccacgtcgttaccgtcttcccgccggtacctccggtaagtccgtaggacgtaaccgtccgacccggtacccttccgtaaccggtaccctacttcccggttacgggtccgggttacccaccgggttacggtaccggtaacgggtaacggggtaaccggtaacgggtcgttaagtttaaccgtttaacgttccggtaacgtacccgttaacgttaccctaaggtaacttaaaccgtaaaacgttaaaccttaaaccgttaaagggtttaccggggtttaaccggggttacgggttaaccccggggacccgggtaaaccccggggtaaacctaaccggtttaaacccgggtaccccggttacccgtaacggttaaccccggaacccgggttaacccggtccgggttaacccccgtccccgggtacccccgtttccgggtaacccttaccccggttttccccgttaaccccgtccccccgtttaccccg

SEQ ID NO: 252387 - DNA, 823 bp, Homo sapiens
  misc_feature: GYAE6OF01A0BDZ.49.35.D02.1.454.CMB.1.raw
tcagagtcgagagacacgaccggtgctcgatttagcacacgatagttgggtttgggggggtctcaggaggcagcgctctcgggactctccaccatggcctggctctgctattcctcaccctcctcactcaggcacgacgggtcctcgggccctagtctcgtcctgactcgcgtctgtcctcgtgtcgtcgggtcctccgtaggactacggtccgaacttccgaaccctacgttcctaccgtcgacctacgtaccgaaacccacgtaagtcggttaacggtttacgttaacgttaattaacttccgttcgttacccgttaccgttaaccggtaaaccctaaaccgtaacccggtaacccggtaacctaaaacccgttaaccccaacttacgtacttacgttacgtttacgttacgggtacggttacgtaggtccggtacggtacccgggaccggttacggttcggttacctacgtccgttccgtacgttcccgtaccgtaccgtacgtacgtcgacgtaccgcgtacccggtcgtccctcgtactcgtcgtccgtcgcgtccgacgacgtcgtacggacggtacgtacgtacgtacgttaacgttacgtcgtactacgtacgtactactaactaaccgtaactaaacgtaacgttaacggttacgggttacgggtaccgggtaccggtaccggtaacccggtaaccgtaccgtacccgttacccggtaccgtaaccggtaccgtacccgtaaccggtccgtacccggtaccccggtaccgttacccggttaccctaccggttaccccgttcccgtcccggtccc

SEQ ID NO: 252388 - DNA, 705 bp, Homo sapiens
  misc_feature: GYAE6OF01EQY63.49.35.D02.1.454.CMB.1.raw
  modified_base (227)..(227): a, c, t, g, unknown or other
  misc_feature (227)..(227): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcaggggcacgagggtcctgggcccagtctcgccctgactcagcctgcctccgtgtcgtgggtcctcgtggactaggtcgatccaccatcttccngcactacggaacccacaatcgtacgttgacttaataattctcgttctccgtcgtaaccaaacaaccgtacccggaacaaaccgtaccctaaatcatgtattgttagaggtcaggtcgtacggccgggccgtacggttacggggtttctccgtacgtccgtccttcccgtaccggtcctaccgtaagttccgtcggaacgtacgccgtaccggtccctaccctacggacctagttccgtgtaccgggtcctaccggagtacggtaggacgggaccggtaggtctagtaattacgtacttacggctagtcgtactaacgtaactaaaaccaactaaacggtaactacgggtttacggggtacggttcggggaacccggtacgggtaacccaacggttaccggtcctaccggaaccgttcgaaccgacggacgcccgttcccgacccggttctaccctcgttccttaccctcccctaaccg

SEQ ID NO: 252389 - DNA, 756 bp, Homo sapiens
  misc_feature: GYAE6OF01C8GZS.49.35.D02.1.454.CMB.1.raw
  modified_base (171)..(171): a, c, t, g, unknown or other
  misc_feature (171)..(171): n is a, c, g, or t
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
tcagagtcgagagacacgaccggtgctcgatttagcacacgatagttgggtttggggggggtctcaggaggcagcgctctcgggacgtctccaccatggcctggctctgctattcctcaccctctcactcagggcacagggtcctggcccagtctgccctgactcagcctncctcgtgtcgtggtcctctggacncgtcgatccaccntcctcctncctacgtacggaaccacccgtaaagtcggtaacgtttcggttaacttagttaactttcgtgttcctaccgtacggtaacctaaaccaaccgtacccccggacaaaaccggtaccccaaactaccagtgacttcgtttacgaggtcgtaacgtggactccggccgtcgttacgggtttctaccactcgtccgttcgtccgtactccgtaactcgtcgcgtacgccgtaccggcccttcccgtcgaacctacgttacgtccggtcgggtactacccgtggtaccgtacggaacgggtcgggacggtaacgttagttaactttacgtaacgtcgtacgcggtactactaactaacgtaaaccaaacttaacgttaaacgttacggtcggggtttacggttaccgggaccggtacccgggaaacgttaaccggtcgtaacccggttccttaccggaactcccgggtaaccgaacccggcccgttcccggtacccccgtttacggtccccgttaacgtttcccgttcccgttaccccttcccccg

SEQ ID NO: 252390 - DNA, 654 bp, Homo sapiens
  misc_feature: GYAE6OF01AJLEK.49.35.D02.1.454.CMB.1.raw
  modified_base (198)..(198): a, c, t, g, unknown or other
  misc_feature (198)..(198): n is a, c, g, or t
  modified_base (340)..(340): a, c, t, g, unknown or other
  misc_feature (340)..(340): n is a, c, g, or t
tcagagtcgagagacacgaccggtgctcgatttagcacacgatagttgggtttggggggggtctcaggagacagcgctctcgggacgtctccaccatggcctgggctctgctattcctcaccctcctcactcagggcacagggtcctgggcccagtctgccctgactcagcctgcctccgtgtctggtctcctggacngtcgatcacatctcctgcactcgaaccacaatgtacgttggtacttataattctgtctccgtgtaccaacactacccggacaaacgtaccccaactcactgtattctttggagtcagtgactcggcccgcgtacgggtttcnctatcgtcttccgtccgtcttaccgaacgtcgtcggcgtacgccgaccggtccctccgtcgaacctcgttccgtcgtccgggcctaccgacggtcgtggacgggaccgaggtacctggtaatttcgttagtcgacgacgtctcttaactaacgtaaacaactaacgttaaaccgtacggtttgggtccgggttaccggccggggtaacccgaaaccgtaaccgttccggacccgttaccgtacccgtacggacccgaccacgggtcctaccccggtccccgtctacctacgttcctcccggttcccctaccccg

SEQ ID NO: 252391 - DNA, 790 bp, Homo sapiens
  misc_feature: GYAE6OF01AWS3V.49.35.D02.1.454.CMB.1.raw
tcagagtcgagagacacgaccggtgctcgatttagcacacgatagttgggtttgggggcatcacataacaaccagattcctcctctaaagaacgcccctgggagcacagctcatcaccatggactggacctggacggttccttcgtttggtggtggcagcagctacaggtcgcccacggtcccgggtccagcgtggtgacaatcgtgggctggaggtgagaacgccgtgggtcgtcggtaggagtctccgtgcgaaggtcttcgacggacgacctaccttacgaaactaacttttcgcgttgtcgtagtccgtgggtcgccgtacgaccggtccccgtaggacgaacggtccgtggacggttggggtagggaacgtactcctaccccgtacttaccgttaatacgtagaacctaaacgtcgtacgacgaacgtacgtaacctaacgttacccgaacgtaacgacgttaaccgttaccctaacccgtttaacgtacccggaaccggtaaacctaaacgtaacccgtaaacccgtaaacgaacctaaccgtacctaaaccgtaaggtaaccggtaacgttaccggcccgtaacctaccggggtaccgtaccggttacgtcccggtaaccggacccggtaaacccggttccggttacccgtttaagtttaccgtttcgtacggtacggtaaccggtacggtaaaccgtagttacgtttacgttaccgttttaccgtagttaacggttaacgttttacccggttaactttaaggttctttaaacgttgttccgg

SEQ ID NO: 252392 - DNA, 728 bp, Homo sapiens
  misc_feature: GYAE6OF01BY37V.49.35.D02.1.454.CMB.1.raw
  modified_base (295)..(295): a, c, t, g, unknown or other
  misc_feature (295)..(295): n is a, c, g, or t
tcagagtcgagagacacgaccggtgctcgatttagcacacgatagttgggtttgggggcatcacataacaaccagattcctcctctaaaagaagcccctgggagcacagctcatcaccatggactggacctggaggttcctctttgtggtggcagcagctacaggtcgcccagtcccgggtcagctggtgcaatcgtgggctggaggtgagaagcgtgggtcgtcggtgaggtctccgtgacgagtcttcgtggacacctaccttacaaacctacgtttgcgtgtcagtcgtggngccgacgccggtccccgtaggaaccgacggtccgtggaggtggggtacgggaacggtacctacccgtacccttacttaaccttaaagtacgtaacgtaacctaaacttagacgacctaacgaacgtaacgtacttacccgaacgaacgacggtaccctacccttaacccgttacggtaccggaacgaaacccgtaacctacccgaacaaacccgaccgtaccgtaaccctacgaacgtaaccggacgtacggtacgaccgacggtaaccgtaacggtacgtcccgtaccggaccccgtacgacccgggttaactttacgttaacgtttccgacggttaacggacggtaaggtaaacgtcgttagtttcggtttaccttttcgaagttaacgtaacttacgttaacctttaggtaccctttaagttccgttacg

SEQ ID NO: 252393 - DNA, 807 bp, Homo sapiens
  misc_feature: GYAE6OF01C4TVG.49.35.D02.1.454.CMB.1.raw
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
tcagagtcgagagacacgaccggtgctcgatttagcacacgataggttggggtttggggggggtctcaggaggcagcgctcgtcgggacgtctccaccatggccgtgggctctgcttacttcctcaccctcctcactacagggcacgacggtcctgggccagtctcgccctgactcagcctcgccgtccgtgtcgtggtcctaccgtggacagtcgactcaccatcctctgactacgtacggaaccactaagtcggtacgttacgttaacttaacttaagttccttacgtccttccgtaacgtaaccaaacgtaaccgtacccggtaactaaaacctaccctaaactcagtacgttacttacgtttaggacgttcaggtacgtaccggcccggtacccggnggttacgggtttaccnctaccgtcgttaccgttccgtaccggactacggtacgtccggtcggacaaccgtccgggaccgtcccgttacccaacgtaacctcggtttcccacgggttcgacccgtcgggaacgtcggtaggaaacgggcttacggagttattaacttacgtcgtagtcgactactaataacttaaccgaaaactaaacgttaaaccgttaacggtcgggttacgggttaccgggttaaccgggaccgggtaaaccggtaaaccccgtaaggttcccgttaaaccgttaaccggtacccggtaacctacccggaacccggtaccgggttccccggttaaccccggtccccggtacttacccgtccccgttcgttaaccccccgtccccgtttaccccg

SEQ ID NO: 252394 - DNA, 951 bp, Homo sapiens
  misc_feature: GYAE6OF01AVFQE.49.35.D02.1.454.CMB.1.raw
  modified_base (220)..(220): a, c, t, g, unknown or other
  misc_feature (220)..(220): n is a, c, g, or t
tcagagtcgagagacacgaccggtgctcgatttagcacacgatagttgggtttggggggggtctcaggaggcagcgctctcgggacgtctccaccatggcctgggctctgctatccctcaccctcctcactcgaggcacagggtcctgggcccagtcctgccctgactcagcctgcctcgtgtcgtgggtctaccgtggacaggtccgattccgaacctnttccctcctagcctacgttaggaaaccccacctaaagttcggtaaccggtttaggttaacctttaaacttaacgttttccttacgttccgtttaccccgtagggttaacccctaaacccgtaaaccgttaaccccccgggtacctaaaaccggtcccccctaaaacgtacctaacgtacgtaagtttccgttttacggtaggttacgacggttacggtaccgtaccgggtacccggtccggttaacggggttttccgtaccgtaccgttccgttccgttcccgttccccgggtaccgttacccgtaaacggttccgtagggtcccgtaaccgacccggtacccggtccccgtaccctccgggaaccctacttcccggtccgtaccggggtaccctacgtacggggtccgggttacggggacggtaacgggcctttaggttaagttttacgtttaacgttggttaccgttcgttacgttaagttaccggtacggtccgggtttaacggtaggttaaccgggtaccggggtaaccggggtaccggggtttacggggttaccggggaccgggggttaacgggtaacccgggtacgggttaccgggttaccccgttaccgggtacgggttacccgtaccggacccggtaaccgggtcccgttacccccggtccccggttaacccgttcccggtaacccgtttcccgttaacccggtttccccccgttacccccgg

SEQ ID NO: 252395 - DNA, 757 bp, Homo sapiens
  misc_feature: GYAE6OF01CLTEP.49.35.D02.1.454.CMB.1.raw
  modified_base (713)..(713): a, c, t, g, unknown or other
  misc_feature (713)..(713): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacgacgggtcctgggcccaggtctcgccctgactcagcctgcctcgtgtcgtgggtcctccgtggaccagtcgatccaccatcctccgtgctacgtcgaaaccacagtcgtaacgttggtaacttatactttctacgtccttccgtaggtaaccctaacaacctaccccggacaaaaccgtaccccaaactctagtacgattcgtttacggaacggttccgaggtcggaacgtccggtccggcgttacggggttcctacgtactccgtcttccgtccggtctaccgtaacgtccgtaggtaccgacgtccggaaccgtcccgtcccgttaaggccctacgttccgttcggtcggtacccttacggcggtacgtaggacggacgtcggacttagtattactacgtacggctagtcctaactataaaccgtaactaaacgtaacttaaaacccggttgttacgggggtttacgttacccggggacgggtacccgtaaacctacgggtaccgttaacccgtaccgttaaccggcctaaccggtaccggaaccggtcccgtaccccggttaaccccggtnttaccccgaccgttttacccgttccggttccccccttaccccgg

SEQ ID NO: 252396 - DNA, 877 bp, Homo sapiens
  misc_feature: GYAE6OF01EJJCF.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcaccatctcctgacactaggaacccacaatgtacgttggtacttatattctgtctctcgtaaccaacaacgtaccccgacaaaccgtaccccaaatcatgtacttctttaggaggtacaggtcgacgtccggcccggtacggttacggggtttctacgtacgttccgtccgtttccgtccggtacctacccgtaacgttccgtacgggacacggtacccgtaacccggtccccttaccccgtaccggtaaccccttaacgtttcccttacccgggttccgggtacccgttacccggtaaccgggtaccggttacgggtaaacccggggtaaccgggtacgggttaccgtttaaggtttaaacttttaacgtttaaccgttcggaaccgtacgttccttaacgtaacttaaaccgttaaaccaaaaaccttaaacgttaaaaccgttaccggggtttacggggtttaaccgggttaccgggggaacccggggtaacccgggtaaaacccgtaaaccggttaccggtaaacccccggttaccggttaacccggtaaccgtaaccccgggtaacccggtaaccggttccccgtaacccccggtacccccccgttacgggttaaccccgtacccgttaccccggtttccccggtttcccccccgttacccccccg

SEQ ID NO: 252397 - DNA, 524 bp, Homo sapiens
  misc_feature: GYAE6OF02F9SA4.49.35.D02.1.454.CMB.1.raw
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttggtgttcggcggcggaaccaactgaccgtcctacgtcagcccaaggcctgccccctcggtccactctcgttcctacccc

SEQ ID NO: 252398 - DNA, 521 bp, Homo sapiens
  misc_feature: GYAE6OF02H5HNJ.49.35.D02.1.454.CMB.1.raw
  modified_base (299)..(299): a, c, t, g, unknown or other
  misc_feature (299)..(299): n is a, c, g, or t
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgancttttgaggttcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcggaccaactgaccgtcctacgtcagcccaaggctgcccctggtccactctgtccctaccc

SEQ ID NO: 252399 - DNA, 524 bp, Homo sapiens
  misc_feature: GYAE6OF02H3YA9.49.35.D02.1.454.CMB.1.raw
tcagagtcgagagacacgaccggtgctcgatttagcacacgatagttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggttcagtgatcggcccgcaggggtttctcgatcgcttctccggctccaagtctggcagcacggcctccctgaccatctctgggctccaggctgaggacgaggctgattattactgcagctcatatacaaacataaacacttgggtgttcggcggcggaccaaactgaccgtcctacgtcagcccaaggcctgcccctggtccactctcgttccctaccc

SEQ ID NO: 252400 - DNA, 522 bp, Homo sapiens
  misc_feature: GYAE6OF02JE27F.49.35.D02.1.454.CMB.1.raw
tcagagtcgagagacacgaccggtgctcgatttagcacacgatagttgggtttgggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcaggggtttctcatcgcttctccggctccaagtctggcagcacggcctccctgaccatctctgggctccaggctgaggcgaggctgattattactgcagctcatatacaaacataaacactttgggtgtttcggcggcggaccaaactgacctctacgtcagccaaggctgaccccctcggtccactctacgtcccgtccc

SEQ ID NO: 252401 - DNA, 525 bp, Homo sapiens
  misc_feature: GYAE6OF02GEZAR.49.35.D02.1.454.CMB.1.raw
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcaggggtttctcatcgcttctccggctccaagtctggcagcacggcctccctgaccatctctgggctccaggctgaggacgaggctgattattactgcagctcatatacaaacataaacacttgggtgttcggcggcggaccaacgtgaccgtcctacgtcacgcccaaggcctcgcccctcggtccactctcgtccctacccc

SEQ ID NO: 252402 - DNA, 662 bp, Homo sapiens
  misc_feature: GYAE6OF02F1N2O.49.35.D02.1.454.CMB.1.raw
tcagagtcgagagacacgaccggtgctcgatttagcacacgatagttggggtttggggggggtctcaggacggcagcggctctcgggacgtctccgaccatggccgtcgggctctgctattccgtcaccctcctcactcagggcacacgggtcctgggcccagtctgccctgacctcagccctgcctccgtgtcctcgggtctcctggacagtcgatcgaccatctcctgccactggaacccacgaagtgacgttggacttataattctgtctctggtacacaatacccgcaagccccaaactacatgatctttgaggtcagtgatcggccgcagggtttctcatcgcttctaccggcgtccaagtctggcagcacgctcctgaccatcgtctggctccaggtctggacggacgacggctgattacttacgtgcacgctacgtattagtaactaaactaacttaaacctaacgtttacgggttacgttacgggtacggtaccgggtaaaccctaaaccgttccggtaacccggttcccgtaaccgggttcccgaaaccgggtaccccgtaaacggggtacccggttaacccgggtacccccccgttaccggggttaccctacccggtttacccgttaccggtttaccccccgtaaccccccg

SEQ ID NO: 252403 - DNA, 561 bp, Homo sapiens
  misc_feature: GYAE6OF02HGMV4.49.35.D02.1.454.CMB.1.raw
  modified_base (424)..(424): a, c, t, g, unknown or other
  misc_feature (424)..(424): n is a, c, g, or t
tcagagtcgagagacacgaccggtgctcgatttagcacacgatagttgggtttgggggggtcgtcaggaggcagcgctcgtcgggacgtctccaccatggcctgggcctctgctacttcctcaccctcctcactcagggcacagggtcctgggcccagtctgccctgactcagcctgccctccgtgtctgggtctcctggacagtcgatcaccatctcctgcactggaaccaccaatgacgttggaacttataattctgtctctgtaccaacaatacccggcaaagtcccaaactcatgatctttgaggtacagtgatcggccgcaggggttctcatcgcttctcggtctccaagtctggcagcaacggcctccctgaccagtctctgggctccgaggctggagacgagctgattagtactgtngctcataataacaaactaataaacgtacgttgggttagttcggcggtacgggaaccaaagtcgaccgtcgtaccggtcacggtcccgaaaggcctaccgccccgtcgggtaccaccgttccttcgtacccctacccc

SEQ ID NO: 252404 - DNA, 537 bp, Homo sapiens
  misc_feature: GYAE6OF02J1WAH.49.35.D02.1.454.CMB.1.raw
  modified_base (441)..(441): a, c, t, g, unknown or other
  misc_feature (441)..(441): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaagtccccaaactcatgatctttgaggtcagtgatcggcccgcaggggtttctcatcgcttctccggctccaagtctggcagcacggcctccctgaccatctctgggctccaggctgaggacgaggctgattatactgcagctcatatacaaacataaacncgttggtgttcgcggtacggaccaactgacccgtctacggtcacgacccgaagcctcgaccccctcggtaccaccgttcctaccgttcccgtcccc

SEQ ID NO: 252405 - DNA, 527 bp, Homo sapiens
  misc_feature: GYAE6OF02HOLQK.49.35.D02.1.454.CMB.1.raw
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggctccctgaccatctctgggctccaggctgaggacgaggctgattattactgcagctcatatacaaacataaacacttgggtagttcggcggcggaaccaacgtgaccgtcctacgtcacgcccaaggcctgcccctcggtccactctcgttccctacccg

SEQ ID NO: 252406 - DNA, 526 bp, Homo sapiens
  misc_feature: GYAE6OF02G5DSE.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatataacaaacataaacacttgggtgttcgggcggcgggaccaacgtgaccgtctacgtcagcccaaggctgtcccctggtccactctcgtccctaccc

SEQ ID NO: 252407 - DNA, 526 bp, Homo sapiens
  misc_feature: GYAE6OF02GPTE1.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcggaaccaactgaccgtcctacgtcacgcccaaggcctcgcccctcggtccactctcgtccctaccc

SEQ ID NO: 252408 - DNA, 523 bp, Homo sapiens
  misc_feature: GYAE6OF02IUQ6L.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccagctgaggacgaggctgattatactgcagctcatatacaaacataaacacttgggtgttcggcggcgggaaccaactgaccgtcctacgtcacgcccaaggctagcccctcggtcactctcgtccctaccc

SEQ ID NO: 252409 - DNA, 547 bp, Homo sapiens
  misc_feature: GYAE6OF02H600L.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaaatgacgttggtacttataattctgtctcctggtaccaacaataccccggcaaagtcccaaactcatgatctttgaggtcagtgatcggcccgcaggggtttctcatcgcttctccggctccaagtctggcagcacggcctccctgaccatctctggctccaggctgaggacgaggctgattattactgcagctcatataacaaacaataaacactttgggtgtttcgggcggcggaacccaaacgtcgaccgttccgtacgtccaacgcccaaggtcctcgccccctcggtcctacgtcttccgttcccctacccc

SEQ ID NO: 252410 - DNA, 513 bp, Homo sapiens
  misc_feature: GYAE6OF02F1Q5C.49.35.D02.1.454.CMB.1.raw
  modified_base (446)..(446): a, c, t, g, unknown or other
  misc_feature (446)..(446): n is a, c, g, or t
tcagagtcgagagacacgaccggtgctcgatttagcacacgatagttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctcctgaccatctctgggctcaggctgaggacaggctgattattactgcagctcatatacaaacataaacacttgggtnttcggcgcggaccaactgaccgtctacgtcagcccaaggctgcccctggtccactctgtccctaccc

SEQ ID NO: 252411 - DNA, 522 bp, Homo sapiens
  misc_feature: GYAE6OF02G0KS2.49.35.D02.1.454.CMB.1.raw
  modified_base (468)..(468): a, c, t, g, unknown or other
  misc_feature (468)..(468): n is a, c, g, or t
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcggaccaacngaccgtcctacgtcacgcccaaggcctcgcccctggccactctgtcccctaccc

SEQ ID NO: 252412 - DNA, 505 bp, Homo sapiens
  misc_feature: GYAE6OF02HSLZP.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggcaaagcccccaaactcatcatttatgaggccgatcagcgccctcaggggtctctgatcgcttctctggctcacgtctggcagcacggctccctgacaatctctgggctccagctggggacaggctgattattattgctgttcatatgcggtgatagtgccgaagggtgtcggcggagggaccaaggtgaccgtcctaggtcagcccaaggctgcccctggtcactcg

SEQ ID NO: 252413 - DNA, 535 bp, Homo sapiens
  misc_feature: GYAE6OF02H1A0E.49.35.D02.1.454.CMB.1.raw
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgagtcagtgatcggccgctagggtttctcgatcgcttctccggctccagtctgcagcacggcctccctgaccatctctgggctccaggctgaggacgagctgatttatttctgcagctcatatgcaggcagcaactaattttgagattagttcgggacgggtaacgggaccaaaggcctcggacccgttaccgtaggtcacggaccccaagggccttccggcccccttccgg

SEQ ID NO: 252414 - DNA, 523 bp, Homo sapiens
  misc_feature: GYAE6OF02FH7YP.49.35.D02.1.454.CMB.1.raw
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgagtcagtgatcggccgcaggggtttctcatcgcttctccggctccaagtctggcagcacggcctccctgaccatctctgggctccaggctgaggacgaggctgattattactgcagctcatatacaaacataaacacttgggtgttcggcgtcgggaccaaactgaccgtctacgtcagcccaaggctagccccctcggtccactctgttccctacccc

SEQ ID NO: 252415 - DNA, 538 bp, Homo sapiens
  misc_feature: GYAE6OF02I9HIY.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcaggggtttctcatcgcttctccggctccaagtctggcagcacggcctccctgaccatcctcgtgggctccaggctgaggacgaggctgattattactgcagctcatataacaaacaataaacacttgggtcgttcggcggcggaaccaacgtcgaccgtcctacgtcacgacccaaggcctcgccccgtcgtccactcttcgtccctacccc

SEQ ID NO: 252416 - DNA, 513 bp, Homo sapiens
  misc_feature: GYAE6OF02I3W7V.49.35.D02.1.454.CMB.1.raw
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctagtccttaatatagacaaactatgcacagacattccacgacagagtcacccttatccgacggaacaaatccaacgaacacagcctacatgaactgcgcagcctaggactctgccgacacggccgtatattctgtnacgagagagnttcgtctttcattgattagtactaggtctatatcg

SEQ ID NO: 252417 - DNA, 533 bp, Homo sapiens
  misc_feature: GYAE6OF02HVRYF.49.35.D02.1.454.CMB.1.raw
  modified_base (425)..(425): a, c, t, g, unknown or other
  misc_feature (425)..(425): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtcccaaactcatgatctttgaggtcagtgatcggcccgcaggggtttctcatcgcttctccggctccaagtctggcagcacggcctccctgaccatctctgggctcaggctgaggacgaggctgattattactgcagctnatataacaaacaataaacacttgggtgttcggcggcggaccaaacgtgaccgtctacgtcacgcccaaggcctcgccccctcggtccactcctcgttcccctaccccg

SEQ ID NO: 252418 - DNA, 178 bp, Homo sapiens
  misc_feature: GYAE6OF02JFNC7.49.35.D02.1.454.CMB.1.raw
  modified_base (174)..(178): a, c, t, g, unknown or other
  misc_feature (174)..(178): n is a, c, g, or t
tcagagtcgagagacacgaccggtgctcgatttagcacacgatagttgggtttgggggaagaggaagactgaccggtcccccaggagttcaggtgctgggcacagcggccctgggctgcctggtcaaggactacttcctctctcgactctgagcgggctggcaaggcgcatagnnnnn

SEQ ID NO: 252419 - DNA, 523 bp, Homo sapiens
  misc_feature: GYAE6OF02JF4H8.49.35.D02.1.454.CMB.1.raw
  modified_base (508)..(508): a, c, t, g, unknown or other
  misc_feature (508)..(508): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaatacccggcaaagtccccaaactcatgatcttgaggtcagtgatcggcccgcagggttctcatcgctctccggctccaagtctggcagcacggcctccctgaccatctctcgggctccgagctgaggacgaggctgattatactgcagctcataatacaaacataaactacgttagggtcgttcgggacggcgggaaccaaacgtcgaccgtctacgtcagccaaggctacgccctgcnctctcgtcccgtccc

SEQ ID NO: 252420 - DNA, 525 bp, Homo sapiens
  misc_feature: GYAE6OF02FQQWO.49.35.D02.1.454.CMB.1.raw
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttagggtgttcggcggcgggaccaaactgaccgtctacgtcagcccaaggcctgcccctcggtccactctcgttcccacccc

SEQ ID NO: 252421 - DNA, 524 bp, Homo sapiens
  misc_feature: GYAE6OF02INFOB.49.35.D02.1.454.CMB.1.raw
  modified_base (325)..(325): a, c, t, g, unknown or other
  misc_feature (325)..(325): n is a, c, g, or t
  modified_base (435)..(435): a, c, t, g, unknown or other
  misc_feature (435)..(435): n is a, c, g, or t
  modified_base (509)..(509): a, c, t, g, unknown or other
  misc_feature (509)..(509): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaaccaccaatgacgttggtacttataattctgtctcctggtaccaacaataccccggcaaacgtccccaaaactcatgatctttgaggtcagtgatcggccgnagggtttctcatcgcttctccggctccaagtctggcagcacggcctcctgaccatctctgggctccgagctgaggacgaggctgattattactgcagctcatatacaaanaataaacacttgggtgttcggcgggacggaccaacgtcgaccgtctacgtcacgccaagctcgcccctggtccnctctcgtccctaccc

SEQ ID NO: 252422 - DNA, 527 bp, Homo sapiens
  misc_feature: GYAE6OF02HJASA.49.35.D02.1.454.CMB.1.raw
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttggtgttcggcggcggaaccaaactgaccgtctacgtcacgtcccaaggctacgcccctcggtccacgtctcgtccctacccc

SEQ ID NO: 252423 - DNA, 530 bp, Homo sapiens
  misc_feature: GYAE6OF02IRQ9J.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatataacaaacataaacacttgggtgttcggcggcggaacaacgtgaccgtcctacgtcacgcccaaggcctcgccccgtcggtccactcctcgtcccctaccc

SEQ ID NO: 252424 - DNA, 531 bp, Homo sapiens
  misc_feature: GYAE6OF02IND8A.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccgaggctgaggacgaggctgattattactgcagctcatataacaaacataaactacgttgggtgttcggcggcggaaccaacgtcgaccgtctaagtcacgcccaagctcgccccgtcggtccactctcgtccctaccc

SEQ ID NO: 252425 - DNA, 629 bp, Homo sapiens
  misc_feature: GYAE6OF02J0B6D.49.35.D02.1.454.CMB.1.raw
  modified_base (319)..(319): a, c, t, g, unknown or other
  misc_feature (319)..(319): n is a, c, g, or t
tcagagtcgagagacacgaccggtgctcgatttagcacacgatagttgggtttgggggggtcgtcaggaggcagcgctctcgggacgtctccaccatggcctgggctctgctattcctcaccctcctcactcagggcacagggcctgggcccagtctgccctgactcagcctgcctccgtgtctgggtctcctggacagtcgatcaccatctcctgcactggaaccacaatgacgttgtacttatattctgtctctgtacaacactacccggacaacgtcccaaactcatgattcttgacggtcagtgactcggcccgngtacggggtttctcactcgtacttcgtcccggcttaccgaacgttctcggcacgcaccggccctccctgaccctatcctcgtcgggcctccgacggtcctcggacgggaccgtaggtccgtagtacttaacttcgtcgaccagtcctacaagtactaacaaactattaaaccgtcgtttagggttacgttaccgggacgggaccggaacctaaaccgtcgtacccgtacttaccgtaccgaacggtcccgaaggtccctaccggtcccccgttacggtacctaccgtccgtttaccgttccccgtacccc

SEQ ID NO: 252426 - DNA, 514 bp, Homo sapiens
  misc_feature: GYAE6OF02FT7YE.49.35.D02.1.454.CMB.1.raw
  modified_base (449)..(449): a, c, t, g, unknown or other
  misc_feature (449)..(449): n is a, c, g, or t
tcagagtcgagagacacgaccggtgctcgatttagcacacgatagttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtnttcggcgcggaccaactgaccgtctacgtcagcccaaggctgcccctggcactctcgtcccaccc

SEQ ID NO: 252427 - DNA, 538 bp, Homo sapiens
  misc_feature: GYAE6OF02I59HY.49.35.D02.1.454.CMB.1.raw
  modified_base (448)..(448): a, c, t, g, unknown or other
  misc_feature (448)..(448): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatcttgaggtcagtgatcggcccgcaggggtttctcatcgcttctccggctccaagtctggcagcacggcctccctgaccatctctgggctccaggctgacggacgagggctggattacgttactgcagctcatataacaaacataaacncgttagggtgttcgggcggccggtaacaactgacctcctacgtcacgcccgaagtcctcgcccctcggtccactccttgttcccgtcccc

SEQ ID NO: 252428 - DNA, 536 bp, Homo sapiens
  misc_feature: GYAE6OF02IGEN4.49.35.D02.1.454.CMB.1.raw
  modified_base (451)..(451): a, c, t, g, unknown or other
  misc_feature (451)..(451): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttataattctgtctcctggtaccaacaataccccggcaaagtccccaaactcactgatctttgaggtcagtgatcggcccgcgaggggtttctcatcgcttctccggctccaagtctggcagcaccggcctccctgaccatctcgtgggcctccaggctgacggacgaggcgtgattattactgcagctcatataacaaacaataaacncgttggtgttcgcgggacggacaaccgtgaccgtctacgtcacgccgaagcctccgcccctcgtccactcgtccgttccctaccc

SEQ ID NO: 252429 - DNA, 538 bp, Homo sapiens
  misc_feature: GYAE6OF02H7BNQ.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctggacccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaactataaacacgttgggtgttacgggcggcgggaaccaagtcgacccgtcctacgtcacgcccgaagcctcgccccctcggtccacgtctcgtcccgtcccc

SEQ ID NO: 252430 - DNA, 736 bp, Homo sapiens
  misc_feature: GYAE6OF02HFFVO.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgccctcgtgtcgtggtctccgtggacagtcgatccaccatcctcctgcacgtacggaaccacaatcgtacgttgtacttatattctgtctccgtgtaccaacaactacccggacaaacgtaccccaaactcatagtattcttgaggtcagtgacgtccggcccgcgtacggggtttctcgtacgttccgtcctttccgtcccggtccttacccgtaacgttccgtcggcctacgccgaccggtcccctcccgtacggaaccctacttccgttcggtcgggtcccttccggacggtccgtacgggaacgggacgggacggtccgttaggtaacttttaacgttacgtcggtactacgtacctactaattaaactaaacctaaaactaaacttaaaccgtacgggtttacgggttacggttaccggggaccgggtaccgggaaaccgtaaaccggtccgtacccggttacccgtaccggtaccgaccggacccggtaacggtcccgtacccggtcccccgttacggtaccctacccgttccgttacccgttacccccttaccccg

SEQ ID NO: 252431 - DNA, 526 bp, Homo sapiens
  misc_feature: GYAE6OF02ISU5V.49.35.D02.1.454.CMB.1.raw
  modified_base (318)..(318): a, c, t, g, unknown or other
  misc_feature (318)..(318): n is a, c, g, or t
  modified_base (421)..(421): a, c, t, g, unknown or other
  misc_feature (421)..(421): n is a, c, g, or t
tcagagtcgagagacacgaccggtgctcgatttagcacacgatagttgggtttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggacttataattctgtctcctgtaccacaatacccggcaaagtcccaaactcatgatctttgagtcagtgatcggaccncaggggtttctcatcgctctccggctccaatctggcagcacggcctcctgaccatctctcggggctcccaggctgaggacgagctgagttattactgcagctnatatacaaacataaacacgttaggtgttcgcggtcgggaccaaacgtgaccgtcctacgcgagcccgaaagcgtacgcccctcggccactccgtcgtcccgtccc

SEQ ID NO: 252432 - DNA, 521 bp, Homo sapiens
  misc_feature: GYAE6OF02HBXZY.49.35.D02.1.454.CMB.1.raw
  modified_base (508)..(508): a, c, t, g, unknown or other
  misc_feature (508)..(508): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcagggttctcatcgcttctccggctccaagtctggcagcacggcctccctgaccatctctgggctccgaggctgaggacgaggctgattattactgcagctcatatacaaacataaacattgggtgttcggcggacggaaccaactcgaccgtctacgtcacgccaagcctcgcccctcgtccnctctcgtccctcc

SEQ ID NO: 252433 - DNA, 528 bp, Homo sapiens
  misc_feature: GYAE6OF02IGGEK.49.35.D02.1.454.CMB.1.raw
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgatttattactgcagctcatataacaaacataaacattggtgttcggcggcggaaccaacgtcgaccgtcctacgtcagcccaaggcctcgcccctcggtccactctcgttcccacccc

SEQ ID NO: 252434 - DNA, 524 bp, Homo sapiens
  misc_feature: GYAE6OF02FZ98K.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatcttgaggtcagtgatcggcccgcaggggtttctcatcgcttctccggctccaagtctggcagcacggcctccctgaccatctctcgggctccaggctggaggacgaggctgattattactgcagctcatatacaaacataaacacgttgggtgttcggcggcggaccaactgaccgtctacgtcagcccaaggcctgcccctcggtccactctcgttccctccc

SEQ ID NO: 252435 - DNA, 513 bp, Homo sapiens
  misc_feature: GYAE6OF02JFDNG.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttggagtggggtgggaaggatcacccctatccttaatatagcaaactatgcacagacattccacgacagagtcacccttatcgcgacaaatccacgaacacagcctacatggaactgcgcagcctaggactctgccgacacggccgtatatttctgtgcgagagagtatcgttctttctagtgattagtacttagtctagttatcg

SEQ ID NO: 252436 - DNA, 513 bp, Homo sapiens
  misc_feature: GYAE6OF02FPGEP.49.35.D02.1.454.CMB.1.raw
  modified_base (419)..(419): a, c, t, g, unknown or other
  misc_feature (419)..(419): n is a, c, g, or t
  modified_base (450)..(450): a, c, t, g, unknown or other
  misc_feature (450)..(450): n is a, c, g, or t
tcagagtcgagagacacgaccggtgctcgatttagcacacgatagttgggtttgggggggtctcatgaggcagcgctctcgggacgtctccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcgtcagtaagcggcctcagggtccctgatcgcttctctggctccaagtctggcaacacggcctccctgaccgtctcgtgggctccgggctgaagatgaggtctgatttatttcngcagctcatatgcaggcagcaactaatttgngtatattcggcggagggaccaagctggaccgtcgtacggtcacgcccaaggcctcgtcccccg

SEQ ID NO: 252437 - DNA, 553 bp, Homo sapiens
  misc_feature: GYAE6OF02H7WSQ.49.35.D02.1.454.CMB.1.raw
  modified_base (332)..(332): a, c, t, g, unknown or other
  misc_feature (332)..(332): n is a, c, g, or t
  modified_base (419)..(419): a, c, t, g, unknown or other
  misc_feature (419)..(419): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaaatcatgatctttgagtcagtgatcgccgctagggttcncatcgcttctccggctccaagtctggcagcacggcctcctgacccatctctgggctccgaggctagaggacgaggctgattattacngcagctcatacaacaaactaataacacgttgggtagttcgggcggacggaaccaaacgtcgaccgttccgtacgtcaccgaccgtaacgccgtccgccccgtacggtcctaccgttctcccgttccctaccccg

SEQ ID NO: 252438 - DNA, 555 bp, Homo sapiens
  misc_feature: GYAE6OF02J07KH.49.35.D02.1.454.CMB.1.raw
tcagagtcgagagacacgaccggtgctcgatttagcacacgatagttgggtttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatcttgagtcagtgatcggccgcaggggtttctcatcgcttctccggctcaagtctgcagcacggcctccctgaccatctctcgggctccagctgaggcgagctgattattactgcagctacatataacaaacataaacacgttgggtacgttcgggccggtacgggaccctaaacgtcggacccgtcgtaacgtccacggtacccaaggtcctcgaccccctcggtacccactccgttccgttacccgtcccccg

SEQ ID NO: 252439 - DNA, 533 bp, Homo sapiens
  misc_feature: GYAE6OF02HP9HD.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcaggggtttctcatcgcttctccggctccaagtctggcagcacggcctccctgaccatctctgggctccgaggctgaggacgaggctgattatactgcagctacatataacaaactaataaacacgttgggtgttcggcggacggaaccaacgtgaccgttctacgtcacgaccgaagtctcgcccctcggtccactctcgtccctaccc

SEQ ID NO: 252440 - DNA, 528 bp, Homo sapiens
  misc_feature: GYAE6OF02JFG92.49.35.D02.1.454.CMB.1.raw
  modified_base (282)..(282): a, c, t, g, unknown or other
  misc_feature (282)..(282): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccccggnaaacgtccccaaactcatgatctttgaggtcagtgatcggcccgcaggggtttctcatcgcttctccggctccaagtctggcagcacggcctcctgaccatctcgtgggctccaggctggagacgagctgattattactgcacgctcatacaacaaacataaacacgttgggtcgttcggcggacggaccaagtcgaccgtctacgtcacgccaaggctcgcccctggcacgtctcgtccctaccc

SEQ ID NO: 252441 - DNA, 521 bp, Homo sapiens
  misc_feature: GYAE6OF02G0KFO.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctggctccaggctgaggacgaggctgattattactgcagctcatatacaaacataaacacttggtgttcggcggcggacaacgtgaccgtctacgtcagcccaaggcctgcccctcggtccactctcgttccctaccc

SEQ ID NO: 252442 - DNA, 594 bp, Homo sapiens
  misc_feature: GYAE6OF02JXO5P.49.35.D02.1.454.CMB.1.raw
  modified_base (322)..(322): a, c, t, g, unknown or other
  misc_feature (322)..(322): n is a, c, g, or t
  modified_base (434)..(434): a, c, t, g, unknown or other
  misc_feature (434)..(434): n is a, c, g, or t
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaagtccccaaactcatgatcttgagtcagtgatcggcccgnaggggtttctcatcgcttctcggctccaagtctgcagcacgcctccctgaccatctcgtacgggctccgaggctggacggacgaggcttgaacttattacgttgcagcctanatacgtaacaaactaataaacacgttcgggttacgttcgggcggaccgggaaccaaacgtcgacccgttccgttaacggtccaacggtccctaaacgggtcctccggaccccccgttcggtacccgtaccgttccgttacccgttacccccttacccccg

SEQ ID NO: 252443 - DNA, 530 bp, Homo sapiens
  misc_feature: GYAE6OF02IR9PM.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggacggaccaacgtcgaccgtcctacgtcacgccaacggctcgccccgtcggtccactctcgtccctacccc

SEQ ID NO: 252444 - DNA, 594 bp, Homo sapiens
  misc_feature: GYAE6OF02JVT55.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaataccccggcaaacgtccccaaactcatgatcttgagtcagtgatcggccgcaggggtttctcatcgcttctccggctccagtctgcagcacggcctcctgaccatctcgtcgggctccgaggctggaggacgaggtctgattactacgtgcagtctacatactaacaaactaataaacgtacgtttgggtacgtttccgggacggtacggaacctaaacgtcgacccgtaccgtaacggtccgtaacgacccgtaaacggtcctaccggtaccccccgttcgggtaccctaaccgtcccgttacccggttccccctacccccg

SEQ ID NO: 252445 - DNA, 530 bp, Homo sapiens
  misc_feature: GYAE6OF02FQIRG.49.35.D02.1.454.CMB.1.raw
  modified_base (395)..(395): a, c, t, g, unknown or other
  misc_feature (395)..(395): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtcccccaaactcatgatctttgaggtcagtgatcggcccgcaggggtttctcatcgcttctccggctccaagtctggcagcacggcctccctgaccatctctgggctccnggctgaggacgaggctgattattactgcagctcatatacaaacataaacagttggtgttcggcggcggacaacgtgaccgtctacgtcacgcccaaggcctcgccccctcggtccacctcttccgtcccgtcccc

SEQ ID NO: 252446 - DNA, 544 bp, Homo sapiens
  misc_feature: GYAE6OF02HJO7Z.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatccggcccgcaggggtttctcatcgcttctccggctccaagtctggcagcacggcctccctgaccatctcgtcgggctccgaggctggaggacgaggctgattatactgcagctcatactaacaaactaataaacacgttagggtgttcggcgggacggaacctaacgtcgaccgtacctacgtcacgcccaaggctcgcccctcggcctactctcgttccctacccc

SEQ ID NO: 252447 - DNA, 529 bp, Homo sapiens
  misc_feature: GYAE6OF02HI6GH.49.35.D02.1.454.CMB.1.raw
  modified_base (399)..(399): a, c, t, g, unknown or other
  misc_feature (399)..(399): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaaatgacgttggtacttataattctgtctcctggtaccaacaataccccggcaaacgtccccaaactcatgatctttgaggtcagtgatccggcccgcgaggggtttctcatcgcttctccggctccaagtctggcagcacggcctccctgaccatctctgggctccgngctgaggacgaggctgatttatacttgcagctcaatataacaaacaataaacacgttgggtcgttcggcggacggaccaacgtgaccgtctacgcagcccaagcctcgccctcgcactctcgtccctccc

SEQ ID NO: 252448 - DNA, 572 bp, Homo sapiens
  misc_feature: GYAE6OF02G2EDH.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctctactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcaggggtttctcatcgcttctccggctccaagtctggcagcacggcctccctgaccatctctgggctccgaggctgaggacgaggctgattattacgtgcagctcatactaacaaactaataaaactacgttagggtacgttcgggccgggaccgggaaccaaacgtcgacccgttcctacggtccaccgtacccagtcggtacctccgtcccccgtcggtcccgacttccgttccgttccccccg

SEQ ID NO: 252449 - DNA, 576 bp, Homo sapiens
  misc_feature: GYAE6OF02IVYU4.49.35.D02.1.454.CMB.1.raw
tcagagtcgagagacacgaccggtgctcgatttagcacacgatagttggggtttgggggggtctcaggaggcagcgctctcgggacggtctccaccatggcctgggcgtctgctattcctccaccctcctcactcagggcacagggtcctgggcccagtctgccctgactcagcctgcctccgtgtctgggtctcctggacagtcgatcaccatctcctgcactggaccacaatgacgttgtactataattctgtctcctggtacaacaataccccggcaaatccccaaactcatgatctttgaggtcagtggaatccggcccgcaggggtttcgtcatcgcttctccggctccaagtctggcagcacggcctccctgaccatctctgggcctcaggctgagggacgaggctgattattactgtcgacgctccataattaacgaaaactaactaaacgtaacttggggtgttcggccgggacgggaaccaaacgtgacccgtcgtaccgtccgaagtaccccgaacgaccgtcgccccccgttgggtacctaccctcgtttccgttaccccacccc

SEQ ID NO: 252450 - DNA, 563 bp, Homo sapiens
  misc_feature: GYAE6OF02GTLIF.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctgtaccaacaataccccggcaaagtccccaaactcatgatcttgaggtcagtgatcggccgcgagggtttctcatcgcttctccggctcaagtctggcagcacggcctccctgaccatctctgggctccgaggctgaggacgaggctgtattattactgcagctcatataacaaactaataaactacgttgggtacgttcgggacgggacggaaccgaaacgtcggacccgttccgtacggtcaacgacccgaaggtccgtccgcccccgttcggtaccaccgtcgttccgttcccctacccc

SEQ ID NO: 252451 - DNA, 543 bp, Homo sapiens
  misc_feature: GYAE6OF02GQZEG.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctcccgtgaccatcctcgtgggcctccaggctgaggacgaggctgattattactgcagctcatatacaaacataaacacgttgggtcttcggcggacggaaccaacgtgaccgtcctacgtcacgtcccgaagccgtcgtccccctcggtcctacctcttccgttcccgtcccc

SEQ ID NO: 252452 - DNA, 518 bp, Homo sapiens
  misc_feature: GYAE6OF02GKDG0.49.35.D02.1.454.CMB.1.raw
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaataccccggcaaagtccccaaactcatgatctttgaggtcagtgatcggccgcagggtttctcatcgcttctccggctccagtctgcagcacggcctcctgaccatcctcgtgggcctccgaggctggaggacgaggctgattattactgcagctcatanacaaanataacattgggtnttcggcggcggaacaactgaccgtccagtcagcccaagctccgccccgtcggcactctcgtccctaccc

SEQ ID NO: 252453 - DNA, 546 bp, Homo sapiens
  misc_feature: GYAE6OF02GXMD4.49.35.D02.1.454.CMB.1.raw
  modified_base (335)..(335): a, c, t, g, unknown or other
  misc_feature (335)..(335): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaataccccggacaaacgtccccaaactcatgatctttgaggtcagtgactcggccgcagggtttcncatcgcttctccgctccagtctggcagcacggcctccctgaccatcctctcgggctccgaggctgaggacgagctgtattattactgcagcctcatactaacaaactaataaactacgtttgggtcgttcgggcggacgggaaccaacgtgaccgttccacgtcacgcccaaggcctcgccccgtcggtcaccgtctccgttcccgtcccc

SEQ ID NO: 252454 - DNA, 538 bp, Homo sapiens
  misc_feature: GYAE6OF02F63XZ.49.35.D02.1.454.CMB.1.raw
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (419)..(419): a, c, t, g, unknown or other
  misc_feature (419)..(419): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacataccccggcaaacgtccccaaactcatgatctttgaggtcagtgatcggccgcagggtttctcatcgcttcnccggctccagtctggcngcacgcctcctgccatctctgggcctccgaggctggacggacgaggcctagattattacngcagctcatactacaaacataaacacgtttgggtcgtttcgggcggacgggaaccaacgtcgtacccgtctacgtcacgcccaaggcctcgcccctcgtccactcctcgtcccctaccc

SEQ ID NO: 252455 - DNA, 532 bp, Homo sapiens
  misc_feature: GYAE6OF02JPR64.49.35.D02.1.454.CMB.1.raw
  modified_base (446)..(446): a, c, t, g, unknown or other
  misc_feature (446)..(446): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatcttgaggtcagtgatcggcccgcaggggtttctcatcgcttctccggctccaagtctggcagcacggcctccctgaccatctctgggctccgaggctggaggacgaggctgtattattactgcagctcatatacaaacataaacncgttggtgttcggcgggacggaaccaacgtcgaccgtcctacgcacgcccaaggcctcgcccctggtccactcgtctcccctaccc

SEQ ID NO: 252456 - DNA, 536 bp, Homo sapiens
  misc_feature: GYAE6OF02GQLSH.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaaactcatgatctttgagtcagtgatcggccgcagggtttctcatcgcttctccggctccaagtctggcagcacggcctccctgaccatctctgggctccaggctgaggacgaggctgattattactgcagctacataataacaaacaataaacacgttgggtcgttcggcgggacgggaaccaacgtgaccgtctacgtcacgacccaaggcctcgcccctcggtccactctcgtcccctaccc

SEQ ID NO: 252457 - DNA, 529 bp, Homo sapiens
  misc_feature: GYAE6OF02F1SIT.49.35.D02.1.454.CMB.1.raw
  modified_base (426)..(426): a, c, t, g, unknown or other
  misc_feature (426)..(426): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcaggggtttctcatcgcttctccggctccaagtctggcagcacggcctccctgaccatctctgggctccaggctgaggacgaggctgattattactgcagctnatatacaaacataaacacttgggtgttcggcggcggaccaactgaccgtcctacgtcacgcccaaggctcgccccctcggtccacctctcgttccccgtcccc

SEQ ID NO: 252458 - DNA, 525 bp, Homo sapiens
  misc_feature: GYAE6OF02JIJRX.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcagggtttctcatcgcttctccggctccaagtctgacagcacggcctccctgaccatctctgggctcaggctgaggacgaggctgattattactgcagctcatatacaaacataaacacttgggtacgttcggcggcggaaccaacgtgaccgtcctacgtcacgccaacggctacgcccctggtccactctcgtccctaccc

SEQ ID NO: 252459 - DNA, 522 bp, Homo sapiens
  misc_feature: GYAE6OF02FV90T.49.35.D02.1.454.CMB.1.raw
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatcttgagtcagtgatcggccgcagggtttcncatcgcttcnccggctccagtctggcagcacggcctcctgaccatctctgggctccgaggctgaggacgaggctgattatactgcagctcatanacaaacataaacncttgggtgttcggcggacggaccaacgtgaccgtctacgtcacgcccaaggcctcgcccctcggtaccactctcgttcccgcccc

SEQ ID NO: 252460 - DNA, 537 bp, Homo sapiens
  misc_feature: GYAE6OF02G6YMI.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgagtcagtgatcggcccgcaggggtttctcatcgcttctccggctccaagtctggcagcacggcctccctgaccatctctgggctccaggctgaggacgaggctgattattactgcagctcatactaacaaacaataaacacgttgggtgttcgggcgggaccggaccgaaacctggacccgttcgacgtcacgcccaaggcctcgcccctggtccactctcgtccctacccg

SEQ ID NO: 252461 - DNA, 521 bp, Homo sapiens
  misc_feature: GYAE6OF02GZ6S2.49.35.D02.1.454.CMB.1.raw
  modified_base (387)..(387): a, c, t, g, unknown or other
  misc_feature (387)..(387): n is a, c, g, or t
  modified_base (496)..(496): a, c, t, g, unknown or other
  misc_feature (496)..(496): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagacaaactatgacacagacattccacgacagagtcaccttancgcgacaaatccaacgaacacacgcctaacatggaactgacgcacgcctagggactctacgccgacgaccggccttattactttctgttgcgagagagattgttctttntatgattagtactagtctattatcg

SEQ ID NO: 252462 - DNA, 534 bp, Homo sapiens
  misc_feature: GYAE6OF02IDYEC.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaaatgacgttggtacttataattctgtctcctggtaccaacaataccccggcaaagtccccaaaactcatgatctttgaggtcagtgatcggcccgcaggggtttctcatcgcttctccggctccaagtctggcagcacggcctccctgaccatctctgggctccgaggctgaggacgaggctgattattactgcagctcataataacaaacaataaacacgttgggtgttcggcggcggaccaaacgtgaccgtcctacgtcacgcccaagctcgcccctcggtccactctcgtccctacccc

SEQ ID NO: 252463 - DNA, 530 bp, Homo sapiens
  misc_feature: GYAE6OF02GVD7J.49.35.D02.1.454.CMB.1.raw
  modified_base (324)..(324): a, c, t, g, unknown or other
  misc_feature (324)..(324): n is a, c, g, or t
  modified_base (344)..(344): a, c, t, g, unknown or other
  misc_feature (344)..(344): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccctnaggggtttctcatcgcttcnccggctcaagtctggcagcacggcctccctgaccatctctgggctccagctgaggacgaggctgattattactgcagctcatatacaaacataaacacttgggtgttcggcggacggaccaaacgtcgaccgtcctacgtcacgcccaaggctcggcccctcggtccacgtctcgttccctacccc

SEQ ID NO: 252464 - DNA, 524 bp, Homo sapiens
  misc_feature: GYAE6OF02GQNN6.49.35.D02.1.454.CMB.1.raw
  modified_base (386)..(386): a, c, t, g, unknown or other
  misc_feature (386)..(386): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttancgacgacaaatccaacgaacacagcctacatcggaactgcgcacgcctaggactccgtacgccgaccgacggccgttactactttctgtgcgagagagagttgttctttctatgtaattagtactagtactattatcg

SEQ ID NO: 252465 - DNA, 655 bp, Homo sapiens
  misc_feature: GYAE6OF02I4FZX.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggacttatattctgtctctgtacaacactacccgacaacgtcccaaactcatgatctttgaggtcagtgactcggcccgcgtaggggtttctcatccgcttccgtccggctaccgtaacgtcgtcggaccagcaccggtcctccctacgaccactcctcgtcgggcctccgaggtctggacggaacgacggctaggtaactttacgttaacgcgtaccgtacgtcttacaaatttaacaaacctaaaactaacttaaaaacccgtggtttaacggggttcggttaccgggtccggggaacccgggtaaaccgtaaaccgtacgtacccgttaccgtaaccggttaccgaccgtaacccgaaggcccgttaccggcccccgttacggtcctacctccgttcccgttaccccgtacccc

SEQ ID NO: 252466 - DNA, 529 bp, Homo sapiens
  misc_feature: GYAE6OF02GS7JS.49.35.D02.1.454.CMB.1.raw
tcagagtcgagagacacgaccggtgctcgatttagcacacgatagttgggtttggggggggtctcaggaggcagcgctctcgggacatctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatataacaaacataaacacttgggtgttcggcggcgggaccaacgtcgaccgtcctacgtcacgcccaaggctcgcccctcgtccactccgtcgttcccccg

SEQ ID NO: 252467 - DNA, 526 bp, Homo sapiens
  misc_feature: GYAE6OF02HI3Y2.49.35.D02.1.454.CMB.1.raw
  modified_base (458)..(458): a, c, t, g, unknown or other
  misc_feature (458)..(458): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggnggcggaccaacgtgaccgtctacgtcacgcccgaagcctcgcccctcggtcactcgttcgtccctccc

SEQ ID NO: 252468 - DNA, 599 bp, Homo sapiens
  misc_feature: GYAE6OF02H5PXE.49.35.D02.1.454.CMB.1.raw
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgnaggggtttcncatcgcttctccggctccagtctggcagcacggcctccctgaccatctctgggctccaggctggaggacgaggctgatttatactgcagctacataactacaaactaataaacctacgtttgggtcgtttccgggaccgggacgggtaacccaacgttcgaccccggttcccttaacggtccaacggaccccgaaaggtcccttaccggccccccgttcgggttaccctaacccgttccgtttacccgttccccctaaccccccg

SEQ ID NO: 252469 - DNA, 536 bp, Homo sapiens
  misc_feature: GYAE6OF02HGVR4.49.35.D02.1.454.CMB.1.raw
  modified_base (394)..(394): a, c, t, g, unknown or other
  misc_feature (394)..(394): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctcgtggctccnggctgaggacgagtctgtattattactgcagctcatactaacaaacataaactacgttggtgttcggcggcggaaccaactgaccgtcctacgtcacgcccaaggctcgcccccgtcggtccactcctcgttccctaccccg

SEQ ID NO: 252470 - DNA, 575 bp, Homo sapiens
  misc_feature: GYAE6OF02I3HBN.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttataattctgtctcctggtacaacaataccccggcaaagtccccaaactcatgatctttgagtcagtgatcggcccgcaggggtttctcatcgcttctccggctccaagtctgcagcacggcctcctgaccatctctcggcctccaggctgacgacgaggctgattattactgcagctcatatacaaaccaataaactacgttacgggttgtttacgggcggtacgggaacccaaacgtcgacccgtcccgttaacggtccaacgacccgtaaacggccgttaccgccccccgttcggtacctaccgtcgttaccgttccccttacccccg

SEQ ID NO: 252471 - DNA, 603 bp, Homo sapiens
  misc_feature: GYAE6OF02GXF3M.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccaccaatgacgttggtacttataattctgtctcctggtaccaacaatacccggcaaacgtccccaaactcatgatcttgaggtcagtgatcggccgcgtagggttctcatcgcttctccggctccaagtctgcagcacggcctccctgaccatcctcgtcgggcctccgaggctagacggacgaggctgtagttattctgcagctacatactaacaaactaactaaactacgtttagggtacgttcgggacggaccgggaaccgtaaacgttcggacccgttaccgtaccggtaccgtaacgtaccccgtaaggtacccttccgtaccccccgttacgggtaccctacccgtcgttacccgttcccccgtaacccccg

SEQ ID NO: 252472 - DNA, 624 bp, Homo sapiens
  misc_feature: GYAE6OF02JJ50W.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatcttgagtcagtgatcggcccgctacggggtttctcgatcgcttctccggctccaagtctgctagcacggcctccctcgaccactcctcgtcgggtcctccgaggctcggacggacgaggctgtaattacttacgtgcagtctactatactaacaaacgtaataaacgtacgttgggtacgttccgggaccgggtaccgggaaacccgtaacgttacggtacccgttacccgttaaccggtaccgaacggaccccgtaaggtcccgttaccggtcccccgttacggccctaaccgttcccgtaccgttcccccttaacccccg

SEQ ID NO: 252473 - DNA, 590 bp, Homo sapiens
  misc_feature: GYAE6OF02I5XCH.49.35.D02.1.454.CMB.1.raw
  modified_base (250)..(250): a, c, t, g, unknown or other
  misc_feature (250)..(250): n is a, c, g, or t
  modified_base (279)..(279): a, c, t, g, unknown or other
  misc_feature (279)..(279): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
tcagagtcgagagacacgaccggtgctcgatttagcacacgataggttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggaccagtcgatcaccatctcctgcactggaaccaccaatgacgttggtacttanaattctgtctctggtacacaataccccgnaagtccccaaactcatgatctttgaggtcagtnatcgccgnagggttcnancgcttctcggctccagtctcggcacgcaccggcctccctgacccgattcctctacggggccttccagggcctgggacggaccggtacgggccttaggaattttacgttactcggtaccaggcctactaatataacaaacgtactaaacgacgtttgggtacgtttcgggccgacgggtaaccaacgtcgacccgtcgttacgtcaacgtccgacggctacgcccccgttcggtactacctcgttacccgtcccgtccccg

SEQ ID NO: 252474 - DNA, 557 bp, Homo sapiens
  misc_feature: GYAE6OF02F4A6K.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccgctccaagtctggcagcacggcctccctgacccatcctctcgggcctccgacggctggacggacgaggctgattattactgcagtctcataactaacaaacataaaccacgtttaggtcgttcgggcggcgggaaccaacgtcgtaccgtcctacgtcacgcccaacggcctcgcccccgtcggtcctactcctcgttacccctaccccg

SEQ ID NO: 252475 - DNA, 597 bp, Homo sapiens
  misc_feature: GYAE6OF02ISUUI.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctgggctgaggtgagaaagcctgggtcgtcggtgaaggtctcctgcaaggcttctggagacaccttcaacaactttgctgtcagctgggtgcgacgaggcccctggacaaggccttgagtgggtgggaaggatcacccctatccttaaatatagactaaactatcgacacagacattccagacagatcaccttatcgacgacaaactccaagaacaacacgacctacgaatggaaactgaccgcaacgcctaacggattccgtacggacccgaacgaccggtaccgttaatttacgtttcgtacggttacgacgtaacggtaagtaacggtaactttaggttacctttttacgtagttaggtaacgtttacggttaacctttaggtacctaatttacgttacgg

SEQ ID NO: 252476 - DNA, 629 bp, Homo sapiens
  misc_feature: GYAE6OF02I8UCR.49.35.D02.1.454.CMB.1.raw
  modified_base (199)..(199): a, c, t, g, unknown or other
  misc_feature (199)..(199): n is a, c, g, or t
  modified_base (421)..(421): a, c, t, g, unknown or other
  misc_feature (421)..(421): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtcctgccctgactcagcctgcctccgtgtctgggtctcctggacngtcgatcacatctcctgcactggaaccacaatgacgttgtacttatattctgtctctgtaccaacaactacccggacaaacgtccccaaactcatgtacttcgttgagtcgagtcgactccggccgcgtacgggttctcatcgcttctccggctccaagtctcgcacgcgaccggcctccctagacctactctcgtcggctccgacggcgtaggacggacgnggcgtagacttacttcgtcgacaggcctactatactaaacgaaaccaattaaacctacgttcgggtacggttaccgggaccgggaccgggtaaacctaaaccggttccgtaacccgttaccggtaccgtaccgaaccggacccgtaacggccctacccggtcccccgtcggtacccgtaccgtacgttacccggtaccccttaccccg

SEQ ID NO: 252477 - DNA, 544 bp, Homo sapiens
  misc_feature: GYAE6OF02H9H5H.49.35.D02.1.454.CMB.1.raw
  modified_base (407)..(407): a, c, t, g, unknown or other
  misc_feature (407)..(407): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgctaggggtttctcatcgcttctccggctccaagtctggcagcacggcctccctgaccatctctgggctccaggctgaggacgnggctgattattactgcagctcatatacaaacaataaactacgttgggttgttcggcggcgggaaccaaacgtcgaccgtcctacgtcgacgccgaaggcctcgccccgtcggtcctactccgttcgttccctacccc

SEQ ID NO: 252478 - DNA, 550 bp, Homo sapiens
  misc_feature: GYAE6OF02FNPOI.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcaggggtttctcatcgcttctccggctccaagtctggcagcacggcctccctgaccatcctcgtcgggcctccgaggctggaggacgaggctgattattactgcagctcatactaacaaacataaactacgttgggtacgttcggcggcggaaccaacgtcgaccgtcctacgtcaccgaccgaacgtcctccgtcccgtcgtcctacctcgttcccgtccctcccc

SEQ ID NO: 252479 - DNA, 555 bp, Homo sapiens
  misc_feature: GYAE6OF02HVRZ1.49.35.D02.1.454.CMB.1.raw
  modified_base (313)..(313): a, c, t, g, unknown or other
  misc_feature (313)..(313): n is a, c, g, or t
  modified_base (390)..(390): a, c, t, g, unknown or other
  misc_feature (390)..(390): n is a, c, g, or t
  modified_base (489)..(489): a, c, t, g, unknown or other
  misc_feature (489)..(489): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctgggctgaggtgagaaagcctgggtcgtcggtgaaggtctccgtgcaaggtcttctggagacaccttcaactaactttgctgtcagctgggtgcgacaggcccctggacaaggccttgngtggtggaaggatcaccctatccttaaatactagacaaactatgacacaagacattccacgacagagtcacccttancgcggaacaaactccaacgaacacaacgacctaacatacgaactcgcgacacgcctaaggctcgacgacccgaccacggaccgttaattacgtttccgngtcgacgagagagtaattcggttactttctaagttagattacggtaacttaggtctatttagtacg

SEQ ID NO: 252480 - DNA, 536 bp, Homo sapiens
  misc_feature: GYAE6OF02GUZP5.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgaggtgggtgggaggatcaccctatcctaatatagacaaactatgcacagacacttccaacgacagagtaccacccttatcgacggactaaatcccaacgaacacacgcctaacataggaactgacgacacgcctagactcgtacgccgacaccggccttattacttcgtgtgcgagagacgtattcgttctttactagtgtacgtacgttactagtctattagtcg

SEQ ID NO: 252481 - DNA, 577 bp, Homo sapiens
  misc_feature: GYAE6OF02G9QXX.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcgaggggtttctcatcgcttctccggctccaagtctggcagcacggcctccctgaccatctcgtgggcctccgaggctggacggacgaggctagtattatacgtgcagtctcatataacaaacaactaaactagttgggtcgttcgggaccgggcggaacctaacgtcgacccgttccgtacgtccgacgacccgaacggcccgtccgacccccgttccggtctacccgttccgttcgtaccccctaccccg

SEQ ID NO: 252482 - DNA, 510 bp, Homo sapiens
  misc_feature: GYAE6OF02HBDWO.49.35.D02.1.454.CMB.1.raw
  modified_base (465)..(465): a, c, t, g, unknown or other
  misc_feature (465)..(465): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcgacccctatccttaatatagcaaactatgcacagacattccacgacagagtcacccttatcgcggacaaatccaacgaacacagcctacatggaactgcgcagcctaggatctcgccgacacgggccgtatactttcngtgcgagagagattgtctttctatgatagtactagtacattatcg

SEQ ID NO: 252483 - DNA, 571 bp, Homo sapiens
  misc_feature: GYAE6OF02H849A.49.35.D02.1.454.CMB.1.raw
  modified_base (333)..(333): a, c, t, g, unknown or other
  misc_feature (333)..(333): n is a, c, g, or t
  modified_base (432)..(432): a, c, t, g, unknown or other
  misc_feature (432)..(432): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttatattctgtctcctggtaccaacaataccccggcaaagtccccaaactcatgatctttgaggtcagtgatcggcccgcaggggtttcncatcgcttctccggctccaagtctggcagcacggccctcctgacccatctctgggcctccgaggctggacggacgagctgatttattactgcagcctanataactacaaacaataaactacgtttgggtgttccgggcgggtaccggaaccgtaacgtcgaccgttccgtacgtcaaccgtcccgaacggtcctaccgtcccccgtacggtcctaccttcgttccgtcccctcccccg

SEQ ID NO: 252484 - DNA, 527 bp, Homo sapiens
  misc_feature: GYAE6OF02GA958.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccaccaatgacgttggtacttataattctgtctcctggtaccaacaataccccggcaaagtccccaaactcatgatctttgaggtcagtgatcggccgcaggggtttctcatcgcttctccggctccagtctggcagcacgcctccctgaccatctctcgggctccaggctgaggacgaggctgattattactgcagctcatataacaaacataaacacttgggtgttcggcggcgggaccaaacgtcgaccgtctacgtcacgcccaaggctacgccctcggtccactctcgtccctccc

SEQ ID NO: 252485 - DNA, 692 bp, Homo sapiens
  misc_feature: GYAE6OF02JR3ZL.49.35.D02.1.454.CMB.1.raw
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactaccccggcaaacgtccccaaactcatcgatcttgagtcagtgatcggccgcgtacggggtttctcagtccgtcttctccggctcccgaagtctcggctacggccaccgggcctcccgtcgaccactctaccgtcggtcctccgaggtctggacggacggacggtctgtacgttattacgtcgtacagtcctacgtataacgtaactaaaacgtaaccttaaaaccgtacggttagggttacgggtttccggggaaccgggtaccgggtaaaaccctaaacggtaccggtaccccggttacccgttaaccggttaccggtaaccgaaccccgtaaacgggtcccgttacccgggtaccccccgtttccggacccgttacccgttaccccggttaccgtttaccccccggttaaccccc

SEQ ID NO: 252486 - DNA, 541 bp, Homo sapiens
  misc_feature: GYAE6OF02G5GR1.49.35.D02.1.454.CMB.1.raw
  modified_base (381)..(381): a, c, t, g, unknown or other
  misc_feature (381)..(381): n is a, c, g, or t
  modified_base (427)..(427): a, c, t, g, unknown or other
  misc_feature (427)..(427): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggccgcaggggtttctcatcgcttctccggctccaagtctggcagcacggcctccctgaccntctcgtcgggctccaggctgaggacgaggctggattacttactgcngctacatatacaaactaataaacacgttggtcgttcggcggacggaaccaacgtcgaccgtcctacgtcacgaccgaacgctcgcccctcggtcctacttctcgttccctaccc

SEQ ID NO: 252487 - DNA, 525 bp, Homo sapiens
  misc_feature: GYAE6OF02J1QGO.49.35.D02.1.454.CMB.1.raw
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaaatgacgttggtacttataattctgtctcctggtaccaacaataccccggcaaagtccccaaactcatgatctttgagtcagtgatcggccgcaggggtttctcatcgcttctccggctccaagtctggcagcacggcctcctgaccatctctgggctccaggctgaggacgaggctgattattactgcagctcatatacaaacataaacncttgggtnttcgggcggcggaaccaacgtcgaccgtcctacgcagcccaaggctccgcccctcgtcactctcgtccctacccc

SEQ ID NO: 252488 - DNA, 528 bp, Homo sapiens
  misc_feature: GYAE6OF02HBQJ6.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtcccccaaactcatgatctttgaggtcagtgatcgccgcagggtttctcatcgcttctccggctccaagtctggcagcacggcctccctgaccatcctctgggctccaggctgaggacgaggctgattatactgcagctcatatacaaacataaacacgttgggtgttcggcggccgggaaccaacgtgaccgtcctacgtcacgcccaaggcctcgcccctcggtccactctctccctacccc

SEQ ID NO: 252489 - DNA, 527 bp, Homo sapiens
  misc_feature: GYAE6OF02HN71J.49.35.D02.1.454.CMB.1.raw
  modified_base (385)..(385): a, c, t, g, unknown or other
  misc_feature (385)..(385): n is a, c, g, or t
  modified_base (413)..(413): a, c, t, g, unknown or other
  misc_feature (413)..(413): n is a, c, g, or t
  modified_base (465)..(465): a, c, t, g, unknown or other
  misc_feature (465)..(465): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagacaaactatgacacagacatccagacagagtcaccttancgcgacaaatccaacgaacacagcctanatggaactgcgacagcctaggatcgtagccgacaccgggtcctatactttcngtgacgagaggagtactgttacgtttcagttgtaattacgtaattacggtactagtttatcg

SEQ ID NO: 252490 - DNA, 599 bp, Homo sapiens
  misc_feature: GYAE6OF02JB1SG.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtaccccaaactcatgatctttgagtcagtgatcggccgcaggggtttctcatcgcttctccggctccaagtctggcagcacgcctccctcgaccatctctgggcctccgaggctaggaggacgaggtctgtaattacttactgcgagtcctcaatataaccaaaactacttaaaactacgttgggttacgttcgggccgggaccggtaaccaacgttcgacccggttacctaccggttccgaacgaccccgaaggtcccgtcccggtcccccgtacggtccctaccgttccgttacccgttcccctacccccg

SEQ ID NO: 252491 - DNA, 654 bp, Homo sapiens
  misc_feature: GYAE6OF02II1RH.49.35.D02.1.454.CMB.1.raw
  modified_base (335)..(335): a, c, t, g, unknown or other
  misc_feature (335)..(335): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactcggaaccaccaatcgacgttggtacttataacttcctgtctcctggtaaccaacaactaccccggacaaacggtccccaaactacatcgatcgtttgaggtcagtgatccggccncgtagggttctcgatccgtcttcgtccggcctaccgaagtcgtggctaaggccgaccggcccttcccgtcgacccgtacttcgtccgtcgggtacctccgacgggtcgttcggaacgggacggacgggtcttaggtacttttattaacgttggcagccttacaataactaaacgaaacctaataaaaccgtacgtttagggtacgtttccgggcgggtaccggaaccctaaacgtcgacccggttacctacggtccaccgtaccgaaggcctacccggccccttacgggtccctaccgttctacccgttcccctacccc

SEQ ID NO: 252492 - DNA, 766 bp, Homo sapiens
  misc_feature: GYAE6OF02HYQ3S.49.35.D02.1.454.CMB.1.raw
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
tcagagtcgagagacacgaccggtgctcgatttagcacacgatagttgggttggggggggtctcaggagcagcgcgtctcggacgtctccaccgatggccgtggggcctctgctattcctcgaccctcctcactcagggcacacgggtcctgggcccagtctgccctgactccagcctgccctcgtgtctggtcctcctggacngtcatcncatcnctgcactcgaaccncaatgacgttgtaacttanaattctagttactacttagttaaccaataacgtaccgacaacgtacccaaactcgactcgtatctttgagtactagtatactcgccgtcgttacgggtttctgtacgtcgtcgttcctcggtacctacgtagtcgtcgcagtcgacgtcctccgacgtacctattcctcgtcggtcctaccgtacggtccgtacgggtacggtacggtacggtaccgtaacggttaacgtttaacgttaccgtttacggaccttaacggttcctttaaacgtacttaaaccgttaaaacgaaaaccgttaaaccttaaaaccggttaaccgggtttagggttaccgggttaccggggtaccggtaaacccgggtttaaacccgaaacccgggttaccgggttaaccccggttaccgtttaccgggaacggtaacccgggacccggtaaaacgggttcccgtcccgggttaccccggttccggttaacctaaccccggtttcgttccccggtttaccccgttaccccc

SEQ ID NO: 252493 - DNA, 760 bp, Homo sapiens
  misc_feature: GYAE6OF02I8THC.49.35.D02.1.454.CMB.1.raw
  modified_base (281)..(281): a, c, t, g, unknown or other
  misc_feature (281)..(281): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctctggtaccaacaactaccccggnaaacgtccccaaactcatgattctttgaggtcagtgatccggacccgcgtaaggggttttcctcgtactccgtcgtttcctcccgggtccttacccgtaaacggtttctacggggtaccaacggtacccgtaaccgggccccttaccccgtcgaaccctaacgttccgttaccgtacgggggtcccttaccgaccgggtcgttcgggaacgggtacggtaacgggcttaggtaacgttttacgttacgttcggtaccgacgtccgttacctaataaacgtttaaaccaaaactaaacgttaaaaccgtaaccggttttacggggttacgtttaccggggccggggtaaccgggttaaacccgaaacgttaccgggtacccgtaccgttaaccggtccgtaaccggtacccgtaaacggtcccttaccggtcccccgttaccggtcctaacccgttcgttacccgttacccctacccccg

SEQ ID NO: 252494 - DNA, 600 bp, Homo sapiens
  misc_feature: GYAE6OF02I1JZT.49.35.D02.1.454.CMB.1.raw
  modified_base (410)..(410): a, c, t, g, unknown or other
  misc_feature (410)..(410): n is a, c, g, or t
tcagagtcgagagacacgaccggtgctcgatttagcacacgatagttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctctggtaccaacaataccccgcaaagtccccaaactcatgatcttgagtcagtgatcgccgcagggttctcatcgcttctccggctcaagtctggcacgcacggcctcctgaccatctcgtggcctccagctggacggacgtaggctgacttattacngtacacgctcgattaactaacaaaaccaataaaccacgtttggggtagtttccgggaccgggcgggaaacccaaaacgtcgtaacccgttccttaaccggtcgtaaccggccccgtaaaggcccctttacggcccccccggtttacgggtacccctaacggttcccctttacggttccccccgtcccccg

SEQ ID NO: 252495 - DNA, 555 bp, Homo sapiens
  misc_feature: GYAE6OF02GW83O.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctctggtaccaacaataccccggcaaagtccccaaaatcatgatctttgaggtcagtgatcggccgcaggggtttctcatcgcttctccggctccaagtctggcagcacggcctccctgaccatctctgggctccaggctgaggcgaggctgattattactgcagctcatatacaaaacataaacacgttgggtgttcgggacggccgggaaccaaacctcgacccgtccgtaccgtccgacgcccgaacggtccgtccgaccccgttccggtcctacctcttcgttcccctacccccg

SEQ ID NO: 252496 - DNA, 556 bp, Homo sapiens
  misc_feature: GYAE6OF02FKOSD.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgagtcagtgatcggcccgcaggggtttctcatcgcttctccggctccagtctggcagcacggcctcctcgaccatctcgtgggcctccgacggctggaggacgaggctgattattactgcagctcactatgacaggcagactaacgtaatttgtagtatacgttcggacgggacggaccgaaggtcctacggtacccgttaccgtaggtacacggacccgaaggcccgtaccggtcccccgttaccggg

SEQ ID NO: 252497 - DNA, 526 bp, Homo sapiens
  misc_feature: GYAE6OF02JDS3M.49.35.D02.1.454.CMB.1.raw
  modified_base (385)..(385): a, c, t, g, unknown or other
  misc_feature (385)..(385): n is a, c, g, or t
  modified_base (443)..(443): a, c, t, g, unknown or other
  misc_feature (443)..(443): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttggagtgggtgggaggatcaccctatccttaatatagacaaatatgcacagacattccacgacagagtcacccttanccgacggaacaaatccaacgaacacacgacctacatacggactgacgcacgcctaggntctcgaccgacgacggtccgtattactttcgtgtacgcgagagagtatgttctttactagtagtatagtactagtcattatcg

SEQ ID NO: 252498 - DNA, 545 bp, Homo sapiens
  misc_feature: GYAE6OF02FGHZ5.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacactttgggtatttcgggcgtcgggaccaaacgtcgaccgtcctacggtcacgacccaaggcctcggcccccttcgggtccaccgttcctcgttccccgtcccc

SEQ ID NO: 252499 - DNA, 544 bp, Homo sapiens
  misc_feature: GYAE6OF02G2ER1.49.35.D02.1.454.CMB.1.raw
  modified_base (447)..(447): a, c, t, g, unknown or other
  misc_feature (447)..(447): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggccgcaggggttctcatcgcttctccggctccaagtctggcagcacggcctcccgtgaccatctcgtcgggctccgaggctgaggacgaggctgattatactgacagctcatatacaaacataaacncgtttaggtgttcggcggacggaaccaacgtcgaccgtccgtacgtcaacgcccgaagcctacgccccgtcggtccacttcctcgtcccctaccccg

SEQ ID NO: 252500 - DNA, 577 bp, Homo sapiens
  misc_feature: GYAE6OF02GKXSB.49.35.D02.1.454.CMB.1.raw
  modified_base (336)..(336): a, c, t, g, unknown or other
  misc_feature (336)..(336): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggccgcgaggggtttcncatcgcttctccggctccaagtctggcagcacggcctccctgaccatctctcgggctccgagctgacggacgaggctgattattactgcagctacatactacaaactaactaaactacgttgggtcgttcgggaccgggtacgggaaccaaacgttcgtacccgttcccgttacggtccaacggccccaaggcctacggcccccgtcggtacccaccgttcttaccgttcccctacccccg

SEQ ID NO: 252501 - DNA, 653 bp, Homo sapiens
  misc_feature: GYAE6OF02I8H9V.49.35.D02.1.454.CMB.1.raw
  modified_base (331)..(331): a, c, t, g, unknown or other
  misc_feature (331)..(331): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctgtaccaacaatacccggcaaagtccccaaactcatgatctttgagtcagtgatcggccgcagggtttctnatcgcttctccgctaccagtctggcagcacggcctccctgaccatcctcgtgggcctccgaggctggacggacgtaggctaggtattacgttactcgtacagcctacctagttaactaaaccaaaacaacttaaaacctaccgtttaggggttacggtttccgggaccgggtaccgggtaaccgtaaaaccgttccggtaaccccggttcccgtaacccggttaccaaccggtaacccccgtaaacggtcccgttacccggcccccccgttacgggtaccccgtaccgtttacccgtcccggtttacccccccggtcccccg

SEQ ID NO: 252502 - DNA, 545 bp, Homo sapiens
  misc_feature: GYAE6OF02JIJIM.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgagtcagtgatcggcccgcgaggggtttctctatcgcttctccggctccaagtctgcagcacgcctccctgaccatctctgggctccgagctgaggacgaggtctgtattattactgcagctcatataacaaacataaactacgttgggtcgttcgggcggaccggaaccaacgtcgaccgtcgtacgtcacgacccgaagcctccgccccgtcggtaccactcctccgtcccctaccc

SEQ ID NO: 252503 - DNA, 553 bp, Homo sapiens
  misc_feature: GYAE6OF02G5Q2Z.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggcctccaggctggaggacgaggctgattattactgcagctcatataacaaacataaacacgttgggtgtttccgggcggaccgggaaccaaacgtcgacccgttccgtacgtcaacgccccaaggcctcggaccccctcggtccaccgtcttcgtcccctacccc

SEQ ID NO: 252504 - DNA, 533 bp, Homo sapiens
  misc_feature: GYAE6OF02G2A5E.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctggctccaggctgaggacgaggctgattattactgcagctcatataacaaacaataaacacgttaggtgttcggcggcggaccaactgaccgtcgtacgtcacgcccaagccgtgccccctcggtccactccgtcgtccccgtccccg

SEQ ID NO: 252505 - DNA, 569 bp, Homo sapiens
  misc_feature: GYAE6OF02JVKRH.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggacaaacgtccccaaactcatgatcttgagtcagtgatcggccgcgagggttctcatcgtcttctccgctcagtctggcagcacgcctcctcgacctatctcgtcgggctccgaggctggacggacgagctgtattatacgtgcacgctacatataacaactaactaaacgtacgttaggtcgttacgggacggtaccggaactaacgtcgaccgtacgtaccggtcgaaccgccgaacggtcctacccggccccgttcggtccctaccgtcgttccggtcccctccccg

SEQ ID NO: 252506 - DNA, 632 bp, Homo sapiens
  misc_feature: GYAE6OF02HUR5C.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctatccctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaaccaacaataccccggcaaacgtccccaaactcatgatctttgaggtcagtgatcggcccgcgtaggggtttctcatcgcttcgtccggctccagtctggcagcacgcctcctgaccatctcgtggcctccgaggtcgtggggacgaggtctagtatttattagttgtcttgttctattagtcggtaccggtgtaagtagggtcggaccggttaaggggtcggttccgggacgggtacgggaaccgtaagggtcggtaccggttccgtaacgggtccgaaccggacccgaacgggtccgttacccggtccccccgttacgggtccccgttaaccgttcccgtttaccgttaccccccgttacccccg

SEQ ID NO: 252507 - DNA, 538 bp, Homo sapiens
  misc_feature: GYAE6OF02G5V2T.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctctggtaccaacaataccccggcaaagtccccaaactcatgatctttgaggtcagtgatcggccgcaggggtttctcatcgcttctccggctccaagtctggcagcacggcctccctgaccatctctgggctccaggctgaggacgaggctgattattactgcagctcatatacaaacataaacacgttaggtcgttcgggcggtacggaacgaactgacccttcgtacgtcacgcccaaggtcctacgccccgtcggtccacgtcctcgttcccgtcccc

SEQ ID NO: 252508 - DNA, 527 bp, Homo sapiens
  misc_feature: GYAE6OF02FHN7D.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcaggggtttctcatcgcttctccggctccaagtctggcagcacggcctccctgacccatctctgggctccaggctggaggacgaggctgattattactgcagctcatatacaaacataaacattgggtgttcggcgcgggaccaacgtcgaccgtctaccgtcaggcccaagctcgcccctcggccactctcgttccctacccc

SEQ ID NO: 252509 - DNA, 550 bp, Homo sapiens
  misc_feature: GYAE6OF02GMX5X.49.35.D02.1.454.CMB.1.raw
  modified_base (388)..(388): a, c, t, g, unknown or other
  misc_feature (388)..(388): n is a, c, g, or t
  modified_base (491)..(491): a, c, t, g, unknown or other
  misc_feature (491)..(491): n is a, c, g, or t
  modified_base (545)..(545): a, c, t, g, unknown or other
  misc_feature (545)..(545): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacacggcccctggacaaggccttgagtgggtgggaaggatcaccctatccttaatatagcaaactatgcacagacattccaacgacagagtccacccttancgacggaacaaactcccaacgaacacacgacctaacatacggaaactgacgcaagccctagggactccgtagcccgaacgaccggtccgttattacttttcgngttgcggagaggagtattgttcctttctagttgattaggtacttagtcttattnttcgg

SEQ ID NO: 252510 - DNA, 542 bp, Homo sapiens
  misc_feature: GYAE6OF02GHIA0.49.35.D02.1.454.CMB.1.raw
  modified_base (379)..(379): a, c, t, g, unknown or other
  misc_feature (379)..(379): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcgaggggtttctcatcgcttctccggctccaagtctggcagcacggcctccctnaccatctcgtcgggctccgaggctgacggacgaggctgtattattactgcagctacatataacaaacataaacacgttgggtgttcgggcggacggaaccaacgtcgaccgtctacgtcacgcccgaaggcctcgcccctcggtccacgtctccgtccctccc

SEQ ID NO: 252511 - DNA, 611 bp, Homo sapiens
  misc_feature: GYAE6OF02IKZAU.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtccccaaactcatgatctttgaggtcagtgatcggcccgcaggggtttctcatcgcttctcgctccaagtctgcagcacggcctcctgacatctcgtggctcgaggcgtgggacgaggctgatttattattgcttgttctatatcgtccggtgagttaggtcgggaccgtaaggggttcggttccggggacggggaagggaacgtaaacggggtaggtacccggtaccgttagggtaccgtaacggtaccccgaaacgggtcccgttacccggtccccccggttccggttacccgtaccgttcccgttccggttccccctacccccg

SEQ ID NO: 252512 - DNA, 502 bp, Homo sapiens
  misc_feature: GYAE6OF02HP0QC.49.35.D02.1.454.CMB.1.raw
  modified_base (384)..(384): a, c, t, g, unknown or other
  misc_feature (384)..(384): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaggatcaccctatccttaatatagcaaactatgcacagacattccacgacagagtcacccttancgcggacaaatccacgaacacagcctacatggaactgcgcagcctaggatctgccgacacggccgtatactttctgtgcgagagacgatgtctttcatgatagtactagtcattatcg

SEQ ID NO: 252513 - DNA, 563 bp, Homo sapiens
  misc_feature: GYAE6OF02F1CJA.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgactcggcccgcaggggtttctcatcgcttctccggctccaagtctggcagcacggcctccctgaccatcctcgtcggcctccgaggctggacggacgaggctgtattattactgcagctcatatacaaacataaactacgttaggtgttacggccggacggaaccaacgtcgaccgtccgtacgtccgacgcccgaaggtcctccgcccccgtcggtacctacctccgttccgttcccctacccccg

SEQ ID NO: 252514 - DNA, 521 bp, Homo sapiens
  misc_feature: GYAE6OF02IOO1Z.49.35.D02.1.454.CMB.1.raw
  modified_base (283)..(283): a, c, t, g, unknown or other
  misc_feature (283)..(283): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (423)..(423): a, c, t, g, unknown or other
  misc_feature (423)..(423): n is a, c, g, or t
  modified_base (446)..(446): a, c, t, g, unknown or other
  misc_feature (446)..(446): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccccggnaaacgtccccaaactcatgatcttgaggtcagtgatcggcccgngtagggtttcncatcgcttctccggctccaagtctggcagcacggcctcctgaccatctctgggctccgaggctgaggacgagctgattattacgngcagctcatatacaaacataacncttgggtgtcggcggcgaccaacgtcgaccgtctacgtcacgaccgagcctcgcccctgccactctcgtccctcc

SEQ ID NO: 252515 - DNA, 559 bp, Homo sapiens
  misc_feature: GYAE6OF02GN403.49.35.D02.1.454.CMB.1.raw
  modified_base (427)..(427): a, c, t, g, unknown or other
  misc_feature (427)..(427): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcagggtttctcatcgcttctccggctccaagtctggcagcacggcctccctgacctatcctcgtcgggcctccgaggtctgaggacgaggctgattattacngcagctcatataacaaacataaactgttggtcgttcggcggacggaaccaacgtcgaccgttacctacgtcacgacccgaaggtcctccggcccccttcggtacctacccgttcctccgttcccctaccccg

SEQ ID NO: 252516 - DNA, 572 bp, Homo sapiens
  misc_feature: GYAE6OF02HGLB1.49.35.D02.1.454.CMB.1.raw
  modified_base (440)..(440): a, c, t, g, unknown or other
  misc_feature (440)..(440): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgagtcagtgatccggccgcgaggggtttctcatcgcttctccggctccaagtctgcagcacggcctccctgacctatcctcgtcgggcctccgaggctggacggacgacggcgtagtattatactgacagctanataactaacaaacaactaaactacgttgggtacgttccgggcgggacggaaccaaacgtcggtaccgtccgtacggtcacggacccaaggcctccggcccctcggtccaccgtccgtccgttccccgtcccc

SEQ ID NO: 252517 - DNA, 540 bp, Homo sapiens
  misc_feature: GYAE6OF02HYI8K.49.35.D02.1.454.CMB.1.raw
  modified_base (228)..(228): a, c, t, g, unknown or other
  misc_feature (228)..(228): n is a, c, g, or t
  modified_base (475)..(475): a, c, t, g, unknown or other
  misc_feature (475)..(475): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaaccngcagtgatgtggaattataaccttttctcctgtaccaacaacaccaggcaaacgcccccaaactcatcatttatgaggccgatcagccggcctcgaggggtctctgactcgcttctctggctccacgtctggcagcacggccctccctagacaatctcgtggcctcgaggcgtggggacgaggcgtagattattattgtctgttcattagtgtaccggtgagtggtcggtcggtaagggtgtcgggnggagggacgaagggtcgaccgtccgtaggtcacggccgaggcctccgccccgtcgtccacgtccg

SEQ ID NO: 252518 - DNA, 524 bp, Homo sapiens
  misc_feature: GYAE6OF02FJFZI.49.35.D02.1.454.CMB.1.raw
  modified_base (399)..(399): a, c, t, g, unknown or other
  misc_feature (399)..(399): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaaagtccccaaactcatgatctttgaggtcagtgatcggccgcaggggtttctcatcgcttctccggctccaagtctggcagcacggcctccctgacccatctctgggctccaggcngaggacgaggctgattattactgcagctcatataacaaacataaacacttgggtgttcggcgcggaccaactgaccgtctacgtcagcccaagctgccccctcggtccactctcgttccctaccc

SEQ ID NO: 252519 - DNA, 556 bp, Homo sapiens
  misc_feature: GYAE6OF02G9A4D.49.35.D02.1.454.CMB.1.raw
  modified_base (199)..(199): a, c, t, g, unknown or other
  misc_feature (199)..(199): n is a, c, g, or t
  modified_base (373)..(373): a, c, t, g, unknown or other
  misc_feature (373)..(373): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccacaatgacgttgtacttataattctgtctcctggtaccaacaactaccccggcaaacgtccccaaactcatgatcttgagtcagtgatcggccgcgaggggtttctcatcgcttcgtccgctccaagtctgcagcacggcctcccngacctactctcgtggcctccgaggctggaggacgaggctagtattattacngtcagctacataanaacaaactataaactagttgggtgttccgggcgggaccggaacctaacgtcgaccctcgtacgtcgacgacccgaacggcctccgccccgtcgtccacgttcctccgttccccgtccc

SEQ ID NO: 252520 - DNA, 724 bp, Homo sapiens
  misc_feature: GYAE6OF02FNJ0J.49.35.D02.1.454.CMB.1.raw
  modified_base (229)..(229): a, c, t, g, unknown or other
  misc_feature (229)..(229): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnccgaatgacgtttggtacttataattctgtctcctggtaccaacaactaccccggacaaacgtccccaaactcatgatcttgaggtcaggtcgatcgggcccgcgtaggggtttctcgatcgcttcgccggtcctccgaagtctggcagcacggcctcctgaccatctcgtcggcctccgaggctggacggtaccggaggctaggactttattaccgtgcaacgcctacaagttaactaaaccgaaactaaacttaaaacccgtaggttttacggggttacggtttacccggggaccggggtaaacccggggtaaaccctaaaaccggtttcccgggtaacccccggttacccgttaaacccggggttcccgtaaacccgggttacccccgtaaaacggggttcccgttaaccccgggttcccccccggttaacggggtttaaccccgttacccggtttacccgtttcccgggtttacccccccgttaccccccg

SEQ ID NO: 252521 - DNA, 643 bp, Homo sapiens
  misc_feature: GYAE6OF02GNHXF.49.35.D02.1.454.CMB.1.raw
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
tcagagtcgagagacacgaccggtgctcgatttagcacacgatagttgggtttggggggggtctcaggaggcgagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggacttataattctgtctcctggtaccaacaataccccggcaaacgtccccaaactccatgactctttgaggtcagtgatcggcccncacggggtttcncatcgacttcgtccggtctccaacgtctggcagcacggcctcccgtgacccagtcctcgtcgggctccgagtcgtggacggacgacggctgtactttattacgtcgacacggtcctacagtaacctacgaaactacgtaaacgtaccgttgggtacgtttcgggaccggtaccggaacctaaaccgtcgtacccgtcctttaaccggtcctaaccggtaccccaagggtacccctttaccggaccccccgttacgggttaccctaacccggtttaccgttcccggtttacccccttacccccgg

SEQ ID NO: 252522 - DNA, 611 bp, Homo sapiens
  misc_feature: GYAE6OF02FOXIE.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctctgtacaacaactaccccggacaaacgtccccaaactcatgatctttgaggtctagtgatccggcccgcgtaggggtttcctctactccgtcttcgtcccggcctccaagtctggcacgcgaccgcctccctgacctactcctcgtcgggcctccgaggcgtggaggacggaggcgttagtactttacttacgtgctacgtctacgtactaacgaacaaacaacttaaactacggttgggtacgttccgggcggaccgggaactacgtcgtacccgtccgtacgtacgaccgacccgtaacggtccgtccgtcccccgttcggtcctacccgtccgttacccgtccccttaccccg

SEQ ID NO: 252523 - DNA, 557 bp, Homo sapiens
  misc_feature: GYAE6OF02G6UIH.49.35.D02.1.454.CMB.1.raw
  modified_base (518)..(518): a, c, t, g, unknown or other
  misc_feature (518)..(518): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccgcaaagtccccaaactcatgatcttgaggtcagtgatcggccgcaggggtttctcatcgcttctccgctccaagtctggcagcacggcctccctcgaccatcctcgtgggcctccgaggctggaggacgaggctgtattattactgcagctcataataacaaacaataaactacgttgggtgttcggcgggacggaaccgaacgtcgaccgtacctaccggtcaaccgccgaaggtccncgtccccgtcggtccctacgtccttcgtccccgtccccg

SEQ ID NO: 252524 - DNA, 557 bp, Homo sapiens
  misc_feature: GYAE6OF02IJVMV.49.35.D02.1.454.CMB.1.raw
  modified_base (383)..(383): a, c, t, g, unknown or other
  misc_feature (383)..(383): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctgggctgaggtgagaaagcctgggtcgtcggtgaaggtctcctgcaaggcttctggagacaccttcaacaactttgctgtcagctgggtgcgacaggcccctggacaaggccttgagtgggtgggaggatcaccctatccttaatatagcaaactatgcacagacattccacgacagagtcacccttancgacggacaaatcccaacgaacacacgcctaacatggaactgcgcacgcctagggactcgtcgcccgaacgaccggccgttaattactttcctgtcgtaccggagtacggaggtattcggttccttttacgtattacggtaattacggttaaccttaggttacctatttatacg

SEQ ID NO: 252525 - DNA, 629 bp, Homo sapiens
  misc_feature: GYAE6OF02GTLWB.49.35.D02.1.454.CMB.1.raw
  modified_base (363)..(363): a, c, t, g, unknown or other
  misc_feature (363)..(363): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactaccccggacaaacgtcccccaaaactccatgatcttgaggtcagtgatcggccgcgtagggttctcatcgcttctccggctccagtcnggcagcacggccctccctgacctatcctcgtcgggcctccgacggctggagggacggaggtctagtactttacgttacgtcgacagtctacaataactaaacaaaacaacttaaactacgtttagggttcgttacggggccgggaccggtaaacccgtaaaccgtcggtaccccgtccgtaccggtacaaccggcccgaaacgggtccgtcccgtacccccggtaccggtccacccgtttccgttacccggttcccccctaccccg

SEQ ID NO: 252526 - DNA, 538 bp, Homo sapiens
  misc_feature: GYAE6OF02GHOVB.49.35.D02.1.454.CMB.1.raw
  modified_base (337)..(337): a, c, t, g, unknown or other
  misc_feature (337)..(337): n is a, c, g, or t
  modified_base (433)..(433): a, c, t, g, unknown or other
  misc_feature (433)..(433): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtcccccaaactcatgatctttgaggtcagtgatcggcccgcaggggtttcncatcgcttctccggctccaagtctggcagcacgcctccctgaccatctcgtcgggctccgaggctgaggacgaggctgattattactgcagcctanatactaacaaacataaacacgttgggtgttcgggcggacggaaccaacgtcgaccgtcgtacgtcacgccaaggcctcgcccctcggtccactctcgtccctccc

SEQ ID NO: 252527 - DNA, 598 bp, Homo sapiens
  misc_feature: GYAE6OF02H6CZ3.49.35.D02.1.454.CMB.1.raw
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
  modified_base (593)..(593): a, c, t, g, unknown or other
  misc_feature (593)..(593): n is a, c, g, or t
tcagagtcgagagacacgaccggtgctcgatttagcacacgatagttgggtttgggggcatcacataacaaccagattactcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagcgtggtgcgacgacggcccctggacaaggtccttggaggtgggtagggagacgtccaacccgttattacctaatatacgactaaactntagcacagactacttccaanacagacgtcctaacccttatcggacggaacaaactccaaacgaacacaacgcctaagactaggaactcgcgacgacgaccgtagacttccgtacggaccacgaccggtccgttacgttagttacttcgtagtacggacgtagtaacggtgttaacgttcgtttaccgtttaagtcgtacgttaacgtacgtttaacggtacttagtnttacg

SEQ ID NO: 252528 - DNA, 588 bp, Homo sapiens
  misc_feature: GYAE6OF02J1ON4.49.35.D02.1.454.CMB.1.raw
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
tcagagtcgagagacacgaccggtgctcgatttagcacacgatagttgggtttgggggggtcgtcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcactggaaccaccaatgacgttggtacttataattctgtctctggtaccaacatacccgcaagtaccccaaactacatgactcttgtagtcagtagatcggccgcagggtttctctactcgcttctccgtctcctaagtctgtcagcacggcctccctgacccccatctctgggacctccacggcngtaggacgaggctgacttatactgcanctcatataacaaacgtaataaacctacgttgggttacgttcggtccgggaccgggaccgtaaaccgtcgtacccgtaccgttaccggcgaaccgcccgaaccggccgttaccggcccccgttaccggtccctacgtcctccgtttccccttaccccccg

SEQ ID NO: 252529 - DNA, 531 bp, Homo sapiens
  misc_feature: GYAE6OF02G3IW4.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggtccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggcctccaggctgacggacgaggctgattattattgctgttcatatgcgtgatagtggcgaagggttgttcgggcggaggaccgaaggtcgaccgtcgtaggtcacggccaaggctcgccccgtcggtccacgtctcgttcccc

SEQ ID NO: 252530 - DNA, 855 bp, Homo sapiens
  misc_feature: GYAE6OF02IDJ3B.49.35.D02.1.454.CMB.1.raw
  modified_base (268)..(268): a, c, t, g, unknown or other
  misc_feature (268)..(268): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccacaatgacgttgtacttatattctgtctcctggtaccaanaacgtaccccggacaaacgtccccaaaactcatgattctttgacggttcagtgatccggcccgngtagggtttcnctacgtccggtctttccgccgggtcctaccgaacgttcgtaggcacgcgaaccggtccctcccgtacggaccctacttccgtcgttcgggtcctacccgacggtccgtagggacgggtaccgacgggtctaaggttacttttaaacgttaccgttacggtacctacgggtccttaacgtaacgtttaaaacctaaaccgtaaaaaaccgttaaaccgttaaaaacccgtttaccgggtttttacggggggtttaccgggtttaccccggggggtaaccgggggttaaccccgggggtaaaaacccgttaaaaacccgggtttaccgggttaaaccccccggtttaaccccggtttaaacccgggtttaaccccggaacccgggttaaccccccgggttaaaacgggtccccggtttaacccccgggttcccccccgtttaacgggggtttaccccctaaccccggttttaccccgggtttcccccggtttaccccccggtttaccccccccg

SEQ ID NO: 252531 - DNA, 559 bp, Homo sapiens
  misc_feature: GYAE6OF02GMIK6.49.35.D02.1.454.CMB.1.raw
  modified_base (334)..(334): a, c, t, g, unknown or other
  misc_feature (334)..(334): n is a, c, g, or t
  modified_base (393)..(393): a, c, t, g, unknown or other
  misc_feature (393)..(393): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatcttgaggtcagtgatcggccgctagggtttcncatcgcttctccggctccaagtctgcagcacggcctccctgaccatctcgtggctccgnggctggacggacgaggtctgtattattactgcagctcataactaacaaacaactaaactacgttgggtcgttcgggacggacggaaccaacgtcgaccgttactaccgtcgacgcccgaaggtacctccgaccccgtcggtcctacctcgttccgtcccctacccc

SEQ ID NO: 252532 - DNA, 536 bp, Homo sapiens
  misc_feature: GYAE6OF02H7RV7.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcaggggtttctcatcgcttctccggctccaagtctggcagcacggcctccctgaccatctctgggctccagctgagacgaggctgattattactgcagctacattataacgaaacaactaaactacgttgggttgttcggacggcggaaccaacgtgaccgtcctacgtcacgccaaggctcgcccctcgtcctactcgtcgtccctccccg

SEQ ID NO: 252533 - DNA, 572 bp, Homo sapiens
  misc_feature: GYAE6OF02J0LN9.49.35.D02.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (451)..(451): a, c, t, g, unknown or other
  misc_feature (451)..(451): n is a, c, g, or t
tcagagtcgagagacacgaccggtgctcgatttagcacacgatagttgggtttggggggggtcgtcgaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgctacgtggaccaccaatgacgttggtacttataattctgtctctgtacctaacactacccggcaacgtcccaactcatnatcttgagtcagtgatcgccggcgaggggttctcagtcgtcttaccgtccggcctccgaacgtctcggacagtccgacggcctcccgtcgaccactctcgtcgggactccgagcgtcgacggacgaggctagacttattactgacgacgtctntagtacataaaccataactacttagggtagttaccgggcggacggacgacgtagaccgtctacggtcacgccgtaacgcgtaccgccccgtggtccgtactccgttaccgtcccgtacccc

SEQ ID NO: 252534 - DNA, 557 bp, Homo sapiens
  misc_feature: GYAE6OF02HP7GQ.49.35.D02.1.454.CMB.1.raw
  modified_base (318)..(318): a, c, t, g, unknown or other
  misc_feature (318)..(318): n is a, c, g, or t
  modified_base (354)..(354): a, c, t, g, unknown or other
  misc_feature (354)..(354): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
  modified_base (488)..(488): a, c, t, g, unknown or other
  misc_feature (488)..(488): n is a, c, g, or t
  modified_base (507)..(507): a, c, t, g, unknown or other
  misc_feature (507)..(507): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctgggctgaggtgagaaagcctgggtcgtcggtgaaggtctcctgcaaggcttctggagacaccttcaacaactttgctgtcagctgggtgcgacacggcccctggacaaggccttggagtgggngggaggactcaccctatccttaatatagacaaactntcgacacagacattaccaacgacagtacgtaccaccctttagcgtaccggactaaactccaacgaacacgacacctaacagtaggaactgcncagccgtagctcncgaccgacgacggaccgttatactttcgngttacgacgacgagtagtnttcggttcttacgttagtgttaatacgttacttaaggtacttatagttcg

SEQ ID NO: 252535 - DNA, 555 bp, Homo sapiens
  misc_feature: GYAE6OF02G89MM.49.35.D02.1.454.CMB.1.raw
  modified_base (396)..(396): a, c, t, g, unknown or other
  misc_feature (396)..(396): n is a, c, g, or t
  modified_base (426)..(426): a, c, t, g, unknown or other
  misc_feature (426)..(426): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatccggccgcgtagggtttctcatcgcttctccggctccagtctgcagcacggcctccctgaccatctcgtcggctccgnggctgaggacgaggctgtattatactgacngctcatactaacaaactataaacgacgtttgggtagttccgggcggacgggaacctaacgtcgtaccgtcctacggtcacggaccaacggctaccgccccgtcgtacctactccgttcgtccccgtccc

SEQ ID NO: 252536 - DNA, 697 bp, Homo sapiens
  misc_feature: GYAE6OF02FV86J.49.35.D02.1.454.CMB.1.raw
  modified_base (235)..(235): a, c, t, g, unknown or other
  misc_feature (235)..(235): n is a, c, g, or t
tcagagtcgagagacacgaccggtgctcgatttagcacacgatagttgggtttggggggggtctcaggaggcagcgctctcgggacgttctccaccatggcctgggctctgctattcctcaccctcctcactcagggcacagggtcctgggccctagtctgccctgactcagcctgcctccgtgtctgggtctcctggacaggtcggatcaccgatccgtctgcactcggaaccncaatgtacgttggtacttataattctgttctctggtaccaactacgtaccccggctaacgtccccaaactcactgatcgtttggaggtcaggtcgacgtccggcccgcgtacggggttttctcgtagtccggtcttcgtccggtccttccgtaacgttcgtcggctacgccgtacgggtccctccgtacgtaccctacgttccgtcgtcgggtcctaccgacggtacgtacgggacggtaccggacggtcctaggtactttacttacgtacgacgtagtacctacgtaactaacgtaaaccgaaaacgtaacgttaaaccgtacggttacgggttacgttacggggaccgggtacggtaaccctaacgtccgtacccgtaccgttaacgactaccggacccgaacgttccgtacccggtcccggtcggtccgtacccgttccgtacccgtcccctacccccg

SEQ ID NO: 252537 - DNA, 520 bp, Homo sapiens
  misc_feature: GYAE6OF02HWUCV.49.35.D02.1.454.CMB.1.raw
  modified_base (327)..(327): a, c, t, g, unknown or other
  misc_feature (327)..(327): n is a, c, g, or t
  modified_base (387)..(387): a, c, t, g, unknown or other
  misc_feature (387)..(387): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (463)..(463): a, c, t, g, unknown or other
  misc_feature (463)..(463): n is a, c, g, or t
  modified_base (475)..(475): a, c, t, g, unknown or other
  misc_feature (475)..(475): n is a, c, g, or t
  modified_base (490)..(490): a, c, t, g, unknown or other
  misc_feature (490)..(490): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacgaggcccctggacaaggccttgaggtgggtgggaaggntacacccctatccttaatatagacaaactatgcacagacataccacgacagatcacctancgacgacaaactcaacgaacacanacctanatggaactgcacagccaggatctgccgacgacggccgtatcttcgngtcgctagacgngtaattcgttctttntatggtatacggtactagtactattagtcg

SEQ ID NO: 252538 - DNA, 535 bp, Homo sapiens
  misc_feature: GYAE6OF02F1445.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcaggggtttctcatcgcttctccggctccaagtctggcagcacggcctccctgaccatcctcgtgggctccgaggctggaggacgaggctgattattacgtgcagctcatataacaaacaataaacgacttgggtcgttcgggcggacggaaccaacgtcgtaccgtcctacgtcacgccaaggcctcgccctgccactctcgtcccgtccc

SEQ ID NO: 252539 - DNA, 604 bp, Homo sapiens
  misc_feature: GYAE6OF02HL5VC.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaataccccggcaaacgtccccaaactcatgatcttgaggtcagtgatcggcccgcgtaggggtttctcatccgtcttcctccggctccaagtctggcagcacggcctccctgaccatctcgtcggctccgaggctgaggacgaggctgattattattgacagtctactaatactaacaaactaataaactacgttagggtcgttcgggacgggacgggaacctaaacgtcgtacccgtccgttaaccggtcgaaccgacccgtaaacggtccgtacccggtacccccgttccgggtacccgtaccgtttccgttcccggttcccccgtacccccg

SEQ ID NO: 252540 - DNA, 641 bp, Homo sapiens
  misc_feature: GYAE6OF02IIZVY.49.35.D02.1.454.CMB.1.raw
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaccaccaatgacgttggtacttataattctgtctctgtaccaacaactacccggacaaacgtccccaaactcatgtaatccgtttagacggtactagtgactccggccccgtcgtacggggtttctcactcgtcttctccggtctaccaagtctggcaagcacggccctccagacctatccgtcgtcggtcctaccgacggtacgtacggaacgggacgtaacggtcgtagtaacttttaagttacgttcgtacttgtacttagtagtacggacggtagtaggtacggtacggtaccgggtaacgggttggttccgggagggtaacgggaccgtaaggtcggtaccgtcggtacgtaccgtacgaacccggtagcccgtccgacccccgtggtaccacgttcccgttcgttcccccg

SEQ ID NO: 252541 - DNA, 669 bp, Homo sapiens
  misc_feature: GYAE6OF02HNYCS.49.35.D02.1.454.CMB.1.raw
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (415)..(415): a, c, t, g, unknown or other
  misc_feature (415)..(415): n is a, c, g, or t
tcagagtcgagagacacgaccggtgctcgatttagcacacgatagttggggtttggggggcatcacataacaacccagattcctcctctaaagaagcccctgggagcacagctcatcaccaatggactcggacctggaggttcctctttgtggtggcagcagctacaggtgcccagtcccgggtccagctggtgcaatcgtggggctgaggtgagaaagctgggtcgtcggtgaaggtctctgcaaggcttcgtggagacaccttcaactaactttgctgtcagngtggngcgacacggcccctggacaacggtccttgaggtgggtgggaaggtctcaccccttagtaccttaaatagtacgactaaacgtatcgacacaagactattaccagaacagacgtccaaccctttanccgacgtaacctaaactacccaacgaaacacgaacgacctaacagtaccggaaactcgacgaccgagcccgtaagggtacttccgacggtacccaaccggaccgggtacccgtttagtttaactttccggtagttccgggacgtaaggtaccggtaaggtacgtttaccggtttaccgtttttaccgtaagtttaaggtaacgttttaacggttaaaccgtttacggtttactttacgttaacgtttaaccggg

SEQ ID NO: 252542 - DNA, 587 bp, Homo sapiens
  misc_feature: GYAE6OF02GQHAR.49.35.D02.1.454.CMB.1.raw
  modified_base (525)..(525): a, c, t, g, unknown or other
  misc_feature (525)..(525): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatcgtggggctgaggtgagaagcctgggtcgtcggtgaaggtctcctgcaaggcttcgtggagaccaccttcaacctaactttgctgtcagcgtgggtgcgacacggccccgtggaccaaggtccttggaggtggggtagggaaggactccaccccttataccttaatatacgactaaactagtgacacagaactacttacccaacgacagacgtcctacccttacgcggacggaacaaactcccaaacgaacaccacgaccctaacacgtaggaacctggaccgcacgccgtaaggctcgtcggaccgacgcggtaccgttatttacgttcgngtcgagtagagagtacttggtttactttcgtatagtataacgtttacacggtattattatcg

SEQ ID NO: 252543 - DNA, 575 bp, Homo sapiens
  misc_feature: GYAE6OF02GR2B2.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactaccccggcaaacgtcccccaaactcatgatctttgaggtcagtgatcggccgcagggtttctcatcgcttctccggctcaagtctggcagcacggcctcccgtgaccatctcgtcgggctccgaggctggacggacgaggctagtattattactgcagctcatactaacaaactataaactacgttagggtgttccgggcggtacgggaaccaacgtcgacccgtccgtacgtcacgacccgaacggcctaccggcccccgttcggtccctaccgttccgttccgttaccccctacccccg

SEQ ID NO: 252544 - DNA, 711 bp, Homo sapiens
  misc_feature: GYAE6OF02JEMZX.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgacactggaaccaccaatcgacgttggtacttataattctgtctctggtaccaacaactaccccggcaaacgtccccaaactcatcgattcttgagtcagtgagtcggcccgcgtagggtttctcgtatcgtcttccgtccggccttaccgaaacgttcgtcgggccacgaccgtccgggtccctccccgtacggtacccagttccttccggtcggggtccttccggaaggtccgttacgggaagggacccggtagggaccgttagtaacgtttacgtttaaccgtggtaccgtacggtacctacgtaattaacttaaaccaaaacgttaactaaacgtacgttttacggggtacgttaccgggaccgggtaccggtaaacccaaacggttccgacccggtttaccttaccggtactaaccggacccctaagggcccgttcccggtaccccgttacggtacctaccgttccgttacccggttaccccttaccccg

SEQ ID NO: 252545 - DNA, 715 bp, Homo sapiens
  misc_feature: GYAE6OF02FET5E.49.35.D02.1.454.CMB.1.raw
  modified_base (305)..(305): a, c, t, g, unknown or other
  misc_feature (305)..(305): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgacctcagcctgcctccgtgtctgggtcctccgtggacagtcgatccaccatcctcctgcacgtcggaacccacaatgacgttgtacttatattctgtctctcggtacaacaactaccccgacaaacgtaccccaaactcatnattctttgagtcagtgacgtccggccgcgtaggggtttctcgatccgtcttccgtccggtcctaccgtaacggtcgtaggcgacgccgtaaccggtccctcccgtacgaccacttcctcgtcgggcctccgaggtcgtacggacgggacggaggtcttaggtaacttacgtttacgcgactaacggtctacgtaacttaactaaaccaaactaacttaaaccggttacgtttacggggttacggtttaccggggacccgggtaaccgggtaaccctaaaccgtcccgggttacccgttacccgtaccggtaaccggaccgtaaccccggtaacggtcccgtaccccgggtaccccccgttaccgggtacccttaccgtacccggtttacccgtttacccccttacccccg

SEQ ID NO: 252546 - DNA, 564 bp, Homo sapiens
  misc_feature: GYAE6OF02G8DCF.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctgggctgaggtgagaaagcctgggtcgtcggtgaaggtctcctgcaaggcttctggagacaccttcaacaactttgctgtcagctgggtgcgacaggcccctggacaaggccttggagtggggtgggaaggatccacccctatcccttaatatagacaaactatgcaacagacattccaacgacagactcctaacccttatcgacggaacaaactcccaacgaaccaacacgacctaacagtacggaactcgcgacacgcctaaggatcgtcgcccgacgccggtaccgttattactttctgttgacggacgtagacttagttcgtttctttctagttagtaattacgtacttaggtacttatttattcg

SEQ ID NO: 252547 - DNA, 668 bp, Homo sapiens
  misc_feature: GYAE6OF02GD3UR.49.35.D02.1.454.CMB.1.raw
  modified_base (200)..(200): a, c, t, g, unknown or other
  misc_feature (200)..(200): n is a, c, g, or t
  modified_base (464)..(464): a, c, t, g, unknown or other
  misc_feature (464)..(464): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccaccaatgacgttgtacttatattctgtctctggtaccaacaactaccccggacaaacgtccccaaactcatgacttctttgaggtcagtgacgtccggcccgcgtacggggttttctacacgtcgtccttccgtcccggctacccgaagttccgtcgggacctacgcccgtaaccgggtccccttcccgtacgaccctatccgtcgtcgggcctccgaggtcgtaggacggacggnggtactagtatttagttacgtgacagtcctacaattaactaaccaaactaataaaccgtacgtttaggggttacgttaccgggaccgggtacgggtaaaccctaacgtccgtacccgttaccgtacgttaccgaaccggtacccgaacggtccctcccggtcccccgtacggtacctaccgtccgttcccgttcccctaccccg

SEQ ID NO: 252548 - DNA, 577 bp, Homo sapiens
  misc_feature: GYAE6OF02G8CAX.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatcttgaggtcagtgatcggccgcaggggtttctcatcgcttctccggctccaagtctgcagcacggcctcctgacatctctggctccagctgagacgagctgattattactgcagctcatataacaaactaataaactacgtttgggtacgttcgggccggacggaacctaaacgtcggtacccgtccgtaaccggtccaacggaccccgtaaaggtccttaccggaccccccgttcggttacccaccgttcccgttaccgtacccccttaacccccg

SEQ ID NO: 252549 - DNA, 755 bp, Homo sapiens
  misc_feature: GYAE6OF02JS4QH.49.35.D02.1.454.CMB.1.raw
  modified_base (303)..(303): a, c, t, g, unknown or other
  misc_feature (303)..(303): n is a, c, g, or t
tcagagtcgagagacacgaccggtgctcgatttagcacacgatagttggggtttgggggggggtctcaggacggcagcgctctcgggacgtctccgaccatggccgtcgggctctgctattccgtctaccctctcactcagggcacacgggtcctgggcccaggtctgcctgactcagcctcgcctccgtgtctcgggtcctccgtggacagtcgactcgaccatcctcctgccactcggaacccacctaatcggacttggtactatattctagtctctaggtaccaacgtaactacccgganaaacgtaccccaaactacgactacggtacttacgttagacgttacaaggtcgtacgttccggccccgtacggttaacgggggttttcaacgtacgttccgtccttccggttccgggtctaaccggacggttacgtcgggtacgtaacggccgtaacccggcccgttaacccgtcggtaccctactcccgttcgttacggggcccttacccggacgggtacgttacggacgggaaaccggtggtaaccggttacgttactttaggttaacctggtacctacggtctaccgtaattaactaaactaactaactaagtcggttcggttgaccgggaccggtaccgggaactaaccgggtcaacccggttccgtaacggtaccgaccggtacctaagggtccccgtaccgtaccccgtacggtccttaccggttccttacccgtcccctaaccccg

SEQ ID NO: 252550 - DNA, 634 bp, Homo sapiens
  misc_feature: GYAE6OF02GFNAT.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcgaggggtttctcatcgcttcgtccggctccaagtctggcagcacggcctcccgtcgaccatcctcgtcgggcctaccgacggcgtggacgggacggaggtcttagtaattactttacgtgtacagtcctactataactaacaaaactaactaaacctacggtttagggttacggtttccgggacgggtaccgggaaaccgaaacgtcggtacccgttaccgtacgtcgaaccgtacccgaacggtcccgtccggtaccccccgttcggttaccctaccgttccgttcccggttcccccgttccccccg

SEQ ID NO: 252551 - DNA, 547 bp, Homo sapiens
  misc_feature: GYAE6OF02IQILW.49.35.D02.1.454.CMB.1.raw
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccccggcaaacgtccccaaaatcatgatctttgaggtcagtgatcggcccgngagggtttctcatcgcttcnccggctccaagtctggcagcacggcctccctgaccatctcgtggctccaggctggaggacgaggctagattacttactcgcacgctacatactaacaaacaataaacacgttgggtgttcgggcgggacggaaccaactcgaccgtacctacggtcacgacccgaaggcctcgcccctggtccactctccgtccctaccc

SEQ ID NO: 252552 - DNA, 713 bp, Homo sapiens
  misc_feature: GYAE6OF02IUU2E.49.35.D02.1.454.CMB.1.raw
  modified_base (283)..(283): a, c, t, g, unknown or other
  misc_feature (283)..(283): n is a, c, g, or t
  modified_base (331)..(331): a, c, t, g, unknown or other
  misc_feature (331)..(331): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaactaccccgganaaacgtccccaaactcatgattcttggaggtcagtgacgtcggcccgngtaggggtttctcgaatccgtcttccgtccggcctcctaagtctcggcacggcacggcctcctgaccatcctcgtcgggcctaccgaggtctaggacgggtacgaggcttaggtaactttacttacgttcgagtacggtcctacgtaattaaccaaaccgtaaaacctaaactttaaaaccgaacgtttttacgggggttacgtttaccgggggacccggggtaccgggtaaacccgtaaaccgtttaccgggaaccccgtttcccgttaaaccggtaccggaaaccgtaccccggtaaacgggtccgttaccccgtaccccccggtttcgggttaaccccaccggttttcccgttacccggtttaccccctaaccccccgg

SEQ ID NO: 252553 - DNA, 925 bp, Homo sapiens
  misc_feature: GYAE6OF02HEMB4.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtgactgtcgactccactatcctctcgactacgtacgaaccaacaagtcgtacggttacgttaacttaattacttcgtcgtcctcgtacgtaaccaaactaaccgtaccccgaacaaacccgtaaccccaaactactacgtagtactttacgttaggacggttacgtagtacgtaaccggtccccgggacccggtacgggtttacgggtttcctacgtacgttccgttccgttcccggtccggtacccttaacgtaacggttcggtacggaccgtacggacccggtaccccggtaccccttcccggtaaccaacccttacgtttcccgtttccgggtaccggggtaccccttaccgggtacgggtcggtaacggggtaaccgggacgggtaccggtcggttaacgtttaaacgtttaaccgtttaccggtccggaaccgttacggtcctaaaccttaaacgttaaacctaaaaacccgaaaacgttaaaaaccgttaaacccggtttaagggggtttaccggggttttaccggggttacccgggggtaacccggggtaaacccgggtaaaaacccgtaaccgggttaacccggttaaccccgttaacccggttaaacccggtcccggaaacccgttaacccgggtaccgttccccggtcccccgttacccccgggttaccggtaccccttaaccggtttccccgtttacccccggtcccccggtttaccccc

SEQ ID NO: 252554 - DNA, 624 bp, Homo sapiens
  misc_feature: GYAE6OF02IBVCB.49.35.D02.1.454.CMB.1.raw
  modified_base (339)..(339): a, c, t, g, unknown or other
  misc_feature (339)..(339): n is a, c, g, or t
  modified_base (403)..(403): a, c, t, g, unknown or other
  misc_feature (403)..(403): n is a, c, g, or t
  modified_base (433)..(433): a, c, t, g, unknown or other
  misc_feature (433)..(433): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaaatgacgttggtacttataattctgtctcctggtaccaacaataccccggacaaaacgtccccaaactcatgatctttgaggtcagtgatcggccgctaggggtttcncatcgcttctccgctccagtctggcagcacggcctcctgaccatctcgtcgggccacggagtgngaggacgcgtcgtagttaattacgttacgngtacgagtctactaataactaaacaaactaaaactaaacgttacggttagggtacgttaccgggtccgggaacggaaacctaacgtccgtacccgttaccgtaccgtacgaaccgacccgtaacggtacccgttccccgaccccgttacgggtaccctaaccgttccgttaccccgttcccctaacccccg

SEQ ID NO: 252555 - DNA, 533 bp, Homo sapiens
  misc_feature: GYAE6OF02F97GZ.49.35.D02.1.454.CMB.1.raw
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctgtaccaacaataccccggcaaagtccccaaactcatgatctttgaggtcagtgatcggcccgcgtaggggtttctcgatcgtcttctccggctccaagtctggcagcaccggcctccctgaccatctctgggcctcgagctgaggacgaggctgtattattactgcngctnatataacaaacaataacagttggtgttcgggcggacggaaccaacgcgaccgttctacgcacgacccagctcgcccctcggtccactcctcgtccctcccc

SEQ ID NO: 252556 - DNA, 590 bp, Homo sapiens
  misc_feature: GYAE6OF02HTGUH.49.35.D02.1.454.CMB.1.raw
  modified_base (336)..(336): a, c, t, g, unknown or other
  misc_feature (336)..(336): n is a, c, g, or t
  modified_base (384)..(384): a, c, t, g, unknown or other
  misc_feature (384)..(384): n is a, c, g, or t
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaaccaacaataccccggacaaacgtccccaaactcatgatcttgagtcagtgatcggccgcgtaggggtttcncgatcgtcttcctccggtctccaatcgtgcacgcaccggcctcccgtnaccatctcgtcggctccgnggcgtggacggacgnggctgtattagttacncgcngctacgaataactaagaaaactaactaaacgtagttacgggttcgttcgggacgggaccggaaccgtaacgtcgtacccgtacgtaccgtccgaccggaccctaaacggccgttccgaccccgtcggtacctaccgttcttcgttcctcccg

SEQ ID NO: 252557 - DNA, 674 bp, Homo sapiens
  misc_feature: GYAE6OF02G8X3C.49.35.D02.1.454.CMB.1.raw
  modified_base (334)..(334): a, c, t, g, unknown or other
  misc_feature (334)..(334): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatcctcctgcacgtcggaaacccaccaatcgacgttggtacttataattctgtctcctggtaccaacaataccccgacaaacgtacccaaactcatgatctttgagtcagtgatccggcccgngtacggggtttctcatcgtcttctccggtctaccaagtctcggcacgcgaccggctcccgtcgacctactctcgtgggcctccgaggtcgtagacggacgaggctaggtactttacgtacgtcgtacgagtcctacgtataaactaaacctaaaactaaacgttaaaccgtacggtttacggggttacggttaccgggtaccggggtaaccggtaacccgtaaacgttaccggtaacccgttaccgttaacccggtcgtaaacccggacccgaacggtcccgtcccgtcccccggttacggttacccacccgtttccgttaccgttcccccgttcccccg

SEQ ID NO: 252558 - DNA, 664 bp, Homo sapiens
  misc_feature: GYAE6OF02IAIOG.49.35.D02.1.454.CMB.1.raw
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctgtaccaacaactaccccggacaaacgtccccaaactcatgattctttgagtcagtgactcggccgngtagggtttcncgactcgcttccgtccggtcctcccgtaagtcgtggacacggccgaccggtccctccctacgaccctactcgtacgtcgggtcctaccgacgggtctaggacggacggacggtctaggtatttattacgtcgtacagtcctcgaattaagaaacctaaacgtaactaaacgtacgttagggttacgttacgggcgggtaaccggtaacccgaacgttccggtacccgttaccgtaccggtacgaaccgtacccgtaacggtcccgtacccggtacccccgtacgggttaccctacccgtttccgttacccgtacccccttacccccg

SEQ ID NO: 252559 - DNA, 609 bp, Homo sapiens
  misc_feature: GYAE6OF02HLMRJ.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaaacgtccccaaaactcactgattcttgaggtcagtgagtcggcccgctaggggtttctcactcgcttcctccggcctacaacgtctcggcagcacggtccctccctcgacccgtatccttcgtacggggctcccgagggtctggaacgggaccggagggtcctagtaactttacttactggctagtcctactagtaactaacaaaacctacttaaaactacgttgggtacgttccgggacggcggaaacccaagtcgaccgtcctacgtcgacgtacccgaagtccgtaccgccccgttacggacctcgtccttcgtcccctacccg

SEQ ID NO: 252560 - DNA, 568 bp, Homo sapiens
  misc_feature: GYAE6OF02GB3PO.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctctcggtaccaacaataccccggcaaacgtccccaaactcatgatctttgagtcagtgatcgccgcacgggttctcatcgctctcgctcagtctgcagcacggcctcctcgaccgactctcgtcgggtctccgagtctgacggcgagctgtattattacttgcagctacattcaaacgaaactaataacctacgttagggttacgttcgggcggaccggaaccgaacgtgacccgtacctacggtacgaccgtacccgaacggtcgtaccgcccccgtcggtacctaccgttcctccggttacccctaccccg

SEQ ID NO: 252561 - DNA, 591 bp, Homo sapiens
  misc_feature: GYAE6OF02FFGAD.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgtttggacttataattctgtctcctggtaccaacaataccccggcaaagtccccaaactcatgatctttgaggtcagttgatcggccgcaggggtttctcatcgcttctaccggctccaacgtctcggctagcaacggcctcccgtgaccatctctcgggctcaggctgacggacgagctgatattactgcagctcatatacaaacataaacacgtttgggtacgtttcgggacggtcgggaacctaacgtacgtaccgtaccgtaccggttaccacggaccccgtaaaggccgttacggcccccccgttcgggttacccacgtttcccgttccggtttcccccgttaccccccg

SEQ ID NO: 252562 - DNA, 658 bp, Homo sapiens
  misc_feature: GYAE6OF02F73C9.49.35.D02.1.454.CMB.1.raw
  modified_base (275)..(275): a, c, t, g, unknown or other
  misc_feature (275)..(275): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaacccaccaatggacgttggtacttataattctgtctctggtaccaacaanaccccgcaaacgtccccaaactcatgatctttgaggtcagtgatcggcccgcgaggggtttcctcatcgtcttctccggcctccaacgtctgcagcacggcctccctgacctactcctcgtcgggcctccgtaggtcgtggacggacgaggtctgtattattagttgtcttcgttcattagtcgtccggtagtagttagggtcggtacggtaaggggttcgggttacgggacggggtaagggtaacgggtaaagggttcgggtaacccggttaccggttaacgggttaccgaaccgggtaaccccgtaagggtccccgttacccgggtccccccggttaccgggttacccaccgttttaccccggttacgtttaccccccccg

SEQ ID NO: 252563 - DNA, 636 bp, Homo sapiens
  misc_feature: GYAE6OF02G3O3M.49.35.D02.1.454.CMB.1.raw
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
  modified_base (313)..(313): a, c, t, g, unknown or other
  misc_feature (313)..(313): n is a, c, g, or t
  modified_base (609)..(609): a, c, t, g, unknown or other
  misc_feature (609)..(609): n is a, c, g, or t
tcagagtcgagagacacgaccggtgctcgatttagcacacgatagttgggtttggggggggggtctcaggaggcagcgctctcgggacgtctccaccatggcctgggctctgctattcctcaccctcctcactcagggcacagggtcctgggcccagtctggccctgactcagcctgcctccgtgtctgggtctcctggacagtcgatcacatctctgcactgaaccacaatgacgttgtacttatattctntctctgtacaacatacccgnaagtccccaaatcatgatcttgaggtcagtgatcggcccgngtaggggtttcctcatccgtcttccgtccggtcttacccaagtcgtcggactagccgaccggccccttcccgtcggacccctattcctcggtcgggtccctccgacggtcgtaggacggacggtaaggctagtaagtttacttactcggactacggctcgtaattaactaaacaaaactactaaaactacggtttacggggttcgttaccgggcgggtaaccggaaaccaaccgttcgaccgttacgtaaccggtcacgacccggaacggtcctcccggcccccgttcggtacccncccttcgttcccgttacccttcccccg

SEQ ID NO: 252564 - DNA, 568 bp, Homo sapiens
  misc_feature: GYAE6OF02FYII1.49.35.D02.1.454.CMB.1.raw
  modified_base (400)..(400): a, c, t, g, unknown or other
  misc_feature (400)..(400): n is a, c, g, or t
  modified_base (552)..(552): a, c, t, g, unknown or other
  misc_feature (552)..(552): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccacaatgacgttggtacttataattctgtctcctggtaccaacaataccccggcaaacgtccccaaactcatgatcttgaggtcagtgatcggcccgcgtaggggtttctcatcgtcttctccggctccaagtctggcagcacggcctcccgtcgaccactctctcgggctccgnggctggaggacgaggctacgtattacttactgcagtcctcgtataacgtaacaaacaactaaactagtttagggtcgtttcgggacgggtccggaaccaagtcgacccgttccgtaccgtcacgacccgtaaggcctccgccccgtgtcccnctctccgtcccctccc

SEQ ID NO: 252565 - DNA, 629 bp, Homo sapiens
  misc_feature: GYAE6OF02GS9AG.49.35.D02.1.454.CMB.1.raw
  modified_base (328)..(328): a, c, t, g, unknown or other
  misc_feature (328)..(328): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatccggcccgngtacggggttttctcgtaactccgtcttccgtccggctaccaacgttctggcagcacggccctcccgtgacccatctacgtcgggctccgaggctggacgggacgaggctagtattagttactgaccgagtctacaattaataaaccaaactaactaaacgtacgttgggtacgtttccgggacgggaccgggaacctaaacgtcggacccgttaccgtacggtaccgacggtacccgaaagggtccctaccggacccccgttggtacccgtaccttccgttaccgttccccctaaccccc

SEQ ID NO: 252566 - DNA, 712 bp, Homo sapiens
  misc_feature: GYAE6OF02HS20A.49.35.D02.1.454.CMB.1.raw
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
  modified_base (540)..(540): a, c, t, g, unknown or other
  misc_feature (540)..(540): n is a, c, g, or t
tcagagtcgagagacacgaccggtgctcgatttagcacacgatagttgggtttggggggggtctcaggaggcagcggctctcgggaccgtctccctaccaatggtccctggggtcttcctgctaattcctcaaccctcctcactcaggcacagggtacctgggccctaggtctggtccctgactcacgtccttagtccttccgtagtcttagggtctcctggacagtcgatcacctagtcgtccttggcgacgtcggtaaccgaccaagtcgtacggttcggtacttagtaattctgttcctcctggtaaccaacaacgttacccgataaacgtaccccaaactctatagtacttctttacgaggtaccagtacggacgtccgggcccggnggttacggggtttcncgtacgtcggtcttcgtccggtctaccgaacgttgtcggcgtacgcgtaaccggtcctcccgtagacctagttcgtaccgtcgggtcctaccggtagtcgtggaacgggacgtgtacctagtacttaagttacncgacaacgttacctaacgtaactaacgtaacctaaaacgtactaaacgtggttaggtacgtacgggacggaaacgaacctaacgtcgtaccgttcgtacgcgtaccgacgaacggtcccgttacggtcccgttacggtacctacgtttaccgttaccgttaccccgtacccg

SEQ ID NO: 252567 - DNA, 890 bp, Homo sapiens
  misc_feature: GYAE6OF02HVLLV.49.35.D02.1.454.CMB.1.raw
tcagagtcgagagacacgaccggtgctcgatttagcacacgatagtggggttggggggtctcaaggaggcaggcgcggtctcgggacgtactccacgattggcctgggcctcgtgtctattttcctcgtaccctcctcacgtcagggcacgagggtcctaggggcccagtcgtgccctgacctcacgcctgcctccgtggtcctgggtctcctggacgacgtcgagtccaaccatcctacctgcaacgtcggaaccaccaagtcgtacgtttagtaacttaactaacttctagtcctaccgtaggtaaaccctaactaacgtaccccggtacaaaaccgtaccccaaacttacgaaacgtacggaacttcgtttacgaacggttaacctaggttcgacttcccgggtaccccgtcggtaccggggttttacctacccggtaacgttcccggtaccttccgtacccggtcctttacccgaaacggttcggtcggacctacggggtacccgtaccggggtaccccttacccgttacggtaaaccctagtttacccgttaccggttaccggggtaacccttacccggtaaacgggtcccgttacgggtaaacccggggtaccggtaacgggtaccgttacggtaacgtttaaacgttaacgttacggtacgtaacggttacttacgtaacttaaacgtaaacgtaaaacttaaacgttaaaccttaacggttttacgggttaccgtttaccggggtaccgggtacgggtaacccgaaaccgtaccggtaacccggttaaccgtaccggtaacgtaaccggaacccgtaacggtccgtacccggtaccccgtacggtaccctaccgttcccgtttaccggttccccgttccccg

SEQ ID NO: 252568 - DNA, 593 bp, Homo sapiens
  misc_feature: GYAE6OF02HIP32.49.35.D02.1.454.CMB.1.raw
  modified_base (338)..(338): a, c, t, g, unknown or other
  misc_feature (338)..(338): n is a, c, g, or t
  modified_base (432)..(432): a, c, t, g, unknown or other
  misc_feature (432)..(432): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactaccccggacaaacgtccccaaactcatgatcttgagtcagtgactcggccgcgtaggggtttcncatcgcttcctccggcctcaagtctggcagcacgcctcctgaccatctcgtcggctccgaggtcgtgacggacgaggctagtacttatactgcncgtctactataactaacaaactacttaaacgtacgttagggtcgttccggggaccgggtacggaacctaacgtccggtacccgttaccgtaccggtcaaccgacccgtaacgggtcctccggtcccccgtggtccctacgttccgttccgtcccctacccg

SEQ ID NO: 252569 - DNA, 552 bp, Homo sapiens
  misc_feature: GYAE6OF02HEZ6J.49.35.D02.1.454.CMB.1.raw
  modified_base (377)..(377): a, c, t, g, unknown or other
  misc_feature (377)..(377): n is a, c, g, or t
  modified_base (428)..(428): a, c, t, g, unknown or other
  misc_feature (428)..(428): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctcctggtaccaacaactacccggacaaacgtccccaaactcactgatctttgagtcagtgatcggcccgcgtagggtttctcatcgtcttctccggctccaagtctgcagcacggcctcccngaccatctcgtcgggctccaggctgaggacgagctgattattctgcagctnataataacgaaacaataaacctacgttgggttcgttcggacgggcggaaccgaaacgtccgacgttaccgtaccgtcacgcccgagccgtccgcccgtcggtccacttctccgtccctaccccg

SEQ ID NO: 252570 - DNA, 541 bp, Homo sapiens
  misc_feature: GYAE6OF02G4Q5Z.49.35.D02.1.454.CMB.1.raw
  modified_base (426)..(426): a, c, t, g, unknown or other
  misc_feature (426)..(426): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaattaccccggcaaagtccccaaactcatgatcttgaggtcagtgatcggcccgcaggggtttctcatcgcttctccggctccaagtctgcagcacgcctcctgaccatctctgggctccgaggctgaggacgaggctgattagttactgcagctnatatacaaactaataaactacgttgggtcgttcggccggcgtaacggaccaacgtcgaccgtccgtacgtccacgcccaacggcctccgccccgtcgtccactctcgttaccccc

SEQ ID NO: 252571 - DNA, 668 bp, Homo sapiens
  misc_feature: GYAE6OF02GP5H9.49.35.D02.1.454.CMB.1.raw
tcagagtcgagagacacgaccggtgctcgatttagcacacgatagttggggtttgggggggggtctcaggaggcagcgctctcgggacgtctccaccatggcctgggctcctgctattcctccaccctcctcactcagggcacagggtcctgggcccagtctgccctgactcagcctgcctccgtgtctgggtctcctggacagtcgatcaccatcctctgcatggaaccacaatgacgttagtacttatattctgtctcctggtaccaacaactaccccggacaaacgtccccaaactcatgactctttggaggtcagtgactccggcccgcgtacggggtttctcacgtcgtcttcgtccggctaccaagtctggcagcacggcctccctgaccactcgtcgtgggcctccgagggctaggacggacggacggtcgtgtaactttacgttacgtcgactacgacctacacgttaataaccaaaacgtaacttaaaccgtacggtttaggggttacggttaccggggaccgggacgggtaaacccgtaaacgtccgggttacccttacccggttaacgtccggaacccggacccggtaacggtcccgtacccgtccccccgttcggttacccaccgtttcccgtaccccgttaccccttaccccccg

SEQ ID NO: 252572 - DNA, 590 bp, Homo sapiens
  misc_feature: GYAE6OF02I9G2U.49.35.D02.1.454.CMB.1.raw
  modified_base (370)..(370): a, c, t, g, unknown or other
  misc_feature (370)..(370): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctcctggtaccaacaatacccggcaaacgtccccaaactcatgatctttgaggtcagtgatcggcccgcaggggttctcatcgcttctccggctccaagtctgcagcacgcctccncgaccatctcgtcgggctccgaggctggacggacgaggctaggacttagttactgcagtctcatactaacaaacaaactaaactacgttacgggtcggttccgggaccgggcggaaaccgtaaacgtacggtacccgtccgtaaccgtccgacgtacccgaaaggcccgtccggacccccgttcggtacctacccgtccgttccgttcccccggtccccc

SEQ ID NO: 252573 - DNA, 557 bp, Homo sapiens
  misc_feature: GYAE6OF02GBX25.49.35.D02.1.454.CMB.1.raw
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatcttgaggtcagtgatcggccgcaggggtttctcatcgcttctccggctccaagtctggcagcaccggcctccctcgaccactcctcgtcggggcctccgaggcctggacgggacgaggctggaattattactgcagctcatanaacaaanataacacgttgggtcgttcgggcggacggaaccaacgtcgacccgtcgtacggtcacgacccgaaggctccgccccgtcggtccacctccgttcgtcccctacccc

SEQ ID NO: 252574 - DNA, 619 bp, Homo sapiens
  misc_feature: GYAE6OF02I9QEF.49.35.D02.1.454.CMB.1.raw
  modified_base (323)..(323): a, c, t, g, unknown or other
  misc_feature (323)..(323): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctctgtaccaacaataccccggcaaacgtccccaaactcaatgatctttgagtcagtgatcggcccgngtaggggtttctcatcgcttctccggctccgaatctggcagcacggtcctcctgaccatctcgtgggcctccgaggctggaggacgaggctagtattatactcgcagtcctacgtataactaacaaaacaacttaaacgtaccgtttaggggttcgtttacggggaccgggtaccgggtaaacctaaaccgttccgacccgtttacccgtaacgtaccgaccggacccgtaacgggtccctacccggcccccgttcggtacccaaccggttccttacccggttccccctacccccg

SEQ ID NO: 252575 - DNA, 759 bp, Homo sapiens
  misc_feature: GYAE6OF02GI5CK.49.35.D02.1.454.CMB.1.raw
  modified_base (336)..(336): a, c, t, g, unknown or other
  misc_feature (336)..(336): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccaccaatgacgttgtacttataattctgtctcctgtaccaacaataccccgacaaacgtccccaaactcatgattctttgagtcagtgagtcggccgtcgtaggggtttcnctagtccgtcttcgtaccggtcctaccgaacgttctcggactacggccgtaccggtcccttaccccgtacgaacccgtacttccgtccggttcgggacccttccggacgggtcgttacgggaacgggacggtacgggtaccttacggtaactttttagtttaacgtttcggtacttttacgtttacgtaactttaggtcgggtacccgggttaggaacgtttacgggtacggggtacccgggttaacggggtttcggggttacccggggtacgggtaaccgggggtaaaccgtagggggttaccgtacccgggttaccggtaacgggttcccgaacgggtacccccgtaaagggtcccggttaccccgtccccggttcccggttacccgtaccgtttacccggttcccgtttaaccccccccg

SEQ ID NO: 252576 - DNA, 608 bp, Homo sapiens
  misc_feature: GYAE6OF02H0CCO.49.35.D02.1.454.CMB.1.raw
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggacaaacgtcccaaaactcatgatctttagaggtcagtgatcggcccgngacggggtttcncatcgcttctccggctcaagtcngcagcacggcctcctgacccatctcgtgggctccaggctggacggacgaggctagatttagtaactgacagctacaataataacaaaacgaattaaaaccgacgtttagggtgttaccgggcgggtaccggaaccaaacgtcgacccgttacttaccggtaccaacgtaccccgaaacgggtccgtccggaccccccgttcgggtacccttaacccgttcgttcccgttacccccttaacccccg

SEQ ID NO: 252577 - DNA, 667 bp, Homo sapiens
  misc_feature: GYAE6OF02HNLP1.49.35.D02.1.454.CMB.1.raw
  modified_base (341)..(341): a, c, t, g, unknown or other
  misc_feature (341)..(341): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccacaatgacgttggtacttatattctgtctcctggtaccaacaataccccggcaaacgtccccaaactcatgactctttgaggttcagtgactccggacccgcgtacggggtttcncagtcgtccttcgtccggctaccgtaagtcgtggcagccaccggtccctccctacggaaccctacgtcctcgtcgggtcctaccgtagggcttcgggaacggacggtaggcgttacgtaagttttacgttaaccgtggacctacgcgttactaagtaacttaaaccaaaactaacttaaacgacgtttcgggtacgttcgggaccgggtacgggaaccctaacgtacggtacccgttaccgtaacgtccgaaccggtacccgaacggtcccgtaccgtacccccggtcggttaccaccgttccgttcccgttaccccctaaccccg

SEQ ID NO: 252578 - DNA, 560 bp, Homo sapiens
  misc_feature: GYAE6OF02F87KF.49.35.D02.1.454.CMB.1.raw
  modified_base (425)..(425): a, c, t, g, unknown or other
  misc_feature (425)..(425): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggacaaacgtccccaaactcatgatctttgaggtcagtgatcggccgcgtagggtttctcatcgcttctccggctccaagtctggcagcacggcctcctgacccatcctcgtcgggctccgaggctgaggacgagctgattattacngcagctacatacaactaaactaataactacgttgggtcgttcgggcggacggaacctaacgtcgtaccgtccgtacgtcgaacgcccgaaggtcctccgtccccgtcggtccaccgtccttccgtcccctacccc

SEQ ID NO: 252579 - DNA, 812 bp, Homo sapiens
  misc_feature: GYAE6OF02IQJ0G.49.35.D02.1.454.CMB.1.raw
  modified_base (201)..(201): a, c, t, g, unknown or other
  misc_feature (201)..(201): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcacgcctgcctccgtgtcgtcggtctccgtgacngtcgatccacactctctgcacgtacgaaccacaatcgtacgttgtacttatattctcgtctccgtacgtaaccaacaaccgtaccccggataaaccgtaccccaaactctatgtaacttcgtttaggacggtcaggtgtacgtccggcccgtcggttacgggtttcacgtacgttccgtcctttaccgccggtccttaaccgtaacgttcgtcggacacgaccgtaacccggtcccttcccgtacgtaaccctacgtttccgtccgggtcgggtacccgtacccggtagggtccgtagggaacgggacggtacgggtacttaggttaacttttaacgttaccgttcggaccgtaccgtacctactaaacgttaaacctaaactaaaacttaaaccgttaaaaccgtttacgggttttacgggggtttaccgggttaccggggaaccggggtaaccccgggtaaaacccgtaaaccgttacccgggtacccgtttaacccgttaaccgggtccgaaacccggtacccggtaaccggtcccgttaccccggtccccccgtttacgggtacccttacccgtttcccgtttaccccgttacccccgttacccccg

SEQ ID NO: 252580 - DNA, 818 bp, Homo sapiens
  misc_feature: GYAE6OF02IOKWK.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttataattctgtctcctgtaccaacaactaccccggacaaacgtccccaaactcatgacttctttgaggtcagtgtacgtccggccccggtcgtacggggtttctcgtacgtccgtccgtttccgtcccggtccttacccgtaaacggttccgtacgggaccgaacggtacccgtaacccgggtcccctaccccgtacggtaacccctacgtttcccgttccggtccggggtacccttcccggaacgggtcccgttaggggaacgggtaaccggtaacggggtccgttaggtaacttttaacgtttaaccgttggaccgtacggtaccttacaaacgttaactaaaccgaaaaactaaaccttaaaaccgtaaccggttttaggggttacggtttacccgggggaccggggtaaccgggtaaaccccgtaaaacgttcccgggtaacccgttacccgttacccggtaaccgaacccggtaaccccggtaaaccgggttcccgttacccggtaccccccgttaccgggttaccctaaccccggtttccgttaccccggttacccccttaacccccg

SEQ ID NO: 252581 - DNA, 545 bp, Homo sapiens
  misc_feature: GYAE6OF02GPM2C.49.35.D02.1.454.CMB.1.raw
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctcctggtaccaacaataccccggcaaacgtccccaaactcatgatctttgaggtcagtgatcggcccgcaggggtttctcatcgcttctccggctcaagtctggcacgcaccggcctccctcgaccatctcgtcgggcctccgaggctggaggacgaggctaggattattacgngcagcctanactanacaaacataaactcgttggtcgttcggcggcggaacaactgtaccgcctacgtcacgccgaaggcctacgccccgtcgtaccaccgtctccgtcccgtcccc

SEQ ID NO: 252582 - DNA, 772 bp, Homo sapiens
  misc_feature: GYAE6OF02GEHKC.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcacgtggaaccaccaatgacgttgtacttataattctgtctcctggtaccaacaactaccccggacaaacgtacccccaaactcatgattctttggaggtcagtgactccggcccgcgtacggggtttctcgtacgtccgccgtttcctcccgggtcctaccgtaacgttcgtcggccgacggccgaccggccccttcccgtacgaccctactccgtcgtcggggtccctaccgacggtccgtaggaacgggaccggacgggcttaggtaactttacgtttacgtcggtacctacgtcctacgtaacttaaacgtaaacctaaaacgtaaacgttaaaccgtacgggtttacgggttacggtttaccggggaccgggtacccgggtaaaacccgtaaacgttacccgggtaaccccgttacccgttaaccggtaccggtaaccccggtaacccggaaaccgggtaccccgttaccccggtacccccccggtttaccggttaaccccgttacccgtttccccggttcccccggtttaccccccgttacccccccg

SEQ ID NO: 252583 - DNA, 610 bp, Homo sapiens
  misc_feature: GYAE6OF02FQ11O.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatccggcccgcgtaggggtttctcagtcgcttctccggcctaccgagtctggcagcgaccggccctccctcgacccatcctcgtcgggcctccgaggctggacggacgaggctgtattattacgtgcagtctacatactaacaaactataacgtacgttagggttcgttcgggaccggtcgggaaacctaacgtaccggtacccttaccgtacccgtacaaccggacccgtaacggacccttccggacccccgtcggttccctaccgttccgttacccgttcccccgtaccccc

SEQ ID NO: 252584 - DNA, 543 bp, Homo sapiens
  misc_feature: GYAE6OF02GSLHO.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccaccaatgacgttggtacttataattctgtctcctggtaccaacaataccccggcaaagtccccaaactcatgatctttgaggtcagtgatcggccgcgaggggtttctcatcgcttctccggctccaagtctggcagcacggcctccctgacccatcctcgtcgggctccgaggctggaggacgaggctgattattactgcagctacatataacaaactaataaactacgtttgggtgttccgggcggcggaaccaaagtcgaccgtctacgtcacgcccaaggcctcgcccctggtccactctcgtccctaccc

SEQ ID NO: 252585 - DNA, 612 bp, Homo sapiens
  misc_feature: GYAE6OF02HU3S0.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggacaaagtcccccaaactcatgatctttgaggtcagtgatcggcccgcagggtttctcatcgcttctccggctccaagtctgcagcacggcctccctgaccatctcgtcgggctccgaggctagaggacgaggtcgtgtattatacgtgcacgtctacataacaacaaactaataaacgtacgtttaggggtcgttaccgggcgggtaccggaacctaaacgtcggtacccgttcctaaccggtccgaaccggacccgaaacggtcccgttacccggtaccccccgttcgggtaccctaccgtttcccgttacccgtttccccctaacccccg

SEQ ID NO: 252586 - DNA, 515 bp, Homo sapiens
  misc_feature: GYAE6OF02HUL0T.49.35.D02.1.454.CMB.1.raw
  modified_base (423)..(423): a, c, t, g, unknown or other
  misc_feature (423)..(423): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcaggggtttctcatcgcttctccggctccaagtctggcagcacggcctccctgaccatctctgggctcaggctgaggacgagctgattattactgcagctnatatacaaacaataaacacttgggtgttcgcggacggacaactcgaccgtctacgtcacgccagctcgcccctcggcactctcgtcctaccc

SEQ ID NO: 252587 - DNA, 526 bp, Homo sapiens
  misc_feature: GYAE6OF02HEEVJ.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcaggggtttctcatcgcttctccggctccagtctggcagcacggcctccctgaccatctctgggcctccgaggctgaggacgaggctgattattactgcagctcatatacaaacataaactagttagggtgttcggcggacggaacaacgtcgaccgtcctacgtcacgccagcctcgcccctcgcactctctccctccc

SEQ ID NO: 252588 - DNA, 754 bp, Homo sapiens
  misc_feature: GYAE6OF02I87FP.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactaccccggacaaacgtccccaaactcatgatctttgagtcagtgacgtcggcccgcgtacggggtttctacgacgttccgtcctttccgtcccggtccttcccgtaaacggttccgtcgggaccgacggtaccgacccgggtcccttccccgtacggaccctaacgttcccttccgtcggggtacctcccgtaacgggcgttacgggacgggacggacgggacgttagtaactttacgttacgtcgaccacggtacctactaacgttaactaaacctaaaacctaacttaaaaccgtacgtttacggggttacggtttaccggggaccgggtaacccgggtaaaccgtaaaccgtccggtaccccgttaccgttaaccggtaccgaaccggtaacccggtaaccggtacccgttacccggtaccccccgttaccggtaccccttacccgttcccgtttacccgttccccccttaacccccg

SEQ ID NO: 252589 - DNA, 653 bp, Homo sapiens
  misc_feature: GYAE6OF02H4Z0R.49.35.D02.1.454.CMB.1.raw
  modified_base (294)..(294): a, c, t, g, unknown or other
  misc_feature (294)..(294): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctcctgtaccaacaactacccgacaacgtcccaaactcatntatctttgaggtcagtgactccggccgtcgtagggtttctctacgttcgtcttccgtccggcctaccgtaagttctggccacgaccgacccggtccctccctacgaccctagtccgtcgtcggacctccgacggcggtacggacggacggacgtcgttacttaagttctaacgtcgacgctctacgataaactaaacaaactaacttaaacgtcggtttacgggtcgggttaccggacccgggtaacgaaaccgttacgtaccggtacccgtccgttaaccggccgtaaccgacccgtacgtcccgtacccgtcccgtaccggtaccttacccgttcttacccccgtaccccttccccg

SEQ ID NO: 252590 - DNA, 669 bp, Homo sapiens
  misc_feature: GYAE6OF02HZ5TD.49.35.D02.1.454.CMB.1.raw
  modified_base (349)..(349): a, c, t, g, unknown or other
  misc_feature (349)..(349): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacgagggtcctgggcccagtctgccctgactcagccctgccctccgtgtctgggtctcctggacagtcgatcaccatctcctgcacgtcggaaccacaatggacgttggtacttatattctgtctccgtgtaccaacaacgtaccccggacaaacgtcccaaactcatgacttctttaggacgtcagtgacgtccgccgtcgtacgggttcncgtatcgtcttcgtccggctaccagtcgtggctacgcgaccggtcctccctacacctctcctcggtcggtctccgaggtccgtaggacggacggaggtactgtaatttacgtacgtcgtacgtagtcctacgaatactaaactaaacgtaaactaaaccgttaggttacgggttcggttccgggccgggtaacggaacccgttaaacggtcccggtacccgttaccggtaccggtaccgaaccggacccggtaacggtcccgttcccggcccccgttcgggtacccttacccgttcgttccccgttcccccgttaccccc

SEQ ID NO: 252591 - DNA, 624 bp, Homo sapiens
  misc_feature: GYAE6OF02JXTUX.49.35.D02.1.454.CMB.1.raw
  modified_base (246)..(246): a, c, t, g, unknown or other
  misc_feature (246)..(246): n is a, c, g, or t
  modified_base (266)..(266): a, c, t, g, unknown or other
  misc_feature (266)..(266): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (430)..(430): a, c, t, g, unknown or other
  misc_feature (430)..(430): n is a, c, g, or t
  modified_base (496)..(496): a, c, t, g, unknown or other
  misc_feature (496)..(496): n is a, c, g, or t
tcagagtcgagagacacgaccggtgctcgatttagcacacgatagttgggtttgggggggttcgtcgaggaggcagcgctctcgggacgtctccaccatggcctggctctgctattcctcaccctcctcactcaggcacagggtcctggcccagtctgccctgacctcagcctgcctccgtgtctgggtctcctggacagtcgatcgaccatctctgcactggaaccacaatgacgttgtacttanaattctgtctctgtaccaanaactacccgacaacgtaccccaaactcatgatcttgacgtcagtgatccggccngtcggtttcncgatccgcttccgtccggctccgaactcgtcggtcagcccacggccctcccgtacacccgatccgtgtcggtcctaccgacggctaggtacgggaaccgnggcgttagtaacctttagtaccttcggccagtccttaccgattactaaccgaaactactaaaccgngtttacgggtcgttacggccgggaaccgaaccgtactaccggacctccgttacgacccgtacgtaccgaaccgtccgtaccgtccccgttacggcctaccgtcccgtttaccgtaccccccttacccg

SEQ ID NO: 252592 - DNA, 695 bp, Homo sapiens
  misc_feature: GYAE6OF02GI8E5.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctgtaccaacaactaccccggacaaacgtaccccaaactcatgaatctttgaggtcagtgatccggcccgcgtaggggtttctcgatcgtcttctccggtcctaccgaacgttctcggcacgaccgaccggtccctcccgtcgaccactcctcgtcgggcctccgacggcgtgggaacggacgtaggcgttagtatttaattaccgtgtcgacgtcttacaacttaactaaaccgaaactaaacttaaaccgttaggtttcggggttcgggttaccggggaccgggtacccgggtaaaccgtaaacccgtacggtacccccggttactacccgggtccgaaccggtaccccggtaaacggtccctaccccgggtaccccccgttccgggttaccctaccgtttccccgttcccgtttcccccccgttaccccccg

SEQ ID NO: 252593 - DNA, 817 bp, Homo sapiens
  misc_feature: GYAE6OF02G6ZWF.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatccaccatcctcctgcacgtcggaacccaccaatcggtacgttggtaacttataattctgtctcctcggtaccaacaactaccccggacaaacgtacccccaactcatgattctttggaggtcagtcgagtccggcccgcgtacggggtttctcgtactcgtcctttccgtccggtcctaccgtaacgttccgtcgggacacggccgaccgggtccccttaccccgtacggaaccctacgttcccgttccggttcgggggcccttacccggacgggtccgtacgggaacggggaccgggtacgggtccgttaggttaacttttaacgtttaccgttcgggtaccgacggtccttaccgtaactttaaactaaaccctaaaaactaaaccttaaaacccgttaccgggttttagggggttaccggtttaccgggggtacccgggggtaacccgggtaaacccgtaaaccgttccgggtaccccggttacccgttacccggttaccgtaaccggtaacccccggtaaccgggtccccgttccccgggtacccccccgttacgggttacccctacccgtttccccgttcccgggtttccccccgttacccccccg

SEQ ID NO: 252594 - DNA, 581 bp, Homo sapiens
  misc_feature: GYAE6OF02GN4AW.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatcttgaggtcagtgatcggccgcgagggtttctcatcgcttctccggctccaagtctggcagcacggcctccctgaacccatcctcgtcgggcctaccgaggctggaggacgaggctagacttattactgcagctactataactaacaaacaataaactacgttggggtcgttcgggacggacggaacctaaacgtcgacccgtcctacggtcaccggacccgaacggccttaccggcccccgttacggtaccctaccgtcccttcgttccccctacccc

SEQ ID NO: 252595 - DNA, 715 bp, Homo sapiens
  misc_feature: GYAE6OF02GMK86.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccaccaatgacgttggtacttataattctgtctctgtaccaacaactaccccgacaaacgtccccaaactcatgattcttgaggtcagtgacgtccggcccggctacggggttttctcgtacgtcgtccttcctccggcctaccaagtccgtggcagccaccggccctccctcgaccctatcctcgtcgggcctccgacgggcggtcggggacgacggcttcgtaattacgttagttgtcgtttgttacgtaattcgtcggtacggtagtagttacggtacgggtaccggggttaagggggtttcggttacgggggacggggtaaacggggtaaaccgggtaaacggggttaccggtacccgggttaccggtttacgggtaccggtaacccgggtacccggaaaccgggttcccgtacccgggttacccccccggttccgggttacccgtacccgttcccggtttaccccggttccccccgttccccccg

SEQ ID NO: 252596 - DNA, 699 bp, Homo sapiens
  misc_feature: GYAE6OF02JZ3QQ.49.35.D02.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
  modified_base (300)..(300): a, c, t, g, unknown or other
  misc_feature (300)..(300): n is a, c, g, or t
tcagagtcgagagacacgaccggtgctcgatttagcacacgatagttgggtttggggggggtcgtcgaggaggcagcgctctcgggacgtctccaccatggcctgggctctgctattcctcaccctcctcactcagggcacagggtcctgggcccagtctgccctgactcagcctgcctccgtgtctgggtctcctggcagtcgatcaccntctcctgcnctgaaccacaagtgaccgtttggtacttataattctntctctcggtacacaactacccgacaacgtacccaaactctatnattcttgtaggtcagtagacgtccggcccggcgttacggggtttacctcgagtttccgtcgttcgtccggtacctccgtaaacgttcgtcggactaacgccggtaaccggtcctaccccgtacgaccctacgttccgtacgtcgggtctacccgcgggtctacggggacggacggtaggtcttacgatttacttacgttacgcgtcgacttcgactactaactaaaccgtaactaaacgttacgttagggttaccgttaccggggtacggtccggtaaaccgaacgttcccgtaccgtaccttacccggtacaccgtacccggaacggttcccgtaacccggtccccgttacggttaccccgtacgtttcccggttacccgttaccccggttacccccg

SEQ ID NO: 252597 - DNA, 598 bp, Homo sapiens
  misc_feature: GYAE6OF02FK7RK.49.35.D02.1.454.CMB.1.raw
  modified_base (364)..(364): a, c, t, g, unknown or other
  misc_feature (364)..(364): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctctggtaccaacaataccccggcaaacgtccccaaactcatgatctttgaggtcagtgatcggcccgcaggggtttctcatcgcttctccggctcagtctgcagcnccggcctccctgaccatctcgtcgggtctccgacggctggacgggacgaggctgtaattattacgtgcacgctcataataacaaactaacttaaaccgacgtttagggttcgttaccgggcggaccgggaacctaacgtacgtacccgttaccgtacggtaccaacggacccgaacggtcctccgtacccccgttcggtaccgtaccgttccttcccgttaccccctacccccg

SEQ ID NO: 252598 - DNA, 561 bp, Homo sapiens
  misc_feature: GYAE6OF02FGYCB.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgagtcagtgatcggccgcaggggtttctcatcgcttcctccggctccaagtctggcagcacggcctccctcgacctatctctgggcctccgaggctggaggacgaggctgattattacgtgcagctcatataacaaacactaaactacgttgggtgttccgggcggtaccggaacctaaacgtcgaccgtcctacggtccacggtacccaagggtcctaccgccccgtcgtccactcctccgttcccctaccccg

SEQ ID NO: 252599 - DNA, 570 bp, Homo sapiens
  misc_feature: GYAE6OF02JKOVU.49.35.D02.1.454.CMB.1.raw
  modified_base (449)..(449): a, c, t, g, unknown or other
  misc_feature (449)..(449): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacactaccccgcaacgtccccaaactcatgatcttgagtcagtgatcggcccgcgtagggttctcatcgcttctccgctccaagtctgtcagcaccggcctcccgtgaccatctcgtgggcctcgagtctggacggtacgacggctacgtattactactcgcagtctcgatagactaaanactaaactagttggtgttacggccgggacggtacctaaacgtcgaccgtacctacggtccacgcccaacggtccgcccggtccccttacggcctaccgtcccgttaccgtcccccgtcccc

SEQ ID NO: 252600 - DNA, 553 bp, Homo sapiens
  misc_feature: GYAE6OF02HD1TP.49.35.D02.1.454.CMB.1.raw
  modified_base (345)..(345): a, c, t, g, unknown or other
  misc_feature (345)..(345): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgagtcagtgatcggcccgcaggggtttctcatcgcttcnccggctccaagtctggcagcatcggcctccctgaccatctctgggctccaggctggagacgaggctgattattactgcagctcaattactaacaaacataaaacacgtttgggtgtttccgggcggaccgggaaccaaacgttgacccgtccgtaacgtccacggaccctaacggctccgccccgtggcctacctcctcgttcccccg

SEQ ID NO: 252601 - DNA, 629 bp, Homo sapiens
  misc_feature: GYAE6OF02H4U6F.49.35.D02.1.454.CMB.1.raw
  modified_base (341)..(341): a, c, t, g, unknown or other
  misc_feature (341)..(341): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactcggaaccacaatgacgttgtacttatattctgtctcctggtaccaacaactaccccggacaaacgtccccaaactcatagatctttgaggtcagtgagtccggcccgcgtaggggtttcncagtcgcttctccggctaccaagtctggcagcgacgcctcctgaccatctcgtgggctccgaggcgtaggacggacgaggcgtagatttacttatgactagtctacgaataataacaaaactaacttaaaccgtaacgtttggggtacggtttaccgggaccgggaccggtaaccgaaacgttaccgtacccgttacccgtaacggtccgaaccggtcccgaaacggtcccgtacccgtccccccgtacgggtaccctaaccgtccttaacccgttccccgtaccccc

SEQ ID NO: 252602 - DNA, 561 bp, Homo sapiens
  misc_feature: GYAE6OF02F70D1.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcgaggggtttctcatcgcttctccggctccagtctggcagcacggcctccctgacccatcctcgtgggtcctccgaggtcctggacggacgaggctggtaacttagttacgtgctagctcaatataacaaacaataaacgtacgttgggtgttcgggcggaccggaaccaacgtcgaccgtcgtacgtcacgacccgaaggcctcgccccgtcggtccacttctccgtccctcccc

SEQ ID NO: 252603 - DNA, 656 bp, Homo sapiens
  misc_feature: GYAE6OF02GUZZ2.49.35.D02.1.454.CMB.1.raw
  modified_base (274)..(274): a, c, t, g, unknown or other
  misc_feature (274)..(274): n is a, c, g, or t
  modified_base (329)..(329): a, c, t, g, unknown or other
  misc_feature (329)..(329): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctctgtaccacaactacccgnaacgtccccaaatcatgatctttgagtcagtgatccggccgcgtacgggttttcncacgttccgcctttccgtcccggcttacccgaaggttcctcgggcctaacggccgtacccgggtcccttccccgtagaaccctagtcctccgtacggggtcctcccgagggtcttagggaaacgggccgtacgggtcgttgtaaacgtttacttacgttcgacgtacggttctactaagttaactaaaccaaactaaacgtaacgttacgtttggggtacgttccggggacgggtacccgaaactaacgtccgaccgttcgaccgtcgaaccgccgtaacgccgttaccgccccgtcgtcctacgttcctccgttacccctaccccg

SEQ ID NO: 252604 - DNA, 763 bp, Homo sapiens
  misc_feature: GYAE6OF02HAP0R.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactcggaaccacaatcgacgttgtacttataattctgtctcctgtaccaacaactacccgacaaaccgtaccccaaactcatgtacttcgtttagacggtacagtgacgtccgggcccgacgttacggggtttctacgacgtccgtccttccgtaccggtccttaccgtaacgttcgtcggccacggccgaccgggtcccctcccgtacggaccctacgttaccgttcggtcgggtcctacccggtacggaccgttacgggaacgggaaccgggtcggtcgttaacggttaacgttttaacttacgttcgtaccgtacgtcctaacgtaattaaactaaaccaaaacttaaacgtaaaacgtacggtttacgggggttaccggttaccggggaccggggtaaccggtaaacccgtaaaccgtaccggtacccgttaccggtaaccggttaccgaaccggtacccggaacggtccccgttacccgtccccccggttacggtacccttacccgttacccgttacccggttacccccttacccccg

SEQ ID NO: 252605 - DNA, 564 bp, Homo sapiens
  misc_feature: GYAE6OF02ITJMG.49.35.D02.1.454.CMB.1.raw
  modified_base (281)..(281): a, c, t, g, unknown or other
  misc_feature (281)..(281): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctctggtaccaacaactaccccggnaaacgtccccaaatcatgatcttgaggtcagtgatcggcccgngtaggggtttcncatcgcttcncggctcagtctgcagcacgcctcctgaccatctcgtcggcctccgaggctggacggacgaggctagtattagtactgactacgctacatactaacaaactaactaaacgtcgttgggttcgttcgggaccggacggaaaccaacgtcgaccgtaccgtacgtccgacgacccgaacggcctccgccccgtggtccacgtccgtccgttccccgtcccc

SEQ ID NO: 252606 - DNA, 576 bp, Homo sapiens
  misc_feature: GYAE6OF02FVCBK.49.35.D02.1.454.CMB.1.raw
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtcccccaaactcatgatcttgaggtcagtgatccggccgcgaggggtttctcgatcgtcttctccggctccaagtctggcagcacggcctcctgaccntctcgnggtctcngctgaggacagggggggctgattattacttgactacgctacatactaacaaacaataactacgttagggttggttcggcggacggaaccgtaacgtacgtaccgtaccgtaccgtcgacgacccgaacgtccgtccgtccccgtccggtaccgtacctccgttccgttcccgtccccg

SEQ ID NO: 252607 - DNA, 706 bp, Homo sapiens
  misc_feature: GYAE6OF02JIISV.49.35.D02.1.454.CMB.1.raw
  modified_base (253)..(253): a, c, t, g, unknown or other
  misc_feature (253)..(253): n is a, c, g, or t
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttatatctntctctggtacacaactacccgcaacgtccccaaactcatgatctttgagtcagtgatcggcccgctaggggttctcatcgcttctccgctccgaagtctggctagcaccggcctcccgtcgaccgactccgttcgtcgggtcctaccgacgggctacgggaacggacggacgggtactggtaatttaaccgtttacgtcggtacctaacggtcctctaacgttaacttaaaccgaaaacctaaacgttaaaaccgtacgtttacggggtttacgggttccgggggtaccgggtacccggggtaaaccctaaaaccggttaccggtaccccggttaacccgtacccggtaccggtaaccggtaacccccggtaagggtccccttacccgggtcccccccgttccggggttacccctaccgttccccggttaccgtttacccccccgggtccccc

SEQ ID NO: 252608 - DNA, 562 bp, Homo sapiens
  misc_feature: GYAE6OF02HN8Y5.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatcttgagtcagtgatcggcccgcaggggtttctcgatcgcttctccggctccaagtctggcagcacggcctccctgaccatctctggctcaggctgagcgagctgattatactgcagtctcatactaacaaacaataaacacgtttgggtcgtttacgggcggaccgggtaaccaaccgtggacccgttacctaaccggtcacgacccgaaggcccttaccgcccccgttcggcctaccgtccgttccgttccccgtacccc

SEQ ID NO: 252609 - DNA, 666 bp, Homo sapiens
  misc_feature: GYAE6OF02G3AM4.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccaccaatgacgtttggtacttataattctgtctcctgtaccaacaactacccgacaaacgtcccaaactcatagattcttgagtcagtgactccggccgctaggggtttctacgtagtccgtcttccgtcccggctccgaagttctaggcacgcacggccctcccgttcgacctattcctcgtcgggcctcccgaggtcgtggacggacgaggcgtagtactttacttacgtcgcaacgtctcgtaactaactaacaaaacctaactaaaacctacgtttacgggttacgggttaccgggaccgggtaaccggaaaccgtaaaccgtacggtacccgttaccgtaaccggttaccgaaccggacccggtaacggtcccgttccggtaccccccgttacggtccctacccgtttaccggttcccgttccccgttcccccg

SEQ ID NO: 252610 - DNA, 588 bp, Homo sapiens
  misc_feature: GYAE6OF02FPWY9.49.35.D02.1.454.CMB.1.raw
  modified_base (371)..(371): a, c, t, g, unknown or other
  misc_feature (371)..(371): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccaccaatgacgttggtacttataattctgtctcctggtaccaacaataccccggcaaacgtccccaaactcatgactctttgaggtcagtgatcggccgcgaggggtttctcatcgcttctccggctccgaagtctggcagcncgtcctccctgaccatctcgtgggcctccgaggtctggaggaccgagggctaggtattattacgtgcagcgtcatacaacaaacactaaactacgttgggttcgtcgggccggtacgggaacccaaacgtcggacccgtccgtacgtccgacgaccccggaacgtccgtacccgtcccccgtcggtacctaccgttccgtcccgttcccgtcccccg

SEQ ID NO: 252611 - DNA, 538 bp, Homo sapiens
  misc_feature: GYAE6OF02FGIWH.49.35.D02.1.454.CMB.1.raw
  modified_base (335)..(335): a, c, t, g, unknown or other
  misc_feature (335)..(335): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccaccaatgacgtttggtacttataattctgtctcctggtaccaacaataccccggcaaagtccccaaactcatgatctttgagtcagtgatcggccgcaggggtttcncatcgcttctccggctccaagtctggcagcacggcctccctgacccatctctgggctccgaggctgaggacgaggctgattattacngcagcctanatactaacaacaataacattgggtgttcgggcggcggaacaaacgtcgaccgtcctacgtcacgcccaacggcctcgcccccgtcgtccactcctcgtccctacccc

SEQ ID NO: 252612 - DNA, 564 bp, Homo sapiens
  misc_feature: GYAE6OF02H3GT3.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaatacccggcaaagtaccccaaactcatgatctttgagtcagtgatcggcccgcaggggtttctcatcgtcttctccggctccaagtctggcagcacggcctccctgcctactctctcgggctccagcttcgaggacgaggctgattacttactgcagcctacataactacaaaactaactaaacactttagggtcgtttacgggccggacggacccaaacgtcgaccgtccgtacgtcacgcccgaaggtcctacggcccccttcggtacctaccgttctccgtcccctacccc

SEQ ID NO: 252613 - DNA, 733 bp, Homo sapiens
  misc_feature: GYAE6OF02JVIC7.49.35.D02.1.454.CMB.1.raw
  modified_base (200)..(200): a, c, t, g, unknown or other
  misc_feature (200)..(200): n is a, c, g, or t
tcagagtcgagagacacgaccggtgctcgatttagcacacgatagttgggtttgggggggtctcgaggaggcagcgctctcgggacgtctccaccatggcctgggctctgctattcctcaccctcctcactcaggcacgagggtcctgggcccagtctcgccctgactcagcctgcctcgtcgtctggtctccgtggacngtcgatcaccatcctctgcacgtgaaccacaatgacgttgtacttatatcgtgtctctcgtacaacactacccgacaacgtcccaaactcatcgtactcgttagacgtcgacgtcgtacgtccggcccgtcgtacggggtttcctcacgttcgtccgttcctccgggacttccgaaacgttccgtaggtccgacggtaccgaccggtcccgttacccgtcgaaccctacgttccgtaaccggttccggtacccgtaacccgtacgggtcccgttaacgggggaccgggaaccgggtacgggtaccgttacggttaactttacgtttaaaccgtcgtacgtaccgtaaccgtactaactaacttaaacgaaaccttaaagtaaaccgttacgttcggggttaggttaccgggtaccgggaccggtaaaccgtaaccgtaccgtacccgtacgtaccggtcgtaacccgcgtaaacggtcccgtaaccgtcccccgttacggtacctcccttacgttccccgtccccttaccccg

SEQ ID NO: 252614 - DNA, 557 bp, Homo sapiens
  misc_feature: GYAE6OF02GKVDS.49.35.D02.1.454.CMB.1.raw
  modified_base (430)..(430): a, c, t, g, unknown or other
  misc_feature (430)..(430): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatcttgaggtcagtgatcggccgcgagggtttctcatcgcttctccggctccaagtctggcagcacggcctcctgaccatcctctgggcctccacggctggaggacgaggctgtattacttactgcagctnatataacaaacaataaacctacgttgggttgttaccgggcggaccggaacaaacgtcgacccgtcctacgtcacgacccgaaggcctacgcccccgttcggtccacctcctcgttcccctacccccg

SEQ ID NO: 252615 - DNA, 520 bp, Homo sapiens
  misc_feature: GYAE6OF02IFQ2T.49.35.D02.1.454.CMB.1.raw
  modified_base (335)..(335): a, c, t, g, unknown or other
  misc_feature (335)..(335): n is a, c, g, or t
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttcnctatcgcttctccggctccaagtctggcagcacggcctcctgaccatctctggcctccgaggctagaggacgaggctagatttattacgtgacagtctcatatgcaggcagcaataattttgngtatagttcggnggacggacgaagctgaccgtctaggtcacgaccaggctccgcccgtccgg

SEQ ID NO: 252616 - DNA, 563 bp, Homo sapiens
  misc_feature: GYAE6OF02JK82R.49.35.D02.1.454.CMB.1.raw
  modified_base (229)..(229): a, c, t, g, unknown or other
  misc_feature (229)..(229): n is a, c, g, or t
  modified_base (419)..(419): a, c, t, g, unknown or other
  misc_feature (419)..(419): n is a, c, g, or t
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnccaaatgacgttggacttataattctgtctcctggtaccaacaactacccgcaaacgtccccaaactcatgaacttcttgaggtcagtgactcggcccgcgtcggggtttctcatccggcttcgtccgctccaagtctggctagcacgcctccctgaccatctcgtgggctccgaggtctggacggacgnggctgacttattactgcacgctacatacgtacaaacataacacgttaggtcgtacggcggtcggacaacgtcgtacctccgtcgacgacgccgaacggcgttccgccccgtacggtccaacgttcgttcccgttcccgtacccc

SEQ ID NO: 252617 - DNA, 681 bp, Homo sapiens
  misc_feature: GYAE6OF02G5MDI.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctgtaccaacaactaccccggcaaacgtccccaaactcatgatcttgagtcagtgatcggcccgcgtaggggtttctctatcgcttctccggctccaagtctggcagcacggcctcctcgacctatctcgtggcctccgaggtcgtggacgggtacgacggtctaggtaactttacgttacgttggacctacggtacctacgtaataacctaaacctaaaactaaacgttaaaaccgtaccggtttaggggttacggttaccgggggtacccggggtaccgggtaaacccgtaaaccgttcggtaccccgttacccgtaaccggtaccgaaccggtaccccgaacgggtcccgttacccggtaccccccgttacgggttaccctaacccgtttcccgttacccggttcccccttaccccccg

SEQ ID NO: 252618 - DNA, 527 bp, Homo sapiens
  misc_feature: GYAE6OF02ITXED.49.35.D02.1.454.CMB.1.raw
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcgaggggtttctcatcgcttctccggctcaagtctggcagcacggcctccctgaccatctctgggcctccaggctggacggacgaggctgattatactgcagctnatntgcagcganctaacttatttgtagattagttcgggcggaaggaccaaggcctaggaccgtcgtacggtcacgcccaaggtcctaccgccccgtcgg

SEQ ID NO: 252619 - DNA, 665 bp, Homo sapiens
  misc_feature: GYAE6OF02I0LKY.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcactgaaccacaatgacgttgtactataattctgtctcctggtaccaacaactaccccggcaaacgtaccccaaactcatgacttctttggaggtcagtgactcggcccgcgtagggtttctcatcgcttccgtccggctaccgtaagtcgtggcagcgaccggtcctccctggaccctactctcgttcggggccttccgacggtctacggacgggacggtacggccgtagggttaacctttacttaacgtcgacgtacggtacctacgtaatacttaaaccaaaacttaaactaaaacgtaacgtttggggtacgttcgggtccgggaaccgggaacctaaacgtccgtaccggttacctaaccggtccggaacgtacccgaaacggtccgtacccgtcccccgttacggtaccctaccgttacccgttccgttacccccgttcccccg

SEQ ID NO: 252620 - DNA, 664 bp, Homo sapiens
  misc_feature: GYAE6OF02J0YQ7.49.35.D02.1.454.CMB.1.raw
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
  modified_base (445)..(445): a, c, t, g, unknown or other
  misc_feature (445)..(445): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcnctggaacctacaatgacgttggtacttanattctgtctctgtacaacaactacccggcaacgtcccaaactcatgattcttgaggtcagtgtatcggccgtacgtaggggttctcgactcgcttcgtccgctcctaagtctggcagtcacggcctccctcgaccactcctcgtcgggccgtccagggctggacggtaacgcggtccgtgttaacttacgtttaacngtacccgagtccttacaattaactaaacgtaaaacctaaacttaaaaccgtaacggtttacgggttacggtttacccgggtacgggtaacccgggaaccgttaaacgtaccgtacccggttaccgtaacccggtcgtaaccggtaacccgaacggtcccgtaccggtaccccctacgggtaccctaccggtttacccttccggttaccccgttcccccg

SEQ ID NO: 252621 - DNA, 654 bp, Homo sapiens
  misc_feature: GYAE6OF02GNV9W.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggccgcaggggttctcatcgcttctccggctccaagtctggcagcacggcctccctgacccatctcgtcgggcctaccaggcctggacggtacggagggctaggtaatttattacgtgccagtccgtactataactaaccaaaactaacttaaaaccgtacgtttacgggttacggttaccggggaccgggtaaccgggaaaccgtaaaccgttcgggaccccggttaccgttaccggtcaaccggtccccctaaaggggtccccttaccggacccccccgttacgggtacccctacccgtttaccggtttcccgttaccccccgtaaccccccg

SEQ ID NO: 252622 - DNA, 737 bp, Homo sapiens
  misc_feature: GYAE6OF02GH9KK.49.35.D02.1.454.CMB.1.raw
  modified_base (306)..(306): a, c, t, g, unknown or other
  misc_feature (306)..(306): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccggtgtcgtgggtctcctggacagtcgatcaccatctcctgcactggaaccaccaatcgtacgttggtaacttataattctgtctcctgtaccaacaacgtaccccgacaacgtaccccaaactcatnacttcttggaggtctagtgacgtccggcccgcggtacgggtttcatacgtccgtccttccgtcccggtacctacccgtaagttcgtcggacctaggaccctaccggtccctacccgtcgaaccctactccgtcggtcgggtcctccggaaggtccgtagggacggaccggtaacgtcgtagtatttaacttacgtacgtacgtacgtaccgtactaaacgttaactaaaacctaaaacgtaaacttaaaccgtacgggttttacgggtaccgggtttaccgggtccgggtaaccgggtaaacccgtaacgtacccggtacccgttaccggtaccgtaaccgaaccggtaacccgtaaccgggtcccgttacccggtccccccgttacgggttcccacccgtttaccgttccccgtttacccccttaccccg

SEQ ID NO: 252623 - DNA, 534 bp, Homo sapiens
  misc_feature: GYAE6OF02F2HAY.49.35.D02.1.454.CMB.1.raw
  modified_base (372)..(372): a, c, t, g, unknown or other
  misc_feature (372)..(372): n is a, c, g, or t
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccaccaatgacgttggtacttataattctgtctcctggtaccaacaataccccggcaaagtccccaaactcatgatctttgaggtcagtgatcggccgcaggggtttctcatcgcttctccggctcaagtctggcagcacggcctccngaccatctgtgggctcaggctgaggacgagntgattattactgcagctacataanaacaaacataaacgacttgggtacgttcggcggacggaccgaaactcgaccgtctacgtcgacgaccgagccgtcgccccgtcggtccactcctacgtccctccccg

SEQ ID NO: 252624 - DNA, 583 bp, Homo sapiens
  misc_feature: GYAE6OF02HJJLA.49.35.D02.1.454.CMB.1.raw
  modified_base (340)..(340): a, c, t, g, unknown or other
  misc_feature (340)..(340): n is a, c, g, or t
  modified_base (367)..(367): a, c, t, g, unknown or other
  misc_feature (367)..(367): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccacaatcgacgttgtacttatattctgtctctggtaccaacaactaccccggcaaacgtccccaaactcatgacttcttgacggtcagtgatccggccgcgtacgggtttcncactcgtcttcgtccgctcagtctgcngcacggcctcctgaccatctcgtcggtcctccgaggtcgtgacgggacgaggtctagtacttatcgtgcgcgtctcatactaacaaactaataaacgtcgttgggtcgttacgggcggaccggaacctaacgtcgaccgttctaccggtcacggacccaacggtccctccggaccccttcgggtacctaccgtaccgtttccggtacccctccccg

SEQ ID NO: 252625 - DNA, 670 bp, Homo sapiens
  misc_feature: GYAE6OF02GRKOH.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttataattctgtctctgtaccaacaactaccccggacaaacgtccccaaactcatgatcttgaggtcagtgagtccggcccgcgtacggggtttctcgatcgtcttcctccggctcctaagtctggcacgccgacggccctcccgtacgacctactccgtcgtcgggcctccgaggcgtcggacggacgaggctaggtacttacttacgtgacgacgtcctactaataactaacaaactaacttaaaccgtacgtttacgggttcggttaccggggccgggtaccgggaaacctaaccgtaccggtacccgttacccgttaaccggtaccgaacccggtacccggtaaccgggtcccgttacccggtccccccgttaccgggttaccctacccgtttcccggttccccggttcccccggtcccccc

SEQ ID NO: 252626 - DNA, 731 bp, Homo sapiens
  misc_feature: GYAE6OF02H6P5V.49.35.D02.1.454.CMB.1.raw
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccaggtcccgggtccagctggtgcaatcgtggggctgaggtgagaaagcctgggtcgtcggtgaggtctccgtgacgaaggcttcgnggacactacctacaactactttcgctgtcngcgtgggtgcgacgacggccccgtaggacaacgggccttggacggtgggggtagggaacggtactacccgtacccctacttacttaacgtatacggacctaaaacttgtacgacctacgaacgtacctaaccgttacccgaaccgactaacggaacgttaccctaacccgtttacgacccggtaaccgggaaactaaaccgtaccgaaaccgaaacccgtagaaccgtacccgttaaaccgtacgttaacggtaaacgtccggaacggaccgtaacccggtaccgtaacgggtacttccggaccgaccggtaacccgaccgggttaacccgttatttaacgtttccgtacggtcggaaccggtaggaccgggtaagttgttaccgttacgttttaccgaagttacgttagttaacgttaaccgttaggtttactacgtttgtaccgg

SEQ ID NO: 252627 - DNA, 634 bp, Homo sapiens
  misc_feature: GYAE6OF02JF42D.49.35.D02.1.454.CMB.1.raw
  modified_base (200)..(200): a, c, t, g, unknown or other
  misc_feature (200)..(200): n is a, c, g, or t
  modified_base (252)..(252): a, c, t, g, unknown or other
  misc_feature (252)..(252): n is a, c, g, or t
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactgaaccacaatgacgttgtacttatattctntctcctgtaccaacaactacccggcaaacgtccccaaactcatgatctttgaggtcagtgactcggcccgcgtaggggtttctctacgtcgtccttccgtcccggtctcccgtaacgtctcggcacggaccaccgggtccctcccgtcgaccctacttccgtcgtcggggtccctccgacgcgtacggagggtacggaggcttcggtatttacttactacgctacggctactatactaacaaactaataaacgtacgttcgggttacggttcggaccgggaccgggaacctaacgtacggtacccgttactaccggtacaccgtaccgaccggtaccgtcccgaccccgttcgcctaccttccgttctcccccgttaccccg

SEQ ID NO: 252628 - DNA, 606 bp, Homo sapiens
  misc_feature: GYAE6OF02H6BQQ.49.35.D02.1.454.CMB.1.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
  modified_base (427)..(427): a, c, t, g, unknown or other
  misc_feature (427)..(427): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacngtcgatcaccatctcctgcactcggaccacaatgacgttgtacttataacttntcgtctcctaggtaccaaacaactaaccccggacaaacgtaccccaaactcaatnatcgtttgaggtcagtgatccgcccgtgtcggggttcncatcgcttcgtccgctcctaagtctggcngccacggtccctccncgtccctctcgtcggtctccgacggccggtggacgnggctgtattactacgtgccgtctacataataaccaaacaaacctaattaggtttgggttcggtacgggtacggacggaccgtaacgcgtacgaccgtccgtacgtccgacgcccgaacggtccgcccgtaccccgtcgttaccgaccttcccgttccggttccctccccttcgttcccc

SEQ ID NO: 252629 - DNA, 783 bp, Homo sapiens
  misc_feature: GYAE6OF02JJ8JE.49.35.D02.1.454.CMB.1.raw
  modified_base (272)..(272): a, c, t, g, unknown or other
  misc_feature (272)..(272): n is a, c, g, or t
tcagagtcgagagacacgaccggtgctcgatttagcacacgatagttgggtttggggggggtcgtcgaggaggcagcgctctcgggacgtctccaccatggcctgggctctgctattcctcaccctcctcactcaggcacaggtcctgggcccagtctgccctgactcagcctgcctccgtgtctgggtcctccgtaggcagtcgatccacatctcctgcacgtggaacccacaatcgacggttagtacttatattctgtctcgtgaccaanactacccggacaacgtccccaaactcatgtacttcttggtaagctagtgtaccggtccggccgaacggtttggtttccgacttacggtcctccgtttaccggtcccgtaccgttacgtaacgttccggtggacgacgacccgggtaacccgttccccgtccgtaaccgaccttaccgttccgtttaccgggtccggttccctaccggacggtttacgggaacgggaccggtaaccgggtaacgttcggttaaacgttacgtttttaactaccggttggctacgtacccttaacttacgttaaaacaaacctaaaacctaaacttaacgttaccggggtttagggttccggttacccggggaccgggaccccgtaaaaatccgttaacccggtcctaaccggttaccgtaaccggcccttaaaacggggtccctaccgggtccccccgtttaccccgggtacccggtttatccccgttttaccggtttacccccggtcccccttaacccccg

SEQ ID NO: 252630 - DNA, 560 bp, Homo sapiens
  misc_feature: GYAE6OF02FPYFX.49.35.D02.1.454.CMB.1.raw
  modified_base (368)..(368): a, c, t, g, unknown or other
  misc_feature (368)..(368): n is a, c, g, or t
  modified_base (455)..(455): a, c, t, g, unknown or other
  misc_feature (455)..(455): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccacaatgacgttggtacttataattctgtctcctggtaccaacaataccccggcaaacgtccccaaactcatgatctttgaggtcagtgatcggcccgcgaggggtttctcatccgtcttctccggctccaagtctggacngcgaccggcctccctagaccctagtcctcgtcgggtctccgaggcctggaggacgaggcgtgtattattacgtgcacgtctacatanaaacaactaataactgttggtggttccggcggaccggactaagcgtaccgtctacgcacgaccgaacgtctccgacccgtcgtactcctcgtccgtccccgtccc

SEQ ID NO: 252631 - DNA, 837 bp, Homo sapiens
  misc_feature: GYAE6OF02ILDMF.49.35.D02.1.454.CMB.1.raw
  modified_base (260)..(260): a, c, t, g, unknown or other
  misc_feature (260)..(260): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatcctcctgcacgtcggaaccacaatcgacgttggtacttataacttctntctcctggtaccaaacaactaccccggacaaacgtccccaactcatgtatctttagacggtcaggtcgacgtccggcccgtcggtacggggttttcctacgtacgttccgtccgttccgtcccggtaccttacccgtaaacggttccgttacgggacctaacgggacccgtaaccccgggtcccttaaccccgtacggaacccttacgttccgtttccggttcggggtaccgtccccgtaacggggtcccggttaacggggaaccgggtacgggtaaccgggtcgttaacggttaactttttaacgttaccgttaacggtaccgtaacgtaccgttaaccgtaactaaacgttaaaccctaaaacgtaaaccttaaaccggtttaacggtttcggggtttacggttacccggggtcggggtaacccgggaaacccgtaaccgttaccgggttaccccgtaacgttaccccggttaacgacccgtaacccgggtaaccggtacccttccccggttaccccccggttccggttaacccttacccggttcccgtttaccccgttcccccgttaacccccg

SEQ ID NO: 252632 - DNA, 533 bp, Homo sapiens
  misc_feature: GYAE6OF02FGLP1.49.35.D02.1.454.CMB.1.raw
  modified_base (421)..(421): a, c, t, g, unknown or other
  misc_feature (421)..(421): n is a, c, g, or t
  modified_base (448)..(448): a, c, t, g, unknown or other
  misc_feature (448)..(448): n is a, c, g, or t
tcagagtcgagagacacgaccggtgctcgatttagcacacgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggatagtcgatcaccatctcctgcactggaaccaccaaatgacgttggtgattataactatgtctcctggtaccaacagtacccaggcaaagcccccagactcatgattatgcgtcagtaagcggcctcagggtcctgatcgcttctctggctcaagtctggcaacgacggcctccctgaccgtctctgggctccgggctgaagatgaggctgattattctgcagctnatatgcaggcagacaaactaattttgngtatacttcgggacggtaggggaaccaaggtactcgtacccggtccgtaacggtccaacggcccaaacggcgtacgtaccccccg

SEQ ID NO: 252633 - DNA, 653 bp, Homo sapiens
  misc_feature: GYAE6OF02JBM8B.49.35.D02.1.454.CMB.1.raw
  modified_base (407)..(407): a, c, t, g, unknown or other
  misc_feature (407)..(407): n is a, c, g, or t
  modified_base (437)..(437): a, c, t, g, unknown or other
  misc_feature (437)..(437): n is a, c, g, or t
  modified_base (506)..(506): a, c, t, g, unknown or other
  misc_feature (506)..(506): n is a, c, g, or t
  modified_base (527)..(527): a, c, t, g, unknown or other
  misc_feature (527)..(527): n is a, c, g, or t
  modified_base (539)..(539): a, c, t, g, unknown or other
  misc_feature (539)..(539): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctcgccctgactcagcctgcctccgtgtcgtgggtcctccgtggacagtcgatcacactctctcgacacgtacggaaaccacctaaagtcggtacggtttacggttaacctttaaattaactttcctcgttcctaccgtacggtaacccaaaccgaaacctaaccccggaactaaaaccgtacccctaaactacactacgtacttcgttacgagtcgagttcgacgtccggtaccgcgttacgggttccncgtactccgtcgtcgtccgtctacacgtcngtcacgcgacccgtcctacctagacctacgtcgtacgcggtccgtcgacggtcgtaacgggcgaacggnggtactagtacttacttacgngacgagtcttanataacaacgaactaacgtaacgtggttcggtacgtcgggacgacggtaacactcgacctactcgtacacgcgacgtcctccgtaccgtcgcctactccgttaccgtccctcccg

SEQ ID NO: 252634 - DNA, 809 bp, Homo sapiens
  misc_feature: GYAE6OF02HNU3T.49.35.D02.1.454.CMB.1.raw
tcagagtcgagagacacgaccggtgctcgatttagcacacgatagttgggtttggggggggtctcaggaggcagcgctctcgggacgtctccgaccatggcctgggctctgctattcctcaccctcctcactcagggcacagggtcctggcccagtctgccctgactcagcctgccctcgtgtcgtgggtcctccgtggacagtcgatccaccatcctcctgcacgtcggaaccactaagtcgaaccgttggtaaccttaataacttcgtgttcctaccgtggtaacccaaacgaaccgtaaccccggactaaaaccgtacccccaaaactcaatgaacttctttacggacggtactaggtagtacgtacccggcccgacggtacggggtttacctacgtacgttccgtaccttccggtacccggtaccttacccgtaaacggttccgtacgggtaccgaacggccgtaacccggtcccctacccgtacggtaaccctacgttcccgttcggtcggaccttacccggacggtccgtacggaacgggtacgacgggtacttggtaaactttacgttacgtacggtctaacgccgttaactagttaaacctaaacgtaaaaccttaaacgttaaaaccgtcgggtttaacggggttaccgttaccggggaccgggtaacccgggtaaacctaaccgttccgggaaccccgttacgttaaccggtacgaaccggtacccgtaacggtaccccgtacccgtacccccggtttccgtacgttacccttccggttacccgggttcccctaccccg

SEQ ID NO: 252635 - DNA, 611 bp, Homo sapiens
  misc_feature: GYAE6OF02IK4DD.49.35.D02.1.454.CMB.1.raw
tcagagtcgagagacacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttagggaattattaaccttttctcctggtaccaacaacaccaggcaaacgcccccaaactcatcatttatgaggccgatcgagccggccctcgagggtctctgactcgcttctcgtcggctccgacgtcgtcggcacgcaccgtccctccgtagactactccgtcgtcgggtcctccgaggtcggtacggggacggaggtccgttagtactttagttagttcggtcttgttctattacgtcggtacggttgtagttaggtcgggtaccggtaaggggttcggttacgggcgggtaacgggtaacgtaagggtacgtaccggttaccgtaggtaccgacggacccgtacggccgtaccgtcccccgtcggtaccc

SEQ ID NO: 252636 - DNA, 597 bp, Homo sapiens
  misc_feature: GYAE6OF02GYGNP.49.35.D02.1.454.CMB.1.raw
  modified_base (274)..(274): a, c, t, g, unknown or other
  misc_feature (274)..(274): n is a, c, g, or t
  modified_base (574)..(574): a, c, t, g, unknown or other
  misc_feature (574)..(574): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcgaaccacaatgacgttgtacttatattctgtctctgtaccacaactacccgnaacgtcccaactcatgatcttgagtcagtgacgtccggccgcgtaggggtttctcgtactccggtccttcgtcccggtctacccgtaagtcgtcggcaggccgtaccggcctcccgtgacctacttcctcggtcggcctccgaggccgtaggacggaggacgcgtagtattactacgtgcacgtctactataacgtaacaaactactaacgtgttagggtcgttacgggcggtaccggaactaacgtcgtaccgtacgtaccgtcgaccgaccgaacggtcccgtcgtcccctcggtacnccgttacctccgtccccgtcccg

SEQ ID NO: 252637 - DNA, 526 bp, Homo sapiens
  misc_feature: GYAE6OF02GEDAU.49.35.D02.1.454.CMB.1.raw
  modified_base (523)..(523): a, c, t, g, unknown or other
  misc_feature (523)..(523): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcgacaaactccacgaacacacgcctacatcggaactgcgcacgcctaggactcgtacgccgacaccggtccgttaattctttctgtgaccgagagagtatcgttctttctatgtacttagtacttagtctagttntcg

SEQ ID NO: 252638 - DNA, 571 bp, Homo sapiens
  misc_feature: GYAE6OF02GKM1G.49.35.D02.1.454.CMB.1.raw
  modified_base (310)..(310): a, c, t, g, unknown or other
  misc_feature (310)..(310): n is a, c, g, or t
  modified_base (462)..(462): a, c, t, g, unknown or other
  misc_feature (462)..(462): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaaccaccaatgacgttggtgaattataactatgtctcctggtaccaacacgtaccaggacaaacgccccagactcatgtattangcgtcagtaacgcgccctcgacgggtcctgatcgcttctctcggctaccaagtcgtgacaacacggcctcccgtcgtaccgtcgtcgtcgggtccgtccgggctagaagagtgacgctagtactttattcgtgactagctacattagtcgangactacgactaaactagtttagtagtattacgtacggacggacggtaacaacgcgtacggtaccgtacgtacggacgaaccgaccgtaacggtccgtaccgtacccccg

SEQ ID NO: 252639 - DNA, 639 bp, Homo sapiens
  misc_feature: GYAE6OF02IJQBL.49.35.D02.1.454.CMB.1.raw
  modified_base (199)..(199): a, c, t, g, unknown or other
  misc_feature (199)..(199): n is a, c, g, or t
  modified_base (250)..(250): a, c, t, g, unknown or other
  misc_feature (250)..(250): n is a, c, g, or t
  modified_base (394)..(394): a, c, t, g, unknown or other
  misc_feature (394)..(394): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacgaggtcctgggcccagtctgccctgactcagcctgcctccgtgtctgggtctcctggacngtcgatcaccatctcctgcacgtgaaccacaatgacgttgtactatattcngtctctgtaccaacaactacccggacaaacgtacccaaactcatgtatcttagagtcagtagactcggccgcgtacggggtttctacgtagtcgtcttccgtcgtcctccgtaagtcgtggcagcgaccgtcctccctagaccnctcgtcgtcgggtctccgacggtcgtacggacggacggtacggcgttagtaactttacgttaaccgtcgtcgtaacggtccttactaacgtaactaaacgtaaaactaaacgtaaacttacggttacgggtacggttcggacgggtacggaaaccgaacgttaccgaccgttaccgtcgtaacgaccgtaccgacgtccgtacccgtccgtccgtactacccgttcgtacccgtccccgttcccg

SEQ ID NO: 252640 - DNA, 596 bp, Homo sapiens
  misc_feature: GYAE6OF02I1QFB.49.35.D02.1.454.CMB.1.raw
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtactatatctgtctctaggtaccaactactaccccgactaaacgtaccccaaatcaatgaacttcttaggagttcgaagttgacgtccgggccccgtgtacgggtttctacctagtccgtcttcgtccggcttaccgaagttccgtgacacggccgtaccggtccctcctgaaccctgtcctgtcggctacgcggctggacggtcgagctgtacttnttacgngctagctnatacaacaatacgaactagttggtcgtggaccggacgtaaccaacgtcgtaccctacgtacgtccgacgccgaaggtcccgtaccgtccccgtaggtaccctacgtactcccggtacccctacccg

SEQ ID NO: 252641 - DNA, 572 bp, Homo sapiens
  misc_feature: GYAE6OF02FGLV7.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccaccaatgacgttggtacttataattctgtctcctggtaccaacaataccccggcaaacgtccccaaactcatgatctttgaggtcagtgatcggccgcaggggtttctcatcgcttctccggctccaagtctggcagcacggccctccctgaccatcctcgtcgggcctccgaggctggacggacgaggctggtattattactgcagcctcattaactaacaaacaataaaccacgttgggtcgttcgggcggacggaccaacgtcgaccgtccgtacgtccgacgacccgaacggtccgtaccgcccccgttcggtcctacgtccgtccgttcccctaccccg

SEQ ID NO: 252642 - DNA, 657 bp, Homo sapiens
  misc_feature: GYAE6OF02FXJV6.49.35.D02.1.454.CMB.1.raw
  modified_base (407)..(407): a, c, t, g, unknown or other
  misc_feature (407)..(407): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactaccccggacaaacgtcccccaaactcatgattcttgaggtcagtgatccggcccgcgtagggtttctcatcgtcttctccggctccagtctggcacgcgaccgtcctccctgaccatctcgtcggcctccgnggcgtggacggaccggagggtcctagtactttacgttacgtcgacgagtcctactaagtaactaaacaaaactaactaaacgtacggtttagggttcggttaccggggtccgggacccgggtaacctaaaccgttccgtacccgttacccgtacggtacccaacccggaccccgtaacggtcccgtacccggtcccccccgttaccgggtaccctaccgttcccgttcccggttaccccccgttcccccg

SEQ ID NO: 252643 - DNA, 685 bp, Homo sapiens
  misc_feature: GYAE6OF02GP36G.49.35.D02.1.454.CMB.1.raw
  modified_base (252)..(252): a, c, t, g, unknown or other
  misc_feature (252)..(252): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccacaatgacgtgtacttatattctntctctggtaccaacaactaccccggcaaacgtccccaaactcatagattctttagaggtcagtgactcggcccgcgtaggggtttctcatcgtcttctccggtctccagtcgtcggcacgcgaccggcctcccgcaccactcctacgtcggcctaccgacggtcgtacgggaacggtaccggaaggtcgtacggttaacgttttacttaacgtcgtaccaaggttccgtactaaactttaactaaaccgaaaacttaaccgtaaaaccgttcggtttaacggggtttacggttaccggggaccggggtaaccggtaaacccgtaaaccgtccggtaaccccgttaccgtacggtaccgaaccgtcccgaacggtcccgtacccgtacccccgttcggtacccgtaccttccgttacccgttacccctaccccc

SEQ ID NO: 252644 - DNA, 539 bp, Homo sapiens
  misc_feature: GYAE6OF02I3S48.49.35.D02.1.454.CMB.1.raw
  modified_base (250)..(250): a, c, t, g, unknown or other
  misc_feature (250)..(250): n is a, c, g, or t
  modified_base (450)..(450): a, c, t, g, unknown or other
  misc_feature (450)..(450): n is a, c, g, or t
tcagagtcgagagacacgaccggtgctcgatttagcacacgatagttgggtttgggggcatcacataacaaccagattcctcctctaaagaagccccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttcnggagaccaccttcaacaactttgctgtcagcgtgggtgcgacaggcccctggacaagggtccttggaggtggggtgggaaggatccgaccccttatccttaatatagactaaactatgacacgagactacttaccagacagtactccaccttactccgcgaacaactccaacgaacacacgcctaacagtggaactgcgnacgctagatcacgccgacgacggcctattactttctagtcgcgagagaggattcttcttactatagattacgttacagtctagttatcg

SEQ ID NO: 252645 - DNA, 805 bp, Homo sapiens
  misc_feature: GYAE6OF02HE0RO.49.35.D02.1.454.CMB.1.raw
  modified_base (313)..(313): a, c, t, g, unknown or other
  misc_feature (313)..(313): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctctggtaccaacaataccccggacaaacgtccccaaactcatgatctttgaggtnagtgatccggcccgcgtacggggtttctcgacttccgtcttccgtcccgggtccttaccccgtaaagttccgtgggacctacggccgtaacccgggccccttaccccgtacgaccctaactccgtttccgtcggggtccctacccggaggtcgttcgggaacgggtaccggtagggtaccgttaggttaactttaacgtttaccgtacggacctacgtaccgttaactaacttaacgtaaaaccctaaaacgtaaacgttaaaacccgtacgggttttaccgggggttacggtttacccgggggaaccggggtaacccgggtaaaacccggtaaaccgttaccggttaaccccggttaccccgtttaccgggttaacccgaaccggtaccccggtaaaccgggttcccggttaccccggttcccccccggtttaccgggttaccccgtaaccgtttccccgtttacccggtttccccccccggttacccccg

SEQ ID NO: 252646 - DNA, 634 bp, Homo sapiens
  misc_feature: GYAE6OF02FR1AH.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccacaatgacgttggtacttataattctgtctctgtaccaacacacccggacaaacgtccccaaactcatgatctttgaggtcagtgacgtccggccgcgtagggtttctcatcgtcttcctccggtctaccgtaacgtcgtcggcacgtccgaccggccctccctagaccctacgttcctcgtcgggtcctccgacggtcgtcggacggacggacggtcgtagtattacgttactcgacgacgtactactaatacgaaacctaaactaactaaacctacggtttcgggtacggtttccgggaccgggtaaccggtaaccaaacgttccgacccgttccgtacgtcaccgacccgacgccgtcccgccccgttccgtaccgtacccttccttcccgtcccctacccc

SEQ ID NO: 252647 - DNA, 659 bp, Homo sapiens
  misc_feature: GYAE6OF02GVZ8J.49.35.D02.1.454.CMB.1.raw
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgcactacgaaccacaatgacgttgtacttatacttctgtctccgtggtaccaacaactaccccggacaaacgtccccaaactcatgactctttagaggtcagtgacgtccggccgcgtagggtttcnctatcgtcttctccggtctaccgaagttcncggcacgcgaccgccctcctgacctatcctcgtcggtcctaccgaggtctaggacggacggaggtctagtaatttacttacgtcgacgtacgtcctactaactaactaaaccaaaactaacgttaaaccgtacggtttggggttacgttaccggggaccgggtaccggaaacccgtaacgtccggtacccggttccgtaacggtccgaaccggtacccgaacggtcccgtacccggcccccgtttcggtacctacccgtttcgttcccggttaccccttacccccg

SEQ ID NO: 252648 - DNA, 548 bp, Homo sapiens
  misc_feature: GYAE6OF02F501T.49.35.D02.1.454.CMB.1.raw
  modified_base (435)..(435): a, c, t, g, unknown or other
  misc_feature (435)..(435): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggccgcaggggtttctcatcgcttctccggctccaagtctggcagcacggcctccctgacccatcctcgtcgggcctccaggctcggaggaccggaggccgtggattattacttgcngctacatactaacaaactataaacagttgggtcgttcgggcggacgggaccaaacgtcgaccgtcctacgtcacgacccgaagctcgcccctgtccactctccgtccctaccc

SEQ ID NO: 252649 - DNA, 726 bp, Homo sapiens
  misc_feature: GYAE6OF02I812X.49.35.D02.1.454.CMB.1.raw
  modified_base (286)..(286): a, c, t, g, unknown or other
  misc_feature (286)..(286): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatcgacgttgtacttataattctgtctcctaggtaccaactaactacccccgganaaacgtccccaaactcatgtattctttgaggtcagtgactcggcccgtcgtagggtttctacgattccgtcttccgtccggctaccgaacgttcgtacggctagccgaaccggtccctcccgtacgaaccctagtccgttacgtcgggcccgttaccgacgggtccgtagggaaccgggtacggacgggtcttaacggtattttaacgttacgtcgacgtacgtacctacgtataacctaaactaaaacaaccgttaaacgtccggtttagggttccggtttaccggggccggtaaacccgggtaaacctaaccgttaccggtaccccggtttaccgttaacggtcccaaccggtcccgtaaacggtcccgttaaccccggtcccccggttaccgttaccccgacgtttacccgtttaccccggttcccccttacccccg

SEQ ID NO: 252650 - DNA, 675 bp, Homo sapiens
  misc_feature: GYAE6OF02FIVZC.49.35.D02.1.454.CMB.1.raw
  modified_base (372)..(372): a, c, t, g, unknown or other
  misc_feature (372)..(372): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctctggtaccaacaataccccggcaaacgtccccaactcatgacttctttgaggtcagtgagtccggcccgcgtaggggtttcctcatcgtcttctccggcctaccgagtctggcngcaccggcctccctgacctactcctccgtgggtcctccgaggtcgtggacgggacggaggcgtagtattacttacgtgtaccgagtcctacaattaactaaaccgtaaaactaaacgtaaaaccgttacggttttacggggttacggtttacccggggaccgggtaacccggggtaacccgtaaacgtacccgggtaccccgttaccgttaaccggttcccgaaccggaccccggtaaacgtcccgtacccggtacccccgtccggtcccgtaccgttccgttcccggttcccccgtcccccg

SEQ ID NO: 252651 - DNA, 691 bp, Homo sapiens
  misc_feature: GYAE6OF02GW6JT.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattctgtctctgtaccaacaatacccggacaaacgtccccaaactcatgactcttgaggtcagtgatccggccgcgtaggggtttctcacgtcgtcttcgtccggtctaccgaagtccgtggacctacgcctaccgggcccttacccgtcgtacccacttcctacggtcgggtcctaccgaggtccgtaggaacgggacgagggtctaggtaatttacttacgtcgtacgagtactcgtaattaactaactaaaactaactaaaaccgtacgtttacggggttaggttccggggtaccgggaccgggtaaaccctaaacgggttaccgtacccgttacccggtaaccggtacgaaccggtaccccgaaacggttcccgtaccggtccccccggttcgggttaccctaccggtttaccttacccggttacccccttaacccccg

SEQ ID NO: 252652 - DNA, 876 bp, Homo sapiens
  misc_feature: GYAE6OF02H0FQG.49.35.D02.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (346)..(346): a, c, t, g, unknown or other
  misc_feature (346)..(346): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtcctccgtggacngtcgatcaccatctcctgcactggaaccncaatgacgttgtacttatattctgtctctcgtaccaacactacccgacaaacgtacccaaactcatagtatctttggacggttacagtcgacgtccggaccgtcgtacgggtttcncgtatccgtccgttcctccggtcctaccgtaacggtccgtaggcctaacgccgtaacccggtccctcccgtaccggaacctacgttccgtccggttcgggtccttcccggtaagggtcgttacgggaacggtacgggtacggtaccgttaaggtaacttttacgttaaccgtacggtaccgtaacggtttacctaaccgtaaacttaaacgttaaaaaccctaaaaccgttaaaaccgtttaaaacccggttaaccgggttttacggggggttaaccggtttacccgggggggaacccggggttaaacccggggaaaacccccggttaaaccgggttacccgggttaaacccccgggttacccggttttaaacccgggtaacccgggtaacccccgggtaaaccccggtaaacccggggttcccccgtacccccgggtttacccccccgggttaacccgggttaacccccttaaccccgggttttaccccggtttaccccccggtttaacccccccgtttaccccccccg

SEQ ID NO: 252653 - DNA, 653 bp, Homo sapiens
  misc_feature: GYAE6OF02GODQL.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagccgtgggtcgtcggtgaaggtctcctgcaggcttcgtggagacaccttacaacaactttgctgtcagcgtgggtgcgacaggcccctaggacgaacggtccttggtaggtggggtagggaaggactccgaaccccttattacccgttaatacgtaacgactaaactatcgacacgagaactacgttaccacgtacagacgtcctacccttagtacgacggaactaaacctccaacgaacaccgacgtacctacagtacggaaacctcgaccgacgccgtacggtacgttacgtcgaccggaccggtaccgtaccggttaacgtttactttacgttacgttacggacggtaacggacgtaaggtacgttgttccgtttaacgtttacgtaacgttaagttaacggttaacggttaacttacgtaactttagtacgttacgg

SEQ ID NO: 252654 - DNA, 704 bp, Homo sapiens
  misc_feature: GYAE6OF02IRAEI.49.35.D02.1.454.CMB.1.raw
  modified_base (436)..(436): a, c, t, g, unknown or other
  misc_feature (436)..(436): n is a, c, g, or t
tcagagtcgagagacacgaccggtgctcgatttagcacacgatagttgggtttggggggggtcgtcgaggaggcgagcgctctcgggacgtctccaccatggcctgggctctgctattcctcacctcctcactcaggcacacggtcctgggcccagtctcgccctgactcagcctgcctccgtgtctcgggtctccgtggacagttcgatcaccatctcctgcactggaaccaccaatcgacgttcgtacttataattctgtctctgtaccacaactacccggcaaacgtacccaaactacactagacttcgtttacgaggttacagtgaactccggcccgacgtagggtttctcaacttcggcttctccggaccttccgaaagtcctcggacagccgacggcctccctgaaccctatccgtcgttagggcctccnggccgtaggacggacggacggacgttaccgaagtttacgttacttaggaccttacgccgtactagttaataaaccctaaaacgtaacttaaacgtaccggttttacgggtcggttaaccggccggggtaaacgggaacccctaaacgtccgtacccgttaccgtttaaccggacccgttaacgggcccgtaaaaggtcccgttaccgggtacccccgtttacgggtaccctacccggtttaccctttcccggttaccccctaaccccg

SEQ ID NO: 252655 - DNA, 563 bp, Homo sapiens
  misc_feature: GYAE6OF02F5I74.49.35.D02.1.454.CMB.1.raw
  modified_base (279)..(279): a, c, t, g, unknown or other
  misc_feature (279)..(279): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (379)..(380): a, c, t, g, unknown or other
  misc_feature (379)..(380): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttataattctgtctctggtaccaacaataccccganaaacgtccccaaactcatcgattcttgagtcagtgatccggccgngtacgggtttcncgatcgcttcgtccgctacagtcngcngcacgcctccngaccnnctcgtggctccgagctgacggcaggctacgtattgtactcgacactctacgtataacaacaaagtaataaacctcgtttgggtcgttccggacggtaccgggaaactaacgcgtacccgtcgtacgtcaccggaccaggtcctccggacccttcggcctaccgtccgttccgtcccctacccg

SEQ ID NO: 252656 - DNA, 680 bp, Homo sapiens
  misc_feature: GYAE6OF02JYJJD.49.35.D02.1.454.CMB.1.raw
  modified_base (526)..(526): a, c, t, g, unknown or other
  misc_feature (526)..(526): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgtaccacttcgggaaaccctacaaattcggaacgttggtaaccttataactttctcgtctctacggtaccaacaactaccccgacaaacgtaccccaactcatacgtattcttagacgtcgaagtgtaacgtccggtaccgtacgttacggggttctacgtacgtccttccttccgtccggtccttaccgtaacgtcgtcggactacgtaccgaccggtccctaccgtacgacctacgttctccgtcgggcctccgaggtcgtaggacggtacgacgtctacggtattacgtacgtcgacgtacgtactnaaatactaaaccaactaaactaaacgtgttttacgggtcgtccgggacggaccggaaaccgtaacgtcccgtaccgtcctacggccacgaccccgtaaggccctaccggtccccttacggaccctacggtcccgttaccggttacccctccccg

SEQ ID NO: 252657 - DNA, 562 bp, Homo sapiens
  misc_feature: GYAE6OF02GMH8Q.49.35.D02.1.454.CMB.1.raw
  modified_base (253)..(253): a, c, t, g, unknown or other
  misc_feature (253)..(253): n is a, c, g, or t
tcagagtcgagagacacgaccggtgctcgatttagcacacgatagttgggtttggggggggtctcaggaggcagcgctctcaggacgtcaccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactntgtctcctggtaccaacagtacccaggacaaacgcccccagactcatgtatttatgcggtcagtaacgcgccctcgacgggtccctgactcgcttctcgtggctccagtctggcacgacgcctccctgacctctcgtggcctcggctagagagtgaggtctgtatttagttctgcagtctacatacgtgacgaggcagacctaacgttagttttgaacgttagttacgttcgggacggtacggaacctaagcgtacggtacccgttcgtacggtccaaccggacccgtaaggtccctccggtacccccg

SEQ ID NO: 252658 - DNA, 731 bp, Homo sapiens
  misc_feature: GYAE6OF02IS4QL.49.35.D02.1.454.CMB.1.raw
  modified_base (256)..(256): a, c, t, g, unknown or other
  misc_feature (256)..(256): n is a, c, g, or t
tcagagtcgagagacacgaccggtgctcgatttagcacacgatagttgggtttgggggtcgatcacataacaaccagattcctcctctaaagaagcccctgggagcacagctcatcaccatggactggacctgggaggttcctctttgtggtggcagcagctacaggtgcccaggtcccgggtccagctggtgcaatcgtggggctggaggtgagaagccgtgggtcgtcggtgaaggtctccgtgcaaggtcttntggacacaccttcaactaacttgacgttgtcagtcgtagggtcgcgacgacggccccgtggaccgaaggtcccttaggacggttgggggtagggacgggtatccgaaccccgttagttaccgttaatacgtacgaactaaacgtagtcgactacgaacgtaactacgttaccgaacgaacaggtacgtacctacccgtttaacgtaccggacggtaaccaaacgttacccgaaacgtaaacccgaacaaccggtaccctaaacgtaacgtaacggtaaccgtacggacgaccggtacgtaacccggtaaggtaacttccgggttaccgacccggaaccgtaccggggtaacccgtttatttaaccgttcgtacggttacgcggtaacgtacggtagtaacgtttccggttacttttaaccgtaagttacggtaacgtttacgtaaacggttttcaacgtttactttaagttccgg

SEQ ID NO: 252659 - DNA, 662 bp, Homo sapiens
  misc_feature: GYAE6OF02G6I0W.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtcgtgggtcctccgtggacagtcgatcaccatctcctgcactgaaccacaatgacgttgacttataattctgtctcctggtaccaacaactacccggacaacgtaccccaaactcatagtacttctttgacggtcagtgagtccggcccgcggtacggggttctacagtcgtccttcgccggtctaccaaggtctcgggacaggaccgtaccggacccttcccgtcggtaacccacgttccgtacgtcgggtaccgttccgagggtcacgggtaacgggacgtaggtactaggttaacttacgttacgtcgtacacgttactctaatacctaaacaaagtaacctaaacgtacgttcgggtacggttccggtacgggaccggaaacctaacgtcgtaccgtaccgtacggccgaacgtccgtaacggccttccggtacccgttccggaccgttaccgtccgttacccggttcctacccg

SEQ ID NO: 252660 - DNA, 789 bp, Homo sapiens
  misc_feature: GYAE6OF02GVD4X.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccaccatgacgttggtacttatattctgtctcctggtaccacaactaccccggacaaacgtccccaaactcatgtactctttagaggtcaggtgacgtccgggcccgtcgtacggggtttccacgtacgtccgtaccgtttccgtcccggtcctaccgtaacgttcgtacggccacggccgaccgggtccctacccgtccgaacctatccgtacgtcggggtcctcccgacggtcgtacgggaacgggacggtacggacgttacggttaactttaacgtttaccgtcggtaccgtacgttaccgttacctaaagttaaacctaaaccgtaaaactaacgttaaaaccgttaccgggtttagggggtttaccgggttccgggggtaacccggggtaaccccggggtaaaaccgtaaacccggtccgggttaaccccggttacccgttaaccggtacccgtaaccggtacccccggaacgggttccccgtaccccgggtaccccccgtttacgggtaccccgttaccccgtacccgttttacccccggtacccccctttacccccgg

SEQ ID NO: 252661 - DNA, 793 bp, Homo sapiens
  misc_feature: GYAE6OF02G0E6A.49.35.D02.1.454.CMB.1.raw
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgacctcagcctgccctccgtgtctgggtctcctggacagtcgatcaccatctcctgcactggaaccaccaatgacgttgtacttatattctgtctctcgtacaacaacgtacccgacaacgtaccccaaactcatacgattctttggtacgtctagtagacgtccggccgtacgtacggggttttctactacgtccgtccgtttccgtcccggtacctacccgtaagtttccgtcggtacacgccgtaaccggtccctccccgtacgtacccgtacttacccgttcgtacgggtccctacccggtacggtccgtacggaacgggacggtacgggtcgtacggttaactttacgtttaaccgtacgtacccgtaaggccctttacgaaacttacgttaaaaactaaaaccgtaaaccttaaaaccgtaccgggttttacgggttaccgggtttccggggaccgggggtaacccggtaaaacccgtaaaccggttaccggttaaccccgtttaccgtaacccggttaaccgtaaccggtaaccccggtaaccggccccgttaccccgtccccccggttacgggtaccccgttaacccgttccgtttaccccgttcccccgttaaccccccg

SEQ ID NO: 252662 - DNA, 596 bp, Homo sapiens
  misc_feature: GYAE6OF02HV07A.49.35.D02.1.454.CMB.1.raw
  modified_base (339)..(339): a, c, t, g, unknown or other
  misc_feature (339)..(339): n is a, c, g, or t
  modified_base (475)..(475): a, c, t, g, unknown or other
  misc_feature (475)..(475): n is a, c, g, or t
  modified_base (491)..(491): a, c, t, g, unknown or other
  misc_feature (491)..(491): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggtcgatcaaccatctcctgcactggaaccaccaatcgacgttggtacttatattctgtctcctggtacaacaatacccggcaaagtccccaaactcactgaatctttgaggtcagtgatccggccgcgtaggggtttcncgtatcgcttcgtccggctcccgtaaagtccgttaggctacggctaaccgggccctcccctggaaccctacgtctcgtgggcctccgacggtcgtagacgggacgaggactggtactttagttactagccagcctnataacaacaaactaanaaactcgttagggtcgttacgggcggacggaaccgtaagtcgaccgtacgtcgtacgcgaccgaacgcgtcccgccgtcgtctacctcgtaccgtccccgtcccg

SEQ ID NO: 252663 - DNA, 577 bp, Homo sapiens
  misc_feature: GYAE6OF02F6NTV.49.35.D02.1.454.CMB.1.raw
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (406)..(406): a, c, t, g, unknown or other
  misc_feature (406)..(406): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccattctcctgccactggaacccacaatgacgttgtacttatattctgtctctgtaccaacaactacccggacaacgtccccaactcatgatcttgagtcagtnacgtcggcccncgtagggtttctcgattcgtcttcgtccgtctccgtaagtcgtggcacgcgaccggccctccgcgaccatcctcgtcggctccnggctggacggtacgagtctagtattattacgcgactcgctanacgtaanaaccaaacaataaactacgttggttcgtacgggccgaccggaaaccacgtacgacccttccacggtcacgacccgtaggcctccgtaccccgtcggtcccacgttcctccggtacccctccc

SEQ ID NO: 252664 - DNA, 845 bp, Homo sapiens
  misc_feature: GYAE6OF02HDFWD.49.35.D02.1.454.CMB.1.raw
  modified_base (220)..(220): a, c, t, g, unknown or other
  misc_feature (220)..(220): n is a, c, g, or t
  modified_base (259)..(259): a, c, t, g, unknown or other
  misc_feature (259)..(259): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaaccatcctcctncactcggaaccaccaagtgacgttgtacttataattctntctctgtaccaacaactaccccgacaaacgtaccccaaactcatgattcgtttagacggtctagtcgacgtccggcccgtacggtacggggttttcctcgtacgttccgtccgtttcgtcccggtaccttacccgaacgtttcgtcggtaccacggcccgtaacccggtccccttaccccgtaccgtaccctacttaccgttccgtaccgggggtcccttacccggacgggttccgtacggggaacgggaaccgggtacgggtaccgtttaggttaaacgttttaacgtttaccgttacggaccggtaacgttaccctaacgttaacgttaaacctaaaacccgaaaaaccttaaacgttaaaacccgtttaacgggtttacggggtttacggggtttaaccggggacccggggtaaacccgggttaaacccgtaaacccgttaccgggttaacccccgttaccgttaacccggtaccgtaaaccccgggtacccgtaaccgggtaccccgttaccccggttaccccccgttccgggttaacccctccggtttacccgttaccccgtttaccccccttaccccccg

SEQ ID NO: 252665 - DNA, 810 bp, Homo sapiens
  misc_feature: GYAE6OF02GI4B5.49.35.D02.1.454.CMB.1.raw
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccaccaatgacgttggtacttagaattctgtctcctgtacaacaataccccggacaaacgtccccaaactcatagattcgtttagacggtctagtgactccggaccgcgtaggggtttcctacgacttcgtccttcctaccggtactccgtaacgtccttggaccagccgtaccggtccctcccgtacgaccctaacgttcccgtcgttgggcccctttaccgaaccgggtcggttacgggaacggggtaaccggtacggggaccttagggttaacttttaaccggtttaaccgtcggtaacctacgggtccctaacgtaaacgttactaaaacctaaaacgtaacgtaaaaacgttaccggttttaaacgggggttccggttttaccggggaaccggggttacccggggaaaaccccgttaaaacggtacccggttaaccccgggttacccggttaacccggtttaacccgggaacccggttaacccgggaaaccggttcccggttaacccccggtacccccggttcccgggtacccgttacccggttacccgttttacccggggtaccccccttttcccccgg

SEQ ID NO: 252666 - DNA, 681 bp, Homo sapiens
  misc_feature: GYAE6OF02HQ1HT.49.35.D02.1.454.CMB.1.raw
  modified_base (341)..(341): a, c, t, g, unknown or other
  misc_feature (341)..(341): n is a, c, g, or t
  modified_base (417)..(417): a, c, t, g, unknown or other
  misc_feature (417)..(417): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctctgcactgaaccacaatgacgttgtacttatacttctagtctcctggtaccaacaactaccccggacaaacgtccccaaactcatgattcgttgaggtcagtgactccggccgacgtacgggtttcncactcgcttcgccggtctccgaagtcgtggctacgccgaccggccctccctgaaccctatctcgtcggcctaccgnggtccgttggacggacggtacggtctagtacttagttaacgtcgtccaagtcccttacaagtaactaaaccaaaactaacttaaaaccgtacggttacggggttacgtttacggggtacccgggaaccggtaaaccgtaaaccgttaccggtacccggttaccccgtaaggttcccaaccggtaacccgaaccggtacccgtcccggtacccccggttcggaccctttaaccgtcccggtttcccgttcccccgttaccccccg

SEQ ID NO: 252667 - DNA, 743 bp, Homo sapiens
  misc_feature: GYAE6OF02GMBZH.49.35.D02.1.454.CMB.1.raw
  modified_base (259)..(259): a, c, t, g, unknown or other
  misc_feature (259)..(259): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggactgtcgatcaccatcctcctgcacgtacgaaccaccaatcgtacgttgtacttatattctntctctgtaccacaactaccccgacaactcccaaactcatgattcgttggagtcagtgtacgtccggcccgcgtacgggtttctcgtactcgtcctttccgtcccggtacctccgtaagttccgtggacacgtccgaccggtcccgttcccacggtaacctacgtttccgttcggtcggggtacccttccggacgggtcgttacgggaaacgggtacgggagggtaccttacggttaaacttttacttacggttcgtacgtaaccggtaccttacgtaatttaacctaaactaaaacctaaacgtttaaaccgtacgggttttggggttaccggttacggggccggggtacccggaaacgttaaaccgtaccgttacccgtcgttaaccggtcccgtaaccggcccggtaaacgtcccggttaacccgtcccccggtttacggaccccttaccggtttacccttccccgttccccttaacccccg

SEQ ID NO: 252668 - DNA, 651 bp, Homo sapiens
  misc_feature: GYAE6OF02HSPGF.49.35.D02.1.454.CMB.1.raw
  modified_base (309)..(309): a, c, t, g, unknown or other
  misc_feature (309)..(309): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (382)..(382): a, c, t, g, unknown or other
  misc_feature (382)..(382): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
  modified_base (432)..(432): a, c, t, g, unknown or other
  misc_feature (432)..(432): n is a, c, g, or t
  modified_base (463)..(463): a, c, t, g, unknown or other
  misc_feature (463)..(463): n is a, c, g, or t
  modified_base (575)..(575): a, c, t, g, unknown or other
  misc_feature (575)..(575): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccacatctcctgcacgtacggaaccacctaatcggacgttaggttacttataacttctgtctcctgtaccaacaagtaccccggacaaacgtcccaactcatnacttcttgaggtcagngtacgcggccgngttacgggttctacgactccgtcttccgccgacctccgtaagtcncggcacgtccgccggtcctcccgngtaccngtctcgtcggctcgaggcgnggaggcgagtcgtagtagttacttacgcgcngtaccactataacgtaaacaaacgtaactaaaccgtgttcggggttacgtccgggaaccgggtaccggaaacctaacgtccgtacccgttaccgttaccgaccggttaaccncccgggtaacgtcccggtccccttaccccgggtcgttaccgtaccccgttaccttcccggttacccccttcccccg

SEQ ID NO: 252669 - DNA, 640 bp, Homo sapiens
  misc_feature: GYAE6OF02GBIG6.49.35.D02.1.454.CMB.1.raw
  modified_base (280)..(280): a, c, t, g, unknown or other
  misc_feature (280)..(280): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccacaagtgacgttgtacttatattctgtctctggtaccaacaataccccgganaaacgtccccaaactcatgattctttagaggtcagtgacgtccggccgcgtaggggtttcctctacgtcgtcttcgtccggcttaccgaagtcctaggcagctacggcctccgngaccntctcgtcggctccgagtcgtagacggacgtggcttagtattaagttcgtgactacgtctactaagtactaaacgaaactaaactaactacgggtttagggttcgttccgggaccggtacgggaaacccgaacgttaccgacccgttacctaaccggtcaaccggaccctaacgggccttaccccgtaccccggttccggtaccctaccggttcccgttacccgttacccccgttacccccg

SEQ ID NO: 252670 - DNA, 769 bp, Homo sapiens
  misc_feature: GYAE6OF02HNIX7.49.35.D02.1.454.CMB.1.raw
tcagagtcgagagacacgaccggtgctcgatttagcacacgatagttgggtttggggggggtctcaggaggcagtgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaaccaccaatcgacgttggtacttataacttcgtgtctccgtcggtaccaaactaacgtaccccggacaaaccgttaccccaaacgtcaacgtgtacttcgtttgacggtcagtcgacgtccggccgtcgtacggggtttctctagtccgtcttccgtccggtacctaccgtaagtcctaggccgtacggccgtaccgggtcccttacccgtcggaccctacgttccgtccgttaccggggtcccttacccgggtacggtaccggtacgggtaaccggggaccggtacgggtacgttcggtaaacgttttaacgttaaccgttcgaccgtaggtccttacgtaacgttaaactaacctaaaacgtaaacgttaaaacgttcgggtttagggttaccgggttccggggaccggggtaaccggtaaccgtaaacgttccggtaacccgttccgttaaccggtccgaccggtacccgtaacggtcccgtccccggtaccccgttccggtacccgtaccgtttcccgttccggttacccccgttcccg

SEQ ID NO: 252671 - DNA, 679 bp, Homo sapiens
  misc_feature: GYAE6OF02FJ3TY.49.35.D02.1.454.CMB.1.raw
  modified_base (342)..(342): a, c, t, g, unknown or other
  misc_feature (342)..(342): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccacaatgacgttggtacttataattctgtctcctgtaccaacaagtaccccgacaaacgtccccaaactcatgatctttgagtcagtgagtccggccgcgtacggggtttctacnctcgtcttcgtccggctccgaacgtctcggcacgccgaccggtccctcccgtcgtacccacttccgtccgtcgggccctccgagggtcctagggacgggacggacggtcgttaggtaactttattaccgtacgtcgtaacgtccttataacttaacgtaaaccaaaactaaacttaaaccgttaccggtttaggggttaccggttccggggtaaccgggaccggtaaaccgtaaaccgtcgtacccgtaccgtaccggtacgacccgacccgtaacggtccgtcccggtaccccgtccggttacctaccgtcccgttcccgttcccccgttaccccg

SEQ ID NO: 252672 - DNA, 584 bp, Homo sapiens
  misc_feature: GYAE6OF02FKHU2.49.35.D02.1.454.CMB.1.raw
  modified_base (387)..(387): a, c, t, g, unknown or other
  misc_feature (387)..(387): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaaccaccaatgacgttggtacttataattctgtctcctggtacaacaataccccggcaaacgtccccaaactcatgatctttgaggtcagtgatccggcccggctacggggtttctcactcgcttctccggctacccaagtctggcagcacggcctcccgtnaccatcctctcgggctccgaggctcggaggaccggaggcttgaattactttactgtcagtctcgatactaacaaacaataaactacgttagggtggttcggccggacgggacctaacgtcgtaccgtccgtaccgtcacgtacccgtaaggcctacggccccgttcggtacctacctcctaccgttcccctaccccg

SEQ ID NO: 252673 - DNA, 819 bp, Homo sapiens
  misc_feature: GYAE6OF02IPLWT.49.35.D02.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccnggacngtcgatcaccatctcctgcacgtagaaaaccagcagtnagttggttaggtaaattacttaaccttttcgtccgtaggtaaccaacaaccaccaaggacaaaaccgtacccccaaaactcaacttactaattttagcggtaggaccaactcgaacggccggtccccgtaagtacggggtctacgtacggaccgttcgtccttccttccgttcgggaaccctttccgaaccggtttccgtcggacctacggaaccgacccggtccccttaccgtacggaacttaacttccgttcgtaacgggccctacccggtaggggaaccggttcgggggtaccgaaagggtcgtttaggttaacttttacgtttaaggtttcgtacggtttacgtttcctaaacggtttgttcgggtcccgggttaagttaagggttaacgggttcccggggtaacgggttaaagggttccgggtaccggggttaccggggaacggggttacccgtaaacggggttccgtaacccggggtttaccgtttacgggtaaccggtaacccgaacccgggtaacggttccccggttaccccgtacccccggtttacggtacccgttacccgtttaaccccgg

SEQ ID NO: 252674 - DNA, 817 bp, Homo sapiens
  misc_feature: GYAE6OF02I6QGK.49.35.D02.1.454.CMB.1.raw
tcagagtcgagagacacgaccggtgctcgatttagcacacgatagttgggtttgggggggtctcaggaggcagcgctctcgggacgtctccaccatggcctgggctctgctattcctcaccctctcactcagggcacagggtcctggccagtctgccctgactcagcctgcctccgtgtctggtctccgtggacagtcgatcaccatctcctgacacgtggaaccaccaagtgacgttggtacttataattctgtctcctggtaccaacaacgttaccccggcaaacggtccccaaaactcgacttacggaacttccttttaggacggttacctaggttacgtaacgttccgggaccccggtcgtaaacggggggtttttcctccgtaacgttccggtaccgtttccgttacccgggggtcccttacccgtaaacggtttccgttccgggacgtaaccgtccgaaacccgggtcccttccccgtttacggacccggtaacttcccgttaacggttcggggaaccctttccgaacgggttaccttaggggaaccggtacggtaacggtcgttacggtaaacgttttacgttaacccgttaggccgttaacggtccttaccggaattttaaacggaaccctaaaacgtaacgttaaaaccgtcgggtttacgggttacggttcccgggtaaccgggtaccggtaaacccgtaacgttaccggtaccggttaccctttaacgggccttaaccggacctaaacgggcccgttccgtaccccgttgggtaccctacgtcccggttacgtcccccggttaccc

SEQ ID NO: 252675 - DNA, 554 bp, Homo sapiens
  misc_feature: GYAE6OF02FIPZQ.49.35.D02.1.454.CMB.1.raw
  modified_base (426)..(426): a, c, t, g, unknown or other
  misc_feature (426)..(426): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgatcggcccgcaggggtttctcatcgcttctccggctccaagtctggcagcacggcctccctgaccatctctcgggcctccgaggcgtgacggacgaggctgattattacngcagctctatataacaaacataaacacgttgggtcgttcggcggacggaaccaacgtcgaccgtcctacgtcgacgacccgaaggcctaccgcccccgtcggtccactccgtccgttccccgtccccg

SEQ ID NO: 252676 - DNA, 755 bp, Homo sapiens
  misc_feature: GYAE6OF02GVFUQ.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatcctcctgcactggaaccacaatgacgttggtacttataattctcgtctcctggtaccaacaactaccccggacaaacgtccccaaactcatgactcttgagtcagtgagtccggccgcgtacgggtttctcagtccgtcttccgtccggtccttacccgaagtcgtcggcacgaccgaccggtccctccctcgacccactccgtcgtcgggcctaccgcggtacgtcgggaacgggacggtacggcgttaggtacgtttaagttccgttgaccgtcgtaccgtacgtaacttaataaacctaaaaccgtaaacttaaaacccgtacggtttacggggttaccgggttaccgggggaaccgggtacccgggtaaaacccgaacccggttaacccggtaccccggttaacccgttaaccgggtaacccggaacccggtaaccccggtaaccgggtcccgtttacccccgggtaccccccggttacccggttaccccgttaaccccggtttcccgtttaccccggttaccccccctttaccccccg

SEQ ID NO: 252677 - DNA, 676 bp, Homo sapiens
  misc_feature: GYAE6OF02JF8B1.49.35.D02.1.454.CMB.1.raw
  modified_base (255)..(255): a, c, t, g, unknown or other
  misc_feature (255)..(255): n is a, c, g, or t
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (373)..(373): a, c, t, g, unknown or other
  misc_feature (373)..(373): n is a, c, g, or t
  modified_base (400)..(400): a, c, t, g, unknown or other
  misc_feature (400)..(400): n is a, c, g, or t
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacaggtcctgggcccagtctgccctgactcagcctgcctcgtgtctgggtctcctggacagtcgatcaccatctcctgacactggaacccaccaatgacgttggacttataattctntctcctgtaccaacaataccccggcaaacgtccccaaactcatgattacttgaggttcaagtgactccggcccgngtacgggtttcnctatcgcttctccggctccgaagtctggccngccgcggcctccctgaccctatccgtntcgggctccgaggctgaggtacgaggcctgtaacgttcgttactcgtacgactcgttaccactaagaacctaaaccgtaacttaaacccgttaggttacggggttccggttacgggaccggggtaccgtaacccgtaaacgttccggacccgtttacccgtaccgggtaaccgtaaccggtacccgtaaacccggttccgttaccccgggtcccccggtttaccggtacccccgtaacggtttcccccgtttaccggtttacccccgttacccccc

SEQ ID NO: 252678 - DNA, 680 bp, Homo sapiens
  misc_feature: GYAE6OF02HM781.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcgaaccacaatgacgttgtactatattctgtctctgtaccaacactaccccggcaaacgtacccaaactcatgattctttgagtacagtgagtccggcccgtcgtagggttctcatcgtcttccgtccggctaccgtaagtcgtgacacgcgaccggtccctccctagaccctatccgtcgtcgggcctaccgaggtcgtggacggacggaggtcttgtaactttaagtaccttaggctaacgtcctaacgtaacttaacgtaaaccaaaaactaacgttaaaaccgtacggttttacggggtacggtttcccggggacgggtaaaccgggaacctaaaccgttacggtacccgtttaccttaacccgggtactacccggacccgtaacgggtccgtaccccggtcccccgttacgggttaccctaccgttaccgttcccgggttacccccttccccg

SEQ ID NO: 252679 - DNA, 619 bp, Homo sapiens
  misc_feature: GYAE6OF02HMGKK.49.35.D02.1.454.CMB.1.raw
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (405)..(405): a, c, t, g, unknown or other
  misc_feature (405)..(405): n is a, c, g, or t
  modified_base (452)..(452): a, c, t, g, unknown or other
  misc_feature (452)..(452): n is a, c, g, or t
  modified_base (543)..(543): a, c, t, g, unknown or other
  misc_feature (543)..(543): n is a, c, g, or t
tcagagtcgagagacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactcggaaccacaatcgacgttgtacttatattctgtctctgtaaccaacactacccggacaacgtcccaaactcatgaattcttagagtcagtgactcggcccgngtagggttcncatcgtcttctccggctaccgagtcgtggcagccgaccggccctccctgaccctgtctcggtcggactccgngctaggacggacgaggccttaggtacttacgttctaggctaagctanactaactaacaaataactaaacgtacgtttggggtcgttaccgggcgggtaccggaaactaaccgtcgtaaccccgtactccggtaaaccncggaccccgtaaggtcctaccccggtaccccgttaccggtcccgtaccgtttaccgttccctttacccccgtaccc

SEQ ID NO: 252680 - DNA, 677 bp, Homo sapiens
  misc_feature: GYAE6OF02GTFF5.49.35.D02.1.454.CMB.1.raw
  modified_base (341)..(341): a, c, t, g, unknown or other
  misc_feature (341)..(341): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataatctgtctccgtgtaccaacaactacccggactaaacgtccccaaatcatagattcttgaggtcagtgacgtccggccgcgtacgggtttcnctacgtcgtaccgttctccggctacccgtaagtcgtggcacggtccgaccgggtaccctacccgtgaaccctacgttccgtcggtcggggcctacccgtaggctagggaacggtacggaggtctagttaacttacttaagtcgacgtcgtacactataactaaacaaaactaaacttaaacgtacggtttacggggttacggttacccggggaacgggacccggtaaaccgtaaaccgtccggtaacccgttacttaacccggcaacccggacccggtaagcccgttaccgccccgttcggtacccttaccgtccgttacccgtccccgttacccc

SEQ ID NO: 252681 - DNA, 730 bp, Homo sapiens
  misc_feature: GYAE6OF02FRECZ.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccaccaatgacgttggtacttataattctgtctctggtacaacactacccggacaacgtaccccaaactcactagacttcgtttgaggtcagtgacgtccggccgtcgtacggggtttctcgacgtccgtccttcgtcccggtcttaccgaacgttctggaccaggccgtaccggtccctccgtacgacctacttccgtcgtcggtaccgtccgtacggtcgtcgggaacgggtaccggacgggtacgttaacgtacgtttaacgtttacgttacggtaccgtacggttccctaacgtataaaccgtaaaccgtaaaaacgtaactttaaaccggtaccgttttacggggttacgggtttaccggggaccgggtaaccggtaacccgtaaccgtccggttaccgtccgtaaccggtacccgtaacggaccccggtaacggccctttacccggtccccgttacggttaccccgtaccgttccgttcccggtccccgttacccccg

SEQ ID NO: 252682 - DNA, 727 bp, Homo sapiens
  misc_feature: GYAE6OF02JOR9J.49.35.D02.1.454.CMB.1.raw
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagccctgcctccgtgtctgggtctcctggacagtcgatcaccatctcctgcactggaaccacaatgacgttggtacttataattctgtctcctgtaccaacataccccggcaacgtccccaactcatgatactttgagtcagttgactcggccgctagggttctcatcgtcttctccggctccaagtctcggcagcacggtcctccctgacctacgtctcgtcgggtctccgaggccgtaggacgggaccggaggtcgtaggtactttaacgttacgtcggtccaacggtcttacgaacttaacgtaaacctaaaactaacttaaaaccgttcccgttttaaacgggggtttccggtttaccgggacccgggggttaacccgggaaaccccgtaacgggtttaacccggaaccccggttttacccgtacccggttaccggtaaacccgtaccccgggtaaaccggtaccccgttacccggttaccccccccgttacgggtttccccgtaaaccccgttccccgggttttacccggtttacccccccgggtaacccccc

SEQ ID NO: 252683 - DNA, 682 bp, Homo sapiens
  misc_feature: GYAE6OF02GJNGS.49.35.D02.1.454.CMB.1.raw
  modified_base (393)..(393): a, c, t, g, unknown or other
  misc_feature (393)..(393): n is a, c, g, or t
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaacccaccaatgacgttggtacttaatatctgtctctgtacaacaagtacccgcaaacgtcccaaactcatgtactctttgagtcagtgactccggccgtacgtacgggtttctcgactcgtcttcgtccggactaccaaggtctcggcacgccgaccgggccttcccgngaacctacttcgtactcgggccttaccgaggtccgtaggacggacggaggacttaggtaacttaacgttactagtccgaactctacgtataaccgtaactaaaactaactaaaccttacggtttacggtacggtttaccgggaccgggtaaccggtaacccgtaaacgttccggacccggttaccgtaacccgggttacgaacccggtacccgggtaaccgtaccgttaccccgccccggttccggtaccgttaaccttcccggttacccgttacccccgttaaccccg

SEQ ID NO: 252684 - DNA, 583 bp, Homo sapiens
  misc_feature: GYAE6OF02HJUAL.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgagtcagtgatcggcccgcgtaggggtttctcatcgcttctccggctccagtctggcacgcgacggtcctccctgaccatcctcgtcgggcctccgacggcgtgacggacgaggcttagtattacttactgaccgagtctacgtaatactaaacaaacaattaaactacgtttagggtcgttcggcggacggaaccgtaacgtcgtaccgtcgtaccgtcgaccgccgaacgtccgtccgtccccgtacggtcctaccgtcgtccgttcccctcccc

SEQ ID NO: 252685 - DNA, 618 bp, Homo sapiens
  misc_feature: GYAE6OF02HN58X.49.35.D02.1.454.CMB.1.raw
  modified_base (253)..(253): a, c, t, g, unknown or other
  misc_feature (253)..(253): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttataattcntctcctggtaccaacaactaccccggcaaaacgtccccaaactcatgatcttgaggtcagtgatcggcccgntacgggttcncatcgtcttctccggctccgaagtctggcagcgacggcctccctgaccatcgtacgtcgggctccgaggctggacggacgaggctaggatttatacgtgaccagtactcaattaactaaacaaaactaacttaaaacgtaaccgtttgggttacggtttaccgggcgggaaccgggaaaccgaaacgtacgtacccgtaccgttaccggttcaccgacccgtaacggccgtacccgtccccgttaccggtccgtaccttccgttacccgttccccgtaccccg

SEQ ID NO: 252686 - DNA, 784 bp, Homo sapiens
  misc_feature: GYAE6OF02FSHQV.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccacaatgacgttgtacttatattctgtctcctgtaccaacaactaccccggcaaacgtccccaaactcatgatctttgaggtcagtgactccggcccgtcgtacgggggtttcctcgtacgtccgtactttcctcccgggtccttacccgtaaacggttccgttacgggacgtacggcccgaaccgggtccccgtttccccgtacgaacccctacgttcccgtttccggttacggggtccccttacccggacgggtaccgttacgggaaacggggtaacccggaaggggtcccgttaaggttaacttttaaaccgtttaccgttacgacgtacggttccctacgtaatttaaactaaaacctaaaactaacgttaaaaaccgttaccggtttaggggttccggtttaaccggggccgggtaaccgggtaaacctaaaccgtccggtaacccgttcgttaacccggtaccgtaaccggtaccccggaacggtcccgttaccgacccccgtttacgggtcccttaacccgttccgttaccccggttaccccgttacccccg

SEQ ID NO: 252687 - DNA, 616 bp, Homo sapiens
  misc_feature: GYAE6OF02IEBL2.49.35.D02.1.454.CMB.1.raw
  modified_base (391)..(391): a, c, t, g, unknown or other
  misc_feature (391)..(391): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctcctgtaccaacaactacccgacaaacgtccccaaactcatcatctttgaggtcagtgatccggccgacgtaggggtttctcgtacgttcgccttcgtccggcctcccgtaagtctcggcagtccacggtcctcccngaccctatccgtcgtcgggctccgacggctaggaggtacgaggctgtaattacgttacgttgtcgtagtcgtactactaacgtaacaaaacctaaacgtaacgtaagtttagggttacggttacgggtacggtaacggtaccgaagtctacgaccgtcgtaaggtaccacgcccgtaagtccgtaccgtcccgtaccggttcctaccttccgtccgttacccccg

SEQ ID NO: 252688 - DNA, 667 bp, Homo sapiens
  misc_feature: GYAE6OF02GU17N.49.35.D02.1.454.CMB.1.raw
  modified_base (200)..(200): a, c, t, g, unknown or other
  misc_feature (200)..(200): n is a, c, g, or t
  modified_base (255)..(255): a, c, t, g, unknown or other
  misc_feature (255)..(255): n is a, c, g, or t
tcagagtcgagagacacgaccggtgctcgatttagcacacgatagttgggtttggggggggtcgtcgaggaggcagcgctctcgggacgtctccaccatggcctgggctctgctattcctcaccctcctcactcagggcacagggtcctgggcccagtctgccctgactcagcctgcctccgtgtctgggtctctggacngtcgatcaccagtctcctgcactggaacccacaatcgacgttgacttataattcngtactctgtacaacaactacccgacaaacgtccccaaactccatacgacttcgtttgacggtacctagttgaacgtccggcccgtacggtacggggttttcctcgtaacgttcgttccgttccgttccggaccttacccgtaaacgtttcgtcggtacaacggtccgaaccggccccttccgttacggacctacttcctcggtacgggccttaccgcgtcgtcggacggacgaggctagacttacttcgtgacgtgccttcaattaacaactaaacaataaacctcgtttgggtacgttacgggccggtacgggaacctaaacgtccggtaccgtccgtaccgtccgaaccgtaccggaacgtcgtaccgtcccccgtacggtcaccgttcccgttcgttacccccctccgg

SEQ ID NO: 252689 - DNA, 752 bp, Homo sapiens
  misc_feature: GYAE6OF02IUWF0.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaacccacaatgacgttgtacttatattctgtctctgtaccaacaactaccccggcaaacgtccccaaactcatgtactctttgaggtcagtacgacgtccggccgtcgtaggggtttctcgtactcgtccttccgccggcctaccgtaagtccgtcggacacggccgaccggtcccctcccgtcgaaccctacttccgtcggtacggggtccctcccggaacgggtccgtacggaacggggtacggtaacggtccttaggtaacttttaacgttaccggtcgtccgaacggttcctaacgtaaactaaacgttaaacctaaaaaccgtaacttaaaaaccgttacgggtttacggggtttaccggtttacccggggaccggggtaaacccggtaaaccccgttaaaacgtcccgggtacccgtttacccgtaaccggtaaccgacccgtaaccggaaacggttcccctaccggtccccccgttacggttaccccgtacgttttacccggtccccgttccccggtaccccc

SEQ ID NO: 252690 - DNA, 716 bp, Homo sapiens
  misc_feature: GYAE6OF02GLSDO.49.35.D02.1.454.CMB.1.raw
  modified_base (202)..(202): a, c, t, g, unknown or other
  misc_feature (202)..(202): n is a, c, g, or t
tcagagtcgagagacacgaccggtgctcgatttagcacacgatagttgggttggggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacngtcgatcaccatcctctgcactaggaacccacaatgtacgttgtacttataattctgtcctctcggtaccaactaacgtaccccggactaaaccgtaccccaaactcatgtaattcgttaggaggtacagtgtacgtccggcccgtacgggtacgggtttccacgtcgtcggtccttaccggtcccgtccgtaccgtaacgtcgtacggtccgacggtccgaccggtcccgtcccgtacggaccctacgtccgtttacgcgggtccctccggacggtcgtacggacgggacggtcgtcgttacgtaacgttacgtaccgttgaccgtactcaaccgtataaaccgttaacgaaaactaacttaaacggtgtttacggttacgggttccggaccgggtaccggaacctaacgtcccggtaccgtaccgttcggaaccgaccggaccggtaaccgtccgtaccccggtccccgttaccgggttcccaccgttcccgttaccccgtcccctaccccg

SEQ ID NO: 252691 - DNA, 774 bp, Homo sapiens
  misc_feature: GYAE6OF02I39SZ.49.35.D02.1.454.CMB.1.raw
  modified_base (208)..(208): a, c, t, g, unknown or other
  misc_feature (208)..(208): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcgagggcacgtagggtcctcgggcccagtcctcgccctgactcacgcctgcctccgtgtcgtggtctccgtggacngtcgatcacatctcctgcacgtacggaaccaccaagtcgtacggttagttaacttaattatttcgtcgttccttccgttacgaaccaactaaccgtaacccggtactaaaccgtaccccaaacttacatacgtacttcgtttacggacgttacgtacgttacggaaccgttccgggccccggtagggttacgggtttcctacgtacgttccgtccttaccgtccggtcctaccggtaacgtcgtacggacgtaccggtaccgccggtacccctccgtacggttaacctcggttccttcgggtaaccggtccgtccggtacggtcgtaacggacgggtcggaacgttcgtaacggttactaacgttcgtcgtagccgttactaactaactaactaaaccgtaaataaccttaacggtttaacggttcgggttaccgtacgggggaccgggttaaccggaacctaacggtaccgtacccgttaacggaccgttaaccgaaccggttaccggacgttcctaccccgtaccggtaccgtaccctaccgtcccgttaccggtacccctccc

SEQ ID NO: 252692 - DNA, 689 bp, Homo sapiens
  misc_feature: GYAE6OF02JHQTX.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcacccatcctcctgcacgtcggaacccaccaagtcgtacgttggttacttaagtaattctgtcttccgtggtaccaacaacgtaccccggacaaacgtcccctaaactcatcgattctttgacgtcagtgagtccggcccgtcgtacggggtttcctacgacgtcgtccttccgtccggtctaccgtaagtctcggtacacgtccaacggtccctcccgtaccggaccctactccgtcgtcgggtcctacccgaggtcgtaggaccgggtacgaggtcgtacgttaagttacttaacgtcgtcctaacgtccttcgaaacttaacaaaccgtaaactaactaaacgttccgtttagggtcgttccgggacgggtacgaaaccctaacgtcgtacccgtacgtaccggtcgaccggtacccgtacggccgttaccgtccccgttccggtaccgttaccgtccgttacccgttcccctaccccg

SEQ ID NO: 252693 - DNA, 632 bp, Homo sapiens
  misc_feature: GYAE6OF02G1MOQ.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttgtacttataattctgtctctggtaccaacaactaccccgcaaacgtccccaaactcatgatcttgagtcagtgatcggccgcgtaggggtttctcactcgccttcgtccggtactccgaagtctggacctacggccaccggcctcccgtagaaccctacttcgtcgtacgggctaccgcggtctgggacggacggaggtcctggtaacttacttaacgtcggctaacgtctacgtaacttaactaaacgtaaactaaacttaaaaccgtaccgtttggggttcgttaccggggacggtaccgggaaacctaacggtcgtaccgtacccgtacgtcacgacccaggtcccgtaccgccccgttacggtccaccttcgtccgtcccctaaccccg

SEQ ID NO: 252694 - DNA, 122 bp, Homo sapiens
  misc_feature: GYAE6OF02JGSL7.49.35.D02.1.454.CMB.1.raw
  modified_base (118)..(122): a, c, t, g, unknown or other
  misc_feature (118)..(122): n is a, c, g, or t
tcagagtcgagagacacgaccggtgctcgatttagcacacgatagttgggtttggggggggtctcaggaggcagcgctctcgggacgtctccaccatggcctgggctctgctatcctnnnnn

SEQ ID NO: 252695 - DNA, 699 bp, Homo sapiens
  misc_feature: GYAE6OF02JGSZ0.49.35.D02.1.454.CMB.1.raw
  modified_base (174)..(174): a, c, t, g, unknown or other
  misc_feature (174)..(174): n is a, c, g, or t
  modified_base (199)..(199): a, c, t, g, unknown or other
  misc_feature (199)..(199): n is a, c, g, or t
  modified_base (328)..(328): a, c, t, g, unknown or other
  misc_feature (328)..(328): n is a, c, g, or t
  modified_base (341)..(341): a, c, t, g, unknown or other
  misc_feature (341)..(341): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctncctccgtgtctgggtctcctggacngtcgatcaccatctccgtgcactggaaacccaccaagtgaaccgttggtacttataatttctgtctcctggtaaccaacaactacccccggacaaacgtacccccaaaactcatgattcttgagtcagngactccggcccgngtaggggtttctcacgtcgtcctttccgtcccggaccttccgaaggttcctacggcctaacgcccgaaccggtcccctcccgtacgacccctacttccgtaccgtcgggtctcccgtacggcgtacggaacggaccgaggtcgttacgtaactttacttacgttcgctacgtctacgacttaacgtaaacaaacctaacgttaaaacctacggtttcgggtacggtaccgggtaccgggacggaaacccgtaacggtacgtacccgttaccgtaccggtactaaccgtacccgaacggtccgtaccccggtccccgtaccggtacctaccggttccgttcccgttacccccgtccccg

SEQ ID NO: 252696 - DNA, 541 bp, Homo sapiens
  misc_feature: GYAE6OF02GGB6E.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaaatgacgttggtacttataattctgtctcctggtaccaacaataccccggcaaagtccccaaactcatgatctttgaggtcagtgatcggcccgcaggggtttctcatcgcttctccggctccaaagtctcggcacgcacggcctccctgaccatctctgggctccaggctgaggacgaggctgattattactgcagctcatataacaaacataaacacttgggtgttcgggcggcgggaaccaaacgtcgaccgtcctacggtcacgcccaaggcctagcccctcggtctactctcgttccctacccc

SEQ ID NO: 252697 - DNA, 799 bp, Homo sapiens
  misc_feature: GYAE6OF02GD4OF.49.35.D02.1.454.CMB.1.raw
  modified_base (344)..(344): a, c, t, g, unknown or other
  misc_feature (344)..(344): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactaggaaccaccaatgtacgttggtaacttataattctgtctcctggtaccaacaactaccccggacaaacgtaccccaaactcatgatcttgagtcagtgagtccggccgcgtaggggtttcncgtatccgtcttccgtccggtcctaccgaagtcgtggacagcgaccgtccctcccgtacgtacctacttccgtcgtcgggtcccttaccgacggtccgtagggaacgggaccggtacggaccgttagttaacgttttactttaaggtttcgtacgtttacggtttactaacgtttacgttccgggttaccgggttacgaagggttttaccgggtttaccgggggtaaccgggggtttaacggggggtttaccggggtttacccgggggaacgggggtaaaccggggtaaaccgggttaaacggggttacccgggtaacccggtttacccgggttaaccgggtacccgtaaccggggaacccccggtaaaccgggttccccggttacccccgggttacccccgttcccgggttaccctaaccccggtttcccgtaccccgggtttcccccccccgg

SEQ ID NO: 252698 - DNA, 913 bp, Homo sapiens
  misc_feature: GYAE6OF02F8S0D.49.35.D02.1.454.CMB.1.raw
  modified_base (215)..(215): a, c, t, g, unknown or other
  misc_feature (215)..(215): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgcgtctgggtctcctggacagtcgatcaccatctcngcactcggaaccaccaatgtacgttggtacttagtaattcgtgtctcctggtaccaacaactaccccggcaaacgtcccccaaactcatgattcgtttggacggtcagtgacgtccggcccgtacgtacggggttttctactacgtcgtactttccgtaccggcttacccgaagtttccgttacgggactacggccgtaacccggtccccgttaccccgtacggaacccctaacgtttcccgttcggttacccggggtacccttaccccggtaacgggtaccggttacgggtaaccgggggaaccgggtaaccgggtaccgttaacgggtttaaaccgttttaaccgtttaaccgtttccggacgttacggttacccgttaaacgtaaaccgttttaaacttaaaacccgtaaaaccctaaaaccgtttaaaacccggtttaccgggtttttaaccgggggtttcggtttaacccgggggtaacccggggttaccccggggtaaaacccgtttaaacccggttacccgggttaaccccggtttaccccgttaaaccgggttcccggtaaaacccggtacccccggtaaaccgggtccccgtttttacccccggaccccccccggtttacgggttacccccggtttaaccccgtttccccggttttacccccggttacccccccgttttaaccccccgg

SEQ ID NO: 252699 - DNA, 812 bp, Homo sapiens
  misc_feature: GYAE6OF02GL4QY.49.35.D02.1.454.CMB.1.raw
  modified_base (248)..(248): a, c, t, g, unknown or other
  misc_feature (248)..(248): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactgaaccacaatgacgttgtactatatctntctctgtacaacataccccgcaaacgtccccaaactcatgattcttgacggtcagtgacgtccggccgtcgtacggggtttctactacgttccgtccttccgtcccggtcctacccgtaacgttccgttacggcctaacggtacccgaacccgggtcccccttaccccgttaccggaacccctacgttacccgtccggttacggggcccgttcccgaacgggtccgttacgggaacggggtaaccggacgggtacgttacggttaaacgtttacgtttaaccgttcggtacccgtacggtacccttacgtaaacgttaaccgtaaacctaaaacgtaaaccgttaaaaccgttacggttttaccggggttacgggttttacccggggaccggggtaacccgggtaaaaccctaacccgggttaccggtaaccccggttacccgtaacccggttaccgtaacccggtaaccccggtaacgggtccccgttaccccggtacccccgttcccggggttaacccttacccggtttccccgtttaccccggttccccccggttaccccc

SEQ ID NO: 252700 - DNA, 637 bp, Homo sapiens
  misc_feature: GYAE6OF02JS3PN.49.35.D02.1.454.CMB.1.raw
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggtcagcagctacaggtgcccagtcccgggtccagctggtgacaagtctgggctggaggtgagaagccgtgggtcgtcggtgaggtctcctgcagcttcnggagacaccttcaacaactttgntgtcagtgtggtgcgacacggccccgtaggacaacggcttaggcgtagggtgggaaggatccaccccgttagtacttaactactaagactaaacgtactagaccactaacgactaacgttacccgaacgtacccgaaaggtacgtacctaacccgtttacgtccgaccggtaaaccaaacttaccccgaacgtaaaccacgtacgtaaccctaacgtagtaaccgactacgacgcgaacgtacgtacggaacttcgacggcccgtacgaaccggaccttagttaaacgtttctcgtagtaccgaggtgtaacggtctacgttcgtttacagttgaacgttagttacgtacgtacttattatacgg

SEQ ID NO: 252701 - DNA, 723 bp, Homo sapiens
  misc_feature: GYAE6OF02FY7KE.49.35.D02.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctctcactcagggcacagggtcctgggcccagtctgccctgactcagcctgcctccgtgtctggtctctggacngtcgatcaccatctcctgcactggaaccncaatgacgttgtactatatctgtctcctgtaccaacaactaccccggcaaacgtaccccaaacgtactatagacttcgtttagaggtcgagttgacgtaccggcccgacgtacggggtttctacgtatccgtaccttctcccgggtcctaccgaacgttcgtcggtacgtacgaccgaaccggtccctccccgttgaacccgtaacgttcccgttaccggttcgggtacccgtcccgtaaccgggtacgtcgggtacgggtaacggtaacgggtcgttacggtaactttacgttaacgtcgtacacgtacctactaacttaactaaccgtaaaccaaacgttaaacctacgtttacggggttagtttaccggggaccggtacccggggtaaactaaccggtaccggtacccgttaccgtaccgtaccgaaccggtacccgaacggtcctaccggtcccccgttacggtccacccgttccttcccgtcccttacccccg

SEQ ID NO: 252702 - DNA, 715 bp, Homo sapiens
  misc_feature: GYAE6OF02JZ3E5.49.35.D02.1.454.CMB.1.raw
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatcgtcctgacactggaacccacaagtcgacgtttaggtaccttaataacgttctgtcctccgtggtaaccaacaactacccccgganaaaccgtccccaaatcgatgtactcgttagacggtcagtgactccggccgtcgtagggttcnctactcgcttccgtccggctccgatctggactagcaccggtcctccgtcacctatctcgtggacctcgagtccgtaggacggcgtagtctgtaactttagtaccgtaggctagtacccttactaagtaaccctaaacggaaaacttaacttaaacccggtacggtttaccggggttaccggtacgggggttaacccgggacggtaaaccctaaaccggtttcccggtaccgttacccggtaaccggttcccgaacggttacccccggtaacgggttccccgtacccgttacccccccggttagttaccccgttaacccggttccccgttcccgttaacccccccggttaaccccc

SEQ ID NO: 252703 - DNA, 575 bp, Homo sapiens
  misc_feature: GYAE6OF02GEDIM.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaactaactttgctgtcagctgggtgcgacgacggcccctggacaaggtccttggaggtggggtagggaaggatccacccctataccttaatatagactaaactatgcacagacattccacgacagacgtcctaccctagtccgacggacaaactccaacgaaccacacgtacctaacagttacggaactgaccgacacgtacctaggactcctcggacccgacgaccggccgttaattatttccgtgtcgacgtaggagtaggcttgttactttatagttagtattaacggttaccttagtactagtttatacg

SEQ ID NO: 252704 - DNA, 678 bp, Homo sapiens
  misc_feature: GYAE6OF02JWTLT.49.35.D02.1.454.CMB.1.raw
  modified_base (204)..(204): a, c, t, g, unknown or other
  misc_feature (204)..(204): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtccgtcgggcccagtctgccctgactcagcctgcctccgtgtctgggtctctgacagtcgntcaccatctcctgcactacggaaccacaatcgtacgttcggtacttatattctgtctctcgtacaactaactaccccggacaaacgtcccaactcagtagacttcttgtagtctagtgtagtccggccgtcggtaacgggtttctcgtactccgtcttccgtccggacctctacgtcgtcgtagacgaccgaccggtcctccgtcgacccgtacttccgtcggttacgcctaccgtcggaccgtgggacgggtacggacggtacttcggaaacttttactacgtcgtactacgtacctaactactaaactaaacaacgtaaacttaaaacggtcgtttaacgggtcggtaccggtcgggaaaccgtaaccgtaaccgtccgtaccgtccgtaacgtccgaacccgtacgtaaccggtcctcccggaccccgttacggccgttaccctccggttacccgttcccccgttaccccg

SEQ ID NO: 252705 - DNA, 696 bp, Homo sapiens
  misc_feature: GYAE6OF02FZNWQ.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactcggaaccaccgaatcgacgttgtacttatattctgtctctgtacacatacccgcaacgcccaactcatagatacttgacgtcagtgacgtcggccgtacgtacggggttctacgacgtcgtcttcgtccggtctaccgaacgttcgtcggctacgaccgaccggtccctcccgtacgacctacttccgtacgtcgggtcccttacccgaacgggtcgtacgggtaacgggtacggacggtcgtaacgtacttacgtttaccgtcgtacctacggtacctacgtaactaaccgtaacaaacctaataaaccgttaggttacggttcggtttacggaccggtaccgggtaaaccaaccgttcgtacccgtccgttaaccgtcggtaaccggaaccccggtaacggtacccgtacccggttcccccgttacggttacccgtacccgttccgttaccccggtttccccgttacccccg

SEQ ID NO: 252706 - DNA, 684 bp, Homo sapiens
  misc_feature: GYAE6OF02HB2NP.49.35.D02.1.454.CMB.1.raw
  modified_base (339)..(339): a, c, t, g, unknown or other
  misc_feature (339)..(339): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccacaatgacgttgtacttataattctgtctcctggtaccaacaactaccccggacaaacgtccccaaactcatgattctttgagtcagtgacgtcggcccgcgtaggggtttcncgacttcgtccttcgtccggcctaccaagtctcggcacgccaccggcctccctacgaccactcctcgtacgggcctccgaggtcgtaggacgggacgacggtctaggtaattttagttacttcggacctacgtcctagtaactaactaaacctaaaacgtaaacttaaaccgtaggtttacgggttacggttacccggggacgggtacccgggtaaaccaaaccggttccgtaacccggttccgttaaaccggtccgaaccggaccccggtaaacggtcccgtaccccggtcccccgttccggtacccttaaccggtccctttacccggttaccccctacccccg

SEQ ID NO: 252707 - DNA, 649 bp, Homo sapiens
  misc_feature: GYAE6OF02GC54G.49.35.D02.1.454.CMB.1.raw
  modified_base (147)..(147): a, c, t, g, unknown or other
  misc_feature (147)..(147): n is a, c, g, or t
  modified_base (439)..(439): a, c, t, g, unknown or other
  misc_feature (439)..(439): n is a, c, g, or t
  modified_base (487)..(487): a, c, t, g, unknown or other
  misc_feature (487)..(487): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtccngggcccagtctgccctgactcagcctgcctccgtgtctgggtctcctggacagtcgatcaccatcctcctgcactggaaccaccaatgacgttggtacttataatctgtctctgtaccaacaactaccccggacaacgtaccccaaactcatcgaatctttaggagttcagtgagtccggaccgcgtacggggttttctcacgttcgtcttccgtccgtacctaccgaacgtcttcggacacgccaccggtccctccctacgacctacgtccgtacgtcgggcctaacccgnggccgtaggacggaccggaggtccgttagtacttaacgttactcgacngtacctcgtaataactaacctaaaactaactaaccgtagttacgggttacgttccgggacggtaccggaacctaacgtacgtacccgttacgaccgtacgacgtaccgacgtccgtaccggtcccctcgggttaccaccgttccgttacctcccctaccccg

SEQ ID NO: 252708 - DNA, 820 bp, Homo sapiens
  misc_feature: GYAE6OF02H65OU.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggactagtcgatcaccatcctcctgcactacggaaccaccaatcgacgttagttactaatacttcgtctctccgtacgtaaccaaccaaccgtaccccggacaaaccgtaccccaaactcaactgtattactttggacgttacgagtcggacgtccggccgtacggttacgggtttcctcgtacgtccgtccttccggtacctccgtacctagtccgtaggaccgtacgtccgaccggtcctacccgtacaccttactccggtcgtccggtacctccgacgggtcctaggggaacggtacggtaggtacttaagtttaaccgtttaagtttccgacgtacttaccgtaaccgttattaaacctaaaacgttaaaaccctaaaactttaacgttaaccgggtttagggtttccggggttaacgggtacccgggggtaaacccggggtacccggttaaaaccctaccgggtttacccgggttaccccggttacccgttaaacccggtaaccggtaaccccgggttaaccgggaccccgtttaccccgttaccccggtcccccgttttaaccgggaaccccctttaccccggtttccccgtttacccccggtttcccccctaaccccg

SEQ ID NO: 252709 - DNA, 686 bp, Homo sapiens
  misc_feature: GYAE6OF02JC6AU.49.35.D02.1.454.CMB.1.raw
  modified_base (249)..(249): a, c, t, g, unknown or other
  misc_feature (249)..(249): n is a, c, g, or t
  modified_base (308)..(308): a, c, t, g, unknown or other
  misc_feature (308)..(308): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcgtggcagtcgatcaccatctctgcactggaccacatgacgttgtacttataattctntctctggtacaacataccccggcaaacgtccccaaactcatgacttcttagagtcagtnagtccggccgcgtaggggttctcgtatcgtcttaccgtcccggtctaccgaacgtcgtacggtcgaaggccgaaccggtcccgttacccgtacggaaccctaacgttcccgtcggttacggggccgttcccgagggtcctagggtaacggggacggaggtccgttagttaacgttaaccgtttacgacgtaccgtaggaccttactaaactactaaacctaaacgtaaactaaacgttaccggtttagggttccggtaaccgggtcggtaccggaaaccgtaaccgttacgacccgttcgtaccgtacgaccgaccgtaccgtaccgtacccggtccctaccgggtcctaccgttaccgtcccttacccgttaccccc

SEQ ID NO: 252710 - DNA, 650 bp, Homo sapiens
  misc_feature: GYAE6OF02IZZHB.49.35.D02.1.454.CMB.1.raw
  modified_base (329)..(329): a, c, t, g, unknown or other
  misc_feature (329)..(329): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctggcccagtctgccctgactcagcctgcctccgtgtctgggtctcctggacagtcgatcaccatctcctgcactggaaccaccaatgacgttgtacttataatctgtctctggtacaacaactaccccggacaacgtccccaaactcatgatcttgagtcagtgatcggccgcgtagggttcnctactcgtcttcgtccggctaccgaagtcgtggccacgccgaccggtcctcccgtcgacctacgtcctcgtcgggccttccgacggtctggacggtacggagtctaggtaacttacgttctcgtacgtcgtaccttactactaacgtaactaaaactacttaaaccgtacgtttacggggtcgttaccggggaccgggtaccggaaaccttaacgtaccgtacccgtacggtacccgtaaccgtaccggtaccgtaacgtacccgttcccggtacccccgttacggtaccctaccgttccgttacccgtccccctaccccg

SEQ ID NO: 252711 - DNA, 663 bp, Homo sapiens
  misc_feature: GYAE6OF02HWJQN.49.35.D02.1.454.CMB.1.raw
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctggcccagtctgccctgactcagcctgcctccgtgtcgtgggtctcctggacagtcgatcaccatctcctgcactacggaaccaccaagtgacgttcggtacttaatattctgtctcctgtaccaacaagtacccgacaaacgtcccaaactctatgatcttgagtacagtgacgtcgcccggtgtacgggttctcacgtcgtcttccgttccgctacctaaggtcgttgacgacgacgccggtccctccgcgaccactcgtcgttacgggcctcggcggtactacggacgggaaacgtcggtcgttaacggtaattttataacgttcggactaggtcctacgaatttaacaaacgtaaaagaaactaaacccggtaagttcgggttacgttccgggtcgggaaccggttaaaccacgggttacacccggttacttaccggacttaacggaccccgtaaggtcctacccgggtccccctacggttcctaccgtacctttaccggtccccgttcccc

SEQ ID NO: 252712 - DNA, 767 bp, Homo sapiens
  misc_feature: GYAE6OF02FT51U.49.35.D02.1.454.CMB.1.raw
  modified_base (282)..(282): a, c, t, g, unknown or other
  misc_feature (282)..(282): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcacctatcctcctgcactcggaacccacaatcgtacgttgtacttatattctgtctctgtacaacactacccganaacgtacccaaactcatgattcttgaggtctagtagactccggccgtcgtacgggtttctcacgtcgtcttccgtccgcctccgtaacgttcgtcggtacacgtccgaccggtcccttacccgtctaccgacttccgtaccggtcggtccgttaccgacggtaccgtacgggaacgggtaaccggacgggtcttacgggtaacttttaacgttacgtacggtacgtacgtacctaacgtaaacttaaaccttaaaactaaaaacccgaaacttttaaaacccggtacggttttaggggttaccgggttaccggggtacccgggtaaccgggtaaacccgtaaaccgttaccgggtaccccttaacccggttaccgtaaccggtacccgaaccccgggtaaccggttacccgtccccgggtacccccgttaccgggttacccaacccggttttcccggttaccccggttacccctttaccccccgg

SEQ ID NO: 252713 - DNA, 748 bp, Homo sapiens
  misc_feature: GYAE6OF02GBCRM.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctccgtgtactggaaccaccaatgacgttgtacttatattctgtctctgtacacacacccggcaacgcccaactcatgattcttgaggtctagtgacgtccggcccgcgtacggggtttcctcgtactcgtctttccgtcccggtccgttaccgtaaggttcgtcgggaccgaggcccgtacccgggtcccttcccgtcgaaccctaccgttccgtttccggtacgggtccctcccgacgggtccgttagggaacggggacccggtacggtcgttacgttaacgtttaactttacgttacggctaccggttcctaaccgttaaagttaaaccttaaaaccgaaaactaaacgttaaaacccgttaggtttaaccggggtttacgggttaccgggttaccgggttaccgggtaaaccccgtaaacggttacccgtacccggttacccgtaccgttacgaaccggtcccgtaacggtccgttcccgtcccccggtccggttacctacccgttcccgttcccgtttccccgcccgttccc

SEQ ID NO: 252714 - DNA, 728 bp, Homo sapiens
  misc_feature: GYAE6OF02F6R86.49.35.D02.1.454.CMB.1.raw
  modified_base (308)..(308): a, c, t, g, unknown or other
  misc_feature (308)..(308): n is a, c, g, or t
  modified_base (369)..(369): a, c, t, g, unknown or other
  misc_feature (369)..(369): n is a, c, g, or t
tcagagtcgagagacacgaccggtgctcgatttagcacacgatagttgggtttggggggggtctcaggaggcagcgctcgtcgggacgttctccaccatggcctgggctctgactattcctcgaccctctcactcgagggcacagggtcctgggccctagtctgccctgtactcgagcctgcctccgtagtcgtggtctcgtggactggtcggatccgaccatcctcgtgcctagtcggaacccacaatggacgttgtacttagtaattcgtgttctcctacggtaaccaactaacgtacccccgganaaaccgtccccctaaagtccatgacttcgtttggaggttccaggtcggatccgggacccgnggttacggggtttctcgtagtccgtcttcgaccggtactaccgtaagtctacggactacgctaccggtcctcccgtagaccctattcccgtcgtgggtccctcggaaggctacggaggacgagtactagtaatttagtcgttgactcgtaactcgaaattacgtaaaccgtaaaataacgttaaccggtacgtttcgggttaccgggttaccgggtccgggtaaccgtaaacgtaacccggtaacggacccggttaccgtaaccggttccgaaccgggtacccgaaccggtccgtaccccggtacccccggttacgttacccgtacccgttccggtttaccggttcccccgtcccccgg

SEQ ID NO: 252715 - DNA, 814 bp, Homo sapiens
  misc_feature: GYAE6OF02J2EGW.49.35.D02.1.454.CMB.1.raw
  modified_base (392)..(392): a, c, t, g, unknown or other
  misc_feature (392)..(392): n is a, c, g, or t
  modified_base (580)..(580): a, c, t, g, unknown or other
  misc_feature (580)..(580): n is a, c, g, or t
  modified_base (606)..(606): a, c, t, g, unknown or other
  misc_feature (606)..(606): n is a, c, g, or t
  modified_base (618)..(618): a, c, t, g, unknown or other
  misc_feature (618)..(618): n is a, c, g, or t
tcagagtcgagagacacgaccggtgctcgatttagcacacgatagttgggtttggggggggtctcaggaggcagcgctcgtcgggacgtctccaccagtcggcctgggctctgctactcctccaccctcctcactcgagggcacgacgggtcctgggccctagtctcgaccctgacctcacgtcctcgcctcgtgtcgtcgggtcctaccgtacggactacgtcactcccacctactcctaccgtcggaccacgtaaccgaaaccctacgttaacgtacgttaacgtttacgttaacttacgttaccttccgttccggtacctacccggtaactaaccccaaaccgtacccgtaaccccgaacctaaaccgtacccctaaagtcttaacgtntttacgttcgtagggtactaacgttcggaccgtccgtacccggggtttcctaccggggttttacgtccgtctaccgttccggttccctacgggttacccacctttaacgggccgttacgaccgtaaccgtcccgtaccggtcctacccgtacgtaccctcgtcgtccgtaccggtcgtacctacgggngtacgacgggacgtacgtcgtttaanacgttagtaccnggactacctgaaccttagtaactaactaaactacggtagttccggtggaccggtccgtacgaccgaaacccgtcgtaccgtcccgtacccaggttaccccgaccggtacccgacggtaccccccgttccggtacccctttcccggtaacctccccggttaccccttaaccccgtttccccccgtaccttaaccccg

SEQ ID NO: 252716 - DNA, 661 bp, Homo sapiens
  misc_feature: GYAE6OF02GVHC2.49.35.D02.1.454.CMB.1.raw
  modified_base (227)..(227): a, c, t, g, unknown or other
  misc_feature (227)..(227): n is a, c, g, or t
  modified_base (304)..(304): a, c, t, g, unknown or other
  misc_feature (304)..(304): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactgaaaccngcagtgatggtaggaattacttaacctttctcctgtaccaacaacaccaggacaacgacccccaatcatctattagngacggccatcgacggccggtccctcgacggggttcctcgtacgtactccgtctttccgtacgtcgcctacccgtacggttcgtacggctacgccgtacccgggtccctcccgtacgaacctaacgttccgtacggtcgggtccgttccggacggggtcggtacgggggaccggaggtcgttagttatttagtttacgttcgtcgtttagtctaagttcgtcggtccggttagtacgttacgggtcggtaaccgggttaaggggttcggtacgggacgggtacggtacgtaggtccggtacccgtacggtacgccgtacgaccggacgtccggtaccgtccccggtagtcctctcccg

SEQ ID NO: 252717 - DNA, 656 bp, Homo sapiens
  misc_feature: GYAE6OF02H6ICL.49.35.D02.1.454.CMB.1.raw
  modified_base (281)..(281): a, c, t, g, unknown or other
  misc_feature (281)..(281): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaccacaatgacgttgtactatattctgtctcctaggtaccaacaacgtaccccgganaaacgtccccaaactcatagatctttgacggttacagtcgtactcggcccgacgtacgggtttctacagttccgtcttcctccggcctaccgaacgtctaggctacgcgtaccggccctacccgtcgaccctactcgtcgtcgggtctccgaggtccgtacggacggaacggtcggtactaggtactttaagttaccgtggactacgtctactaataactaaacgtaaactaataaaccgtacgtttcgggtacgttcggggtacggacggtaaaccaacgtcggaccgtccctacgtccgtacgacccggtaacggtcctcccggtccccgttacgggtaccctaacccgttcgttacccgtcccccgtccccg

SEQ ID NO: 252718 - DNA, 630 bp, Homo sapiens
  misc_feature: GYAE6OF02HWZH5.49.35.D02.1.454.CMB.1.raw
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (406)..(406): a, c, t, g, unknown or other
  misc_feature (406)..(406): n is a, c, g, or t
  modified_base (441)..(441): a, c, t, g, unknown or other
  misc_feature (441)..(441): n is a, c, g, or t
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
tcagagtcgagagacacgaccggtgctcgatttagcacacgatagttgggtttggggggggtcgtcgaggaggcagcgctcgtcgggacgtctccaccatggcctgggctctgctattcctcacctcctcactcagggcacgagggtcctgggcccagtctgccctgactcgagcctgcctccgtgtcgtgggtctcctggacacgtgatcaactctctccgtagcagtacggaaccacaaatcgacgttggtaatataattctgtctcgtgtaaccaacgaacgacccgacaaacgtacccctaaacncatagaattcgtttgacgtnagtgattccgccgcgtagggtttcatactgtctctccggacctccgagttacgcgtcgaagccgaacgtcctcccgnacctagcctagtcggctcgagcgagagcgagcgancgttaatagtgaccagtacctcgaataactaanaaaaccgtaaanaacgtaaccgttaggtcgtttacggcggggccggaaaacgtaaccgacggaacccgttccgttacggacttaaccggacgttaaccggaacgtcccgttccccggtacggtaccctacggtttacctaccgtcccggtttcccc

SEQ ID NO: 252719 - DNA, 702 bp, Homo sapiens
  misc_feature: GYAE6OF02HFGOQ.49.35.D02.1.454.CMB.1.raw
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
  modified_base (347)..(347): a, c, t, g, unknown or other
  misc_feature (347)..(347): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtcgaaccacaatgacgttgtaacttatatctntctctagtaccaaacaactaccccgganaaaccgtcccaaaactcatcgtattcttaggagtacagtcgagtccggcccgtgtacgggttctnacgttccgtcttccgccggtctaccgtaagtcgtcggtaccagtcccgaccggtccctcccgtgaaccctcgttacctcggtacgggccctcggaagcgtacggaacggtacggtacggtacgtagttaacgtttaaacttacctgtaccgtacgtactactaaactaagtaaaccaaactaaactaaaccgttaacgttcgggtttacgggtaccggacggggtaaaccggtaacctaacgggtaccgttacccgtaaccgtttaccggaacctaccggtaaccggtaaccggtacccgtttccgacccccggttacggttacctccgttaccgtttcccgtaccccttccccg

SEQ ID NO: 252720 - DNA, 719 bp, Homo sapiens
  misc_feature: GYAE6OF02I83SF.49.35.D02.1.454.CMB.1.raw
  modified_base (211)..(211): a, c, t, g, unknown or other
  misc_feature (211)..(211): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaaccntcgtctgcactcggaaccacaagtgacgttgtacttatacttctgtctcctagtaccaacaactacccggactaacgtacccaaactctatcgtactcttagagtcagtagacgtccggccgtcgtacgggttctcgtactcgtccttccgtccggtacctccgtaacgtcgtacggcgaacgtccgtaccggtccctcccgttacgaacccttacgtccgttcggtaccggtccgtacccggtaacggtccggtacgggaacggtaccggtaacggtccgtacggttaacttttacttacggttacggtacctaacggtccttaacgtaactaaccgtaaaacctaaacgttaaccgtaaaccgttcggttacgggttccggtacgggtaccggggtaccgtaaaccgtaacgtccggtacccgttaccgtaccgtacgtaccggtacgaccgtcccgtacccgtcccgttacgtccgtacctccgttaccccgtccccttaccccg

SEQ ID NO: 252721 - DNA, 772 bp, Homo sapiens
  misc_feature: GYAE6OF02IA16H.49.35.D02.1.454.CMB.1.raw
  modified_base (215)..(215): a, c, t, g, unknown or other
  misc_feature (215)..(215): n is a, c, g, or t
  modified_base (261)..(261): a, c, t, g, unknown or other
  misc_feature (261)..(261): n is a, c, g, or t
  modified_base (354)..(354): a, c, t, g, unknown or other
  misc_feature (354)..(354): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtcctccgtggacagtcgatcaccntcctcctgcacgtacggaaccacaatgacgttgtacttatattctntctcctgtaaccaacaacgacccgacaaacgtacccaaactcactagtattcgttacgtaggtcgtagtgacgtccggccgtcgtcgggttcncgtagtctccgttccgtccggtctaccgtacgtccgtgaccgacgtaccaccggtccctacctacgtaccctaccgttcgttaccggtcggtacccgtccggtacgggtcgtacgggaacgggtaccgggtacggtacgttagtaactttaacgttacgtcgacgtacgtaccttacgtaaacttaaccgaaaacttaaacctaaacgttaaaccggttaccgggtttacgggggtacccgggtttacggggccccgggttaaaccgggtaaaccccgtaaaccgttcccgggtaaccccgggtttaccggtacccggttaacgaacccggtacccgaaccgggttcccgtcccccggttaccccggtacccggtacccgttacccgttcccgtttaaccccgtccccccttacccgg

SEQ ID NO: 252722 - DNA, 620 bp, Homo sapiens
  misc_feature: GYAE6OF02FVPY6.49.35.D02.1.454.CMB.1.raw
  modified_base (395)..(395): a, c, t, g, unknown or other
  misc_feature (395)..(395): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactaccccggacaaacgtccccaaactcatgattcttgaggtcagtgactccggccgcgtagggtttctcagtccgtcttcgtccggctcctaagtctggcacgcaccggcctcccgcgaccnttcctcgtcggcctccgaggtctaggaggaccgaggtctagtacttacttacgcgtcagtctactataacaaacctaaactaactaaaccgtcggttaggggttcgttacgggaccggaccggtaacctaacgtcgtacccgttcctaccgtcgaaccgacccgtaacggtcctcccggtccccgtcggttaccctaccgttccgttcccgttaccccgtccccg

SEQ ID NO: 252723 - DNA, 560 bp, Homo sapiens
  misc_feature: GYAE6OF02H0CQ2.49.35.D02.1.454.CMB.1.raw
  modified_base (411)..(411): a, c, t, g, unknown or other
  misc_feature (411)..(411): n is a, c, g, or t
  modified_base (551)..(551): a, c, t, g, unknown or other
  misc_feature (551)..(551): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttcgtggagacaccttcaactaactttgctgtcagctagggtgcgacgacggcccctggacgaaggccttggagtggggtgggaaggactaccacccctataccttaatatagacaaactatgacacagaactagttaccacgtacaagtacgtcctaacccttancgtacggaactaaacgtccaacgaacacacgacctaacagtacggaactcgacgacacgtccgtagactcgtcgaccgcgacggactattcgttctgtagcgagagagtatgttacttactagtgtattagtacttagtnttattgtcg

SEQ ID NO: 252724 - DNA, 668 bp, Homo sapiens
  misc_feature: GYAE6OF02GX2UU.49.35.D02.1.454.CMB.1.raw
  modified_base (487)..(487): a, c, t, g, unknown or other
  misc_feature (487)..(487): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactcggaaccacaatgacgttgtacttatattctgtctccgtgtaccaacaactaccccggacaaacgtccccaaactcatgtactacttggaggtcaggtgacgtccggccgtgtacgggttctcgactccgtcttccgtcccggtctccgaagttcgcggcgagccgtaccggcccttacccgcgacctacgtccttcgtcgggtcctccggacggcgtacggaacgggacgtaggtcgtagtaactttattaccgtgacgtacncgtacagtaactaaacaaactaaacgtaacgtacgtttagggtcggttcgggaccgggtaaccggtaaaccgtaaccgtaccggtacccgttaccgtaaccggtccgaaccgtacccgaacggtccgtaccccgcccgttaccgtaccgttaccgttcccgttcccgtaccccttaccccg

SEQ ID NO: 252725 - DNA, 933 bp, Homo sapiens
  misc_feature: GYAE6OF02JKS8X.49.35.D02.1.454.CMB.1.raw
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccaccaatgacgttggtacttataattctacgtctcctcggtaccaactaactaccccggactaaacgtaccccaaactactactagtattccttagtacggtcctaagtcgtaagtccggtacccggcggtacggggttttctccgtacgttccggtccttccgtcccggtactacccgtaacgtttcgtacggtaccacgtaccggtaccggtaccccttaccccggtacgtacccgtacgttccgttaccggtacggggtccctacccggtaacgggtcgttacgggaacgggtaaccgggtacggtacccggttaggttaaacgttttaccgtttaaaccggttcgtaaacccggttaacggtacccgtttaccggtaaactttaaacccgttaaaacccgttaaaaccgggttaaaaccttaaaacccggtttaaccgggtttttacggggggttaacccggttttacccgggggggtacccgggggtaaacccggggtaaaaccccgttaaacccggtttaaccgggttacccccgggttacccgtttaaccccgggtttaaccgtaaaccggggttaacccccggtaaccggggttaccccgttttaccccggggtacccccccgtttaaccggggtttaaccccgttaaacccggtttcccgggttttacccccggtttccccccggttaaccccccg

SEQ ID NO: 252726 - DNA, 556 bp, Homo sapiens
  misc_feature: GYAE6OF02GDXF2.49.35.D02.1.454.CMB.1.raw
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (358)..(358): a, c, t, g, unknown or other
  misc_feature (358)..(358): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (524)..(524): a, c, t, g, unknown or other
  misc_feature (524)..(524): n is a, c, g, or t
  modified_base (552)..(552): a, c, t, g, unknown or other
  misc_feature (552)..(552): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatcgtgggctgaggtgagaaagcctgggtcgtcggtgaaggtctcctgcaaggcttcgtgganacaccttcaacaatttgctntcagcgtggtgcgacncggcccctggacgagccgttgaggtgggtagggaggtatccaccctataccttaatatagacaaactntcgacacagacacttccacgacaagactacaccttagcgacgactaacncccagaccacacacctanagtcggaacctgcgaccacgcgtacggactcgcgacccgtacgaccggtacgttacttactttcgtgtcgacgtaggacgaggtattcgttaccgtttntagttggtattaggttaactgtatattntacg

SEQ ID NO: 252727 - DNA, 615 bp, Homo sapiens
  misc_feature: GYAE6OF02F3289.49.35.D02.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (318)..(318): a, c, t, g, unknown or other
  misc_feature (318)..(318): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcacntctcctgcactgaaccacaatgacgttgtacttatattctgtctctgtacaacaactacccggacaacgtcccaactcatagattcttgaggtcagtgagtccggccgngtgggtttctctagtcgtctcctccggctacgtagtctggcagccgtaccgccctccgtcaccctatcctcgtggctcgcggctggacggacggacgtcgtagtatttacttacttcggacgacgtcctagtactaacaacaaacctaataaaccgtcggtttaggttcggttacgggacggtaccggaaccgtaacgtacggtaccgtaccgtacgtaccgacgacccgtaacggtaccgttcccggtaccccgttacgtcccgtaccgtcccgttacccgttccccgtacccccg

SEQ ID NO: 252728 - DNA, 719 bp, Homo sapiens
  misc_feature: GYAE6OF02JJK1I.49.35.D02.1.454.CMB.1.raw
  modified_base (290)..(290): a, c, t, g, unknown or other
  misc_feature (290)..(290): n is a, c, g, or t
  modified_base (345)..(345): a, c, t, g, unknown or other
  misc_feature (345)..(345): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtcctgggtctccgtggacagtcgatcaccattcctcctgctacgtacggaaccaccaatgacgttggtacttatattctgtctcctgtaccaacaacgtaccccgganaaacgtaccccaaactcatcgaattcgtttgaggtccagtcgacgtccggcccgnggtaacgggtttctcgacgttccggtccttacgttcccggtacctaccgtaacgtcgttacggaccacggtccgtaccggtcccctacccgtacgacctaccgttccgtacgtcgggacctccgaggtctacggaggacgaggtctaggttacttacgttacgcgtacgtacgtcttactaataactaacaaaacctactaaacgttaccgggttaggtcggttacgggacccgggaaccggtaaacctaaccgttaccgggtacccgtaaccgttcggtaccgtaaccggtacccggacggttacccgtacccggtaccccccggtttagggtacccttacccggttcggtttacccgtcccgttaccccccg

SEQ ID NO: 252729 - DNA, 528 bp, Homo sapiens
  misc_feature: GYAE6OF02H02K0.49.35.D02.1.454.CMB.1.raw
  modified_base (440)..(440): a, c, t, g, unknown or other
  misc_feature (440)..(440): n is a, c, g, or t
  modified_base (452)..(452): a, c, t, g, unknown or other
  misc_feature (452)..(452): n is a, c, g, or t
  modified_base (489)..(489): a, c, t, g, unknown or other
  misc_feature (489)..(489): n is a, c, g, or t
  modified_base (497)..(497): a, c, t, g, unknown or other
  misc_feature (497)..(497): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttcgtggagacacctttcaacaactttgctgtcagctgggtgcgacacggcccctggacaaggccttggagtgggtgggaaggatccaccctataccttaatatagacaaactatgacacagactattccacgacagacgtaccacccttatcgacgacaaactccaacgaacacacgcctacatggaactgacncagccaggatcncgccgacacggcctattattcgtgtcgcgagagagtntgttcttntatgtaattacgtacttagtacttattatcg

SEQ ID NO: 252730 - DNA, 726 bp, Homo sapiens
  misc_feature: GYAE6OF02GU6G8.49.35.D02.1.454.CMB.1.raw
  modified_base (256)..(256): a, c, t, g, unknown or other
  misc_feature (256)..(256): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (530)..(530): a, c, t, g, unknown or other
  misc_feature (530)..(530): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctggtctctggacagtcgatcaccatctcctgacactacggaaccactaagttcgacgttggtacttatattcngtctccgtcggtaccaacacgtaccccggacaaacgtccccaaactcatgctcttagngtcagtancgtccgccggtcgtacgggtttcctacgtacgtcgtccgttaccggtcccggtacctaccgttaacgtccggtggaccgtaacgggcctaaaccggtccccgtcccgtacgaacctacgtttccgtaccgtggggtcccctacggacggtcgtaggaccgggtacggacggtctaagggtacttaacgttacgcggtactaccggttntaactacttaaccgtaaacaaacgtttaaaccgtaaccgttagggtttacgggttacggttacgggtaccgggtacccggaaccgtaaaccggttccgtaccggttccgtaacggtaccgaaccgtaccggtaaacgtcccgtaaccccgtcccgttacggtacccttccggtaccgttcccgtccctttaccccg

SEQ ID NO: 252731 - DNA, 565 bp, Homo sapiens
  misc_feature: GYAE6OF02IZEXY.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaagggtctcctgcaaggcttcgtggagacaccttcaacaactttgctgtcagctgggtgcgacacggccccgtggacaaggtccgttggaggtgggggtagggaagggactcccgaccccgtattaccctttaatatagacaaactatagacacagactattaccacgacagtacgtacctacccttagtccgacggacaaactccaacgaacacacgacctaacatcggaactgccgacagccgtaggactcgtacgccgacacggcctattattcctgtgcgagagagtatcgttcgtttctagtagattacggttacttagtactattagttcg

SEQ ID NO: 252732 - DNA, 734 bp, Homo sapiens
  misc_feature: GYAE6OF02I3QFS.49.35.D02.1.454.CMB.1.raw
  modified_base (321)..(321): a, c, t, g, unknown or other
  misc_feature (321)..(321): n is a, c, g, or t
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccaccaatgacgttggtacttagtaattccgtgtcctcctggttaccaactaataccccggacaaacgtccccaaactccatgattcttgagtntacgtgactcggcccgcgtacggggttctcatcgtcttcctccgctaccgacgtcttggctagccgaccgtcctcccgtcgtacctacgttctacggtcgggccgtccgtacggtccgtacggtacgggtacggtacggtacgtacgtaatttaacgttaaccgtggtacctacgcctactaacgtactaaaccaaaacgtaaaccgttaaactaaccgggttttacgggtacggtttaccggggccgggtaacccggggtaaacccgtaaaccgtttaccggaccccggttacccgttaccggtaacggtaacccggtaacccggaaacggttcccgtacccggttacccccccggttaccggtaccccgttaccgttaccccgtttacccggttaccccccttacccccgg

SEQ ID NO: 252733 - DNA, 739 bp, Homo sapiens
  misc_feature: GYAE6OF02IY6CC.49.35.D02.1.454.CMB.1.raw
  modified_base (251)..(251): a, c, t, g, unknown or other
  misc_feature (251)..(251): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactacagggcacgagggtcctgggcccagtctcgccgtgacctcagcctgccgtcgtgtcgtgggtcctcgtggacctaggtccgatccacctatcctctgctactacggaaccaactaagngtacgttagtacttattaattctgtcctctacgtaaccaacacctaacccgactaaccgtacccaacttacagtagtacttcgttaggtacgtctagtacgacgtcccgccggacggttcggttacgtcacgtccgtctaccggtccgacttaccgtaacgtcgtacggcacgaccgaccgtcctcccgtacgtaccgtacgttccgtacggtccgtctaccggacgttacggacggaacgggttacggacgggtacttacgtaactttaacgttaccgacgtcgtaaaccctagtaccctaataaacccggtaactaaaacctaacggttaaccgtaacgggttaccgggttagggttaccgggaaaccggttaaccgaaacgttacccgaaccggttccgtaccggtacgtacccgtaaccggtacacccggttaccgtcccgttacccggacgacctttaccgtaccgtccgttaccccctcccg

SEQ ID NO: 252734 - DNA, 899 bp, Homo sapiens
  misc_feature: GYAE6OF02JF4XT.49.35.D02.1.454.CMB.1.raw
  modified_base (130)..(130): a, c, t, g, unknown or other
  misc_feature (130)..(130): n is a, c, g, or t
tcagagtcgagagacacgaccggtgctcgatttagcacacgatagttgggttggggggggtctcaggaggcagcgctctcgggacgtctccaccatggcctgggctctgctattcctcaccctcccatcncggacgacaggtccgtcggaccgacgtctcgtcctacgtacgtcacgcctcgcctcccgttcgtcgtcggttacgtccctcggacgtacgtcgactactaccgactactcctacgtcgactacgtaacccgtaaccaactaggtaccgttcggttaacctttaagttaaacttccggttcgttaccgtttcccgtacgggttaacccggtaaacctaaaccttacccccgggaccccgtaaaccgttaaccccccgtaacctaactccggtataccgtttacctttacggtacgggttccgtaacggttcgtaaccgggttcccggaccccggtccggttacggggttttaccgttccctagtaccggttcccgttccgtttccccgggaccttaccgtaacccggtggttgacccgtacgtccggaccgttacccgtacccgtcgtaaaccgtccttcggtccgtttcggaccggttaccgaccggttaccggtaccgtaacgggtaacgggtaccgggtaccgtacgttaacgttaacgttaccgtacggtacgtaccgttactcggtaacctaacgtaaacctaaccgtaaacgtaaacttccgggttaacgggttccggtaccgggtccgggtaaccggtacgtaaaccggtacgttacccgtacgttacccgtccgtaaccgttaccggaacggtcccggtacccgtaccccgttaccggtacccgtccggttaacctcccgggtttacccgccccttacccgg

SEQ ID NO: 252735 - DNA, 855 bp, Homo sapiens
  misc_feature: GYAE6OF02GZPZM.49.35.D02.1.454.CMB.1.raw
  modified_base (288)..(288): a, c, t, g, unknown or other
  misc_feature (288)..(288): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtaggacaggtcgatcacatcctcctgcacgtcggaaccacaatcgtacgtgtactatattctgtctcgtacgtacaacaacgtaccccganaaaccgtcccaaactcatagtacttcgttaggaggtcagtcgtacgtccggccgtcggtacggggttctacgtacgttccgtcgtttccggtccggaccttacccgtaaagttccgtacgggacctacggtaacccgtccggggtacccctacccggtaacgaaccctaacgttccggtacggtccggggtacctaccggtaacggtccgttaggggaacgggttaaccgggagggtacttaacggttactttaaaccgttacgtacgaccgtaacggttcctaacgtaaactttaaccgtaaaaccgaaaaccgttaaaaacgttaacccgtttacgggtttacggggttaacccgggtttaccgggggaacccggggtaaacccggtaaaaccccgtaacgtttacccgggtaaccccgggtttaacccggttaccggtaaacccgggtaacccgggtaaccccggtaacccgggtaccccgttacccccgggtacccccgttaacccgggtttaccccgtaaccggtttccccggtttaccccggttacccccgtttccccccg

SEQ ID NO: 252736 - DNA, 660 bp, Homo sapiens
  misc_feature: GYAE6OF02JFZI1.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaacgtccccaaactcatgatctttgaggtcagtgactcggcccgcgtacggggtttctcacgtcgtcttcctccggctccgaagtctggcagcgacggcctccctgaccactcctcgtcgggcctccgaggctaggacggacgaggctagtacttacttacgtcgcagtcctactaactacttaacgaaacctaacttaaaccgtacgtttaggggttacggtttaccggggccggggtaaccgggtaaaccctaaacggttaccggtacccgttaccgtaaccggttacccaaccggtacccgtaaacggtccgtacccggtacccccggttccggtacccgtacccgttaccgttcccgttacccccttacccccg

SEQ ID NO: 252737 - DNA, 647 bp, Homo sapiens
  misc_feature: GYAE6OF02GR1SG.49.35.D02.1.454.CMB.1.raw
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcactggaaccaccaatcgacgttggtacttataattctgtctcctggtaccaacaactaccccggacaacgtaccccaaactcatcgattcttgagtcagtgagtccggcccgtcgtaggggtttcctcgtactccgtcctttccgtcccggtctaccgtaacgtcgtggctacggaccgaccggtccctcccgtggaaccctatccgtcgtcgggcctacccgacgggctggacggtacggaggtctagtattagtacgtnacagccttanaataacgtaaacaactaaactaacgtacgtttacgggtcgtttaccgggcgggtaccgggaaccgtaacgtcgtacccgttacctacggtacccacggaccccgtaaggtccctcccggccccgtcggtactacccgtcgttcccttacccctaccccg

SEQ ID NO: 252738 - DNA, 775 bp, Homo sapiens
  misc_feature: GYAE6OF02I969N.49.35.D02.1.454.CMB.1.raw
  modified_base (525)..(525): a, c, t, g, unknown or other
  misc_feature (525)..(525): n is a, c, g, or t
tcagagtcgagagacacgaccggtgctcgatttagcacacgatagttgggtttggggggggtctcaggaggcagcgctctcgggacgtctccaccatggcctgggctctgctattcctccaccctcctcactcagggcacagggtcctgggcccagtctgccctgacctcagcctgccctccggtgtctgggtctccgtggacagtcgatcaccatctcctgcactggaaccacaatgacgttgtacttatattctgtctccgtggtaccaacaactacccccggcaaaccgtaccccaaacttcatcgtattctttggacggttcgagttggactccgggcccgtcgtaaggggttttccgtactacgtcgtccttccgtccggtccctcctaacgttcgtgggtcctacgcccgaccggtccccgttacccctcggaacccctacgttccgttccggtcgggaccttcccggacggtcgtaggacggaccgggtagtcgtacgtaattacttacggtgtaacngtcctactaaacgtaacttaaaccgaaactaaaccgtaaccgtaacggtttaggggtttaccggttccggggccggggtaaacccgggtaaaacccgtaaacgttaccccgggtaccccgtttaacccgtaacgggttccccaacgggtaccctaaacccgggtccgttaaccccccgggttccccgtttaccccgggtacccttacccgtttaccccgtttcccccggttacccccctttaccccccgg

SEQ ID NO: 252739 - DNA, 906 bp, Homo sapiens
  misc_feature: GYAE6OF02HVPXN.49.35.D02.1.454.CMB.1.raw
tcagagtcgagagacacgaccggtgctcgatttagcacacgatagttggggtttgggggggggtctcaggaggcagcgctctcgggacgtctccaccatggcctgggctctgctattcctcacccctcctcactcagggcacgagggtcctgggcccagtctcgccctgactcagcctgcctccgtgtcgtgggtcctccgtggacaggtcgtatccaacctatccttccctgacctaccgtacggaaacccaccgaatcggtacgttggtaacttaataacttctgttccttcgttcggtaaccaacaactaccccggactaaaaccgtcccccaaaactccaatacgtattcctttaggaggttcaggtcggtacgtccggccccgtggttaacggggtttcctacgtaacgttccgtccgtttccggtcccggtacctacccggtaacgttccggtacggtccgtaacggcccgtaccgggtaccccttcccgtaccgtaacctaccttccgtccggtccggggtaccttaccccgggacgggtccgtaacgggaaccggggaacggtaccgggttacgttaagggttaccttttaacgttaccgtacggtaccgtaacgttacctaacgtaaacctttaaaccgttaaaaacgaaaacccgtttaaaacgttaaaaccggtttacggttttaacggggggttaccgggtttaacccggggacccggggggttaaacccgtaaaacccggttaaacccgtaccgggtaccccggttaaccgttaacccgggtaccggtaaacccggtacccccggtaaacggtccccgttaaccccggacccccggtttaccggtacccttaccccggtttcccgtttacccccgtacccccggttacccccc

SEQ ID NO: 252740 - DNA, 754 bp, Homo sapiens
  misc_feature: GYAE6OF02JQMNU.49.35.D02.1.454.CMB.1.raw
  modified_base (195)..(195): a, c, t, g, unknown or other
  misc_feature (195)..(195): n is a, c, g, or t
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctccnggacagtcgatcaccatctcctgacactggaaccacaatgtacgttggtacttatattctgtctctcggtacaacaactcccgacaacgtccccaaactcatcgatctttgagtcagtgactacggccgactaggggttctacgtactcggtcttcgtccggctccgtaagtcgttcggacgtacacgtacggtcctcccgtacgaccctacgtccttcgtacggcctaccgacgtccgtaggaacgggtacgtacgggtcttaaggtactttacgtttacgccgtacgtacggtccttaaccgttataaaccggttaaacctaaaaccgtaaaccgttaaaccttacggggtttaaccgggggttacgttacccgggggtaaccgggtaaacggggtaaacccctaacgggttacccggttacccgtttaacccggttaccgtaccccgggttaacctacccgggaaccggtttaccccgtacccgggttacccccccgttaccggggtaccccttaacccggtttcccggtttaccccggtcccccggtttcccccc

SEQ ID NO: 252741 - DNA, 665 bp, Homo sapiens
  misc_feature: GYAE6OF02IB2TU.49.35.D02.1.454.CMB.1.raw
  modified_base (198)..(198): a, c, t, g, unknown or other
  misc_feature (198)..(198): n is a, c, g, or t
  modified_base (215)..(215): a, c, t, g, unknown or other
  misc_feature (215)..(215): n is a, c, g, or t
  modified_base (315)..(315): a, c, t, g, unknown or other
  misc_feature (315)..(315): n is a, c, g, or t
  modified_base (343)..(343): a, c, t, g, unknown or other
  misc_feature (343)..(343): n is a, c, g, or t
  modified_base (475)..(475): a, c, t, g, unknown or other
  misc_feature (475)..(475): n is a, c, g, or t
  modified_base (504)..(504): a, c, t, g, unknown or other
  misc_feature (504)..(504): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacaggtcctgggccagtctcgccctgactcagcctgcctcgtgtcgtgggtctcctggacngtcgatccacatctccngcacgtcgaaccacaatgacgttgtacttatattctgtctcgtcgtaccaacaacgtacccgactaaacgtacccaactcatcgtacttcgttggacgtnagtcgactccggccgacggtacggttcncgtatcgtcttcgccgtcgtaccgtaacgttcgtacggacgtacgacgtaccggtcctcccgtacgacctacttcgtcgtacggtcaccggtcgtcgtaggacggacgtacggtctaagtactttacgtacncgtacacgtacctaactataaccgtaaanaacttaacgttaacttacgggttcggttcggtaccgggtcggtaaccggaaccttacggaccttacggttccgttaacggctaacccggaccgttaacgggtcccctaccggttccccggttcgtacctaccggtttcccgtttaccgacccccttcccgg

SEQ ID NO: 252742 - DNA, 754 bp, Homo sapiens
  misc_feature: GYAE6OF02G5SLX.49.35.D02.1.454.CMB.1.raw
tcagagtcgagagacacgaccggtgctcgatttagcacacgatagttgggtttggggcatcacataacaaccagattcctcctctaaagaagcccctgggagcacagctcatcaccatggactggacctggaggttcctctttgtggtggcagcagctacaggtgcccagtcccgggtccagctggtgcaatcgtgggctgaggtgagaaagccgtgggtcgtcggtgaaggtctccgtgcaagggcttcgtggagacaccttacaactaactttgactgtcagcgtgggtgcgacgacggccccgtagggtacaacggtcttcggtagggtggggttagggaacgggacttaccgaacccccttagttacccctttaaagtaacgtaacgtaactaaaacgtactagactaacgaacgaactactttacccgaaacgtaacaacgttaccggtacccttaaccccgtttaacttccggaaccggtaacgtaaaaaccgttaccccgaaaccgtaaacccgaaccgaaccggttaacccttaaccgaaacggttaccgggttaaacgttccgggaaccgaaccgtaacgtacccgttaacgggtacttacccgttcggacccggtaaccgaccgggtaccgttaacgtttaacttttccgtaggttcggaccggaagtacggtaagtgttaccggtttctttagtactttaggtacgttaagttaccggttaagtttaccttagtttattacgg

SEQ ID NO: 252743 - DNA, 734 bp, Homo sapiens
  misc_feature: GYAE6OF02JCH7U.49.35.D02.1.454.CMB.1.raw
  modified_base (288)..(288): a, c, t, g, unknown or other
  misc_feature (288)..(288): n is a, c, g, or t
  modified_base (351)..(351): a, c, t, g, unknown or other
  misc_feature (351)..(351): n is a, c, g, or t
tcagagtcgagagacacgaccggtgctcgatttagcacacgatagttgggtttggggggggtctcaggaggcagcgctcgtcgggacgtctccaccatggcctggctctgctacttcctcaccctcctcactcaggcacagggtcctgggcccagtctgccctgactcagcctgcctccgtgtctgggtcctcctggacagtcgatcaccatccgtctgcacgtggaaaccaccaatcgtacgttggtaacttaataattctgtctcgtcggtacaacaactcccganaaacgtccccaaatcatcgattcgtttgagttacagtagacgtccggccgcgtagggtttccncgacgttcgcttccgtccggtcttaccgaagttcgtcgacgacgcctacggcctcccgagtaaccacgtccgtcgtcgggtccttccgaaggtcaggacggacgcgacgttgaactttaatcgtacgcgtactccgtaactaataacgtaaccgaaaactacgttaaactacgggtttaggggtaccgttaccgggtaaccgggaaccggttaaacccgtaaaacgggtttccgggttaaccccggttaacgtacccgggttaacccggaaaccggtacccggttaacgggttaccccgtttaccccggtacccccggtttaagggttaccccccgtaaaggtttaccccccgggtttcccggtttaccccccgtccccccgg

SEQ ID NO: 252744 - DNA, 668 bp, Homo sapiens
  misc_feature: GYAE6OF02FNZZX.49.35.D02.1.454.CMB.1.raw
  modified_base (326)..(326): a, c, t, g, unknown or other
  misc_feature (326)..(326): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacgagggtcctgggcccagtctgccctgactcagcctgcctcgtgtctcgggtctcctggacagtcgatcaccatctcctgcacgtggaaccacatgacgttgtacttatattctgtctctggtaccaacactaccccggacaaactaccccaaactcatgattcttgaggtcagtgacgcggcccgngtacgggttactcgtatcgccttcctccggcctaccgaacgttccgtcggactacggccgtaccggtccctccctacggacccttacgtcctcgtcgggtcctacgacggtcgtagggaccgggtacggagggtccgttacgtaaacttagttttaccgcgtaccggactccgttactactaacgtaaacaaaactaactaaaaccgtcggttagggttacggtttacgggcgggtaccggtaacctaaacgtcgtaccgtccctaacggtcaccggtacccgtaacggcccgtcccgtaccccgtccggttaccaccgtccgttccggttacccctccccg

SEQ ID NO: 252745 - DNA, 732 bp, Homo sapiens
  misc_feature: GYAE6OF02ICD8R.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaccaccaatgtacgttgtacttatattctgtctctgtacaacacgtaccgactaacgtacccaaactcagtcgtattctttaggacggttcgtacgtagacgtccggcccgtgttaccgggtttctacgtacgtccgtcttaccgtccgacctacctacggtcgacgctacgccgaccggtcctcctacgctacgtcgtacgtcgggacctcggtacggcgtacgggaacgggtacgacggtcgttaacgtacgtttacgtacgttcggactcggactactaagtaacctaaacaaactaaacttaacgtagggttacgggtacgggtttacccgggacgggtaacccggtaaaccgtaaccgttacccggtaaccccgtttaccgttaacccggtaaccggtaaccccggtaacccggtaacccggtaccccgtttaccccgggacccccgtttaccggtaccctttaccccggttaccctttacccccggttcccccttaacccccgg

SEQ ID NO: 252746 - DNA, 739 bp, Homo sapiens
  misc_feature: GYAE6OF02GLSR9.49.35.D02.1.454.CMB.1.raw
  modified_base (212)..(212): a, c, t, g, unknown or other
  misc_feature (212)..(212): n is a, c, g, or t
  modified_base (305)..(305): a, c, t, g, unknown or other
  misc_feature (305)..(305): n is a, c, g, or t
  modified_base (435)..(435): a, c, t, g, unknown or other
  misc_feature (435)..(435): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcgatccaccntctcctgcacgtggaacccacaagtgacgttggtacttatattctgtctcctcggtaccaacaacgtaccccgacaacgtaccccaactcatntattcttagagtcagtgtacgtccggccgcggtacgggtttctcgattccgtccttccgtcccggtcctaccgtaacgtcgtcggacacgaccgaccggtcccttacccgacgtacctacttccgtccgngggtcctccgtaggcgtggacgggacggacgggtctaacgtacttttagttaccgttgaccgtaacgtccttaacgtaagttaaacctaaaccctaaaactaaaccttaaaccggttaccggttttacggggttcgggtttaacccggggacgggtaacccgggtaaaccgttaaccgttaccggtaacccgttacccgttaccggaaccgtaaccggaccccggtaacgggtccccgttaccccggtaccccggttccggttaccctaccggtttcccgtttccccggttccccttaccccgg

SEQ ID NO: 252747 - DNA, 754 bp, Homo sapiens
  misc_feature: GYAE6OF02JLH3E.49.35.D02.1.454.CMB.1.raw
  modified_base (539)..(539): a, c, t, g, unknown or other
  misc_feature (539)..(539): n is a, c, g, or t
  modified_base (574)..(574): a, c, t, g, unknown or other
  misc_feature (574)..(574): n is a, c, g, or t
tcagagtcgagagacacgaccggtgctcgatttagcacacgatagttgggtttggggggggtcgtcaggaggcagcgctctcgggacgtctccaccatggcctgggctctgctattcctcaccctcctcactcagggcacagggtcctgggcccagtctgccctgactcagtcctgcctccgtgtcgtgggtctccgtggactgtcgatcaccatcctccgtgcacgtcggaacccacaagtgacggtttcgtacttaagttaattctcgtaccttccgtcggtaaccaaccgaaaccgtaccccggtacaaaccgtacccctaaacctacgtactagtacttagtttacggtacggtccgtaagttcgtaccgtaccggaccccggtacggttacggggtttcttccgacttccgtaccttcccgtccggtaccttacccgaacgttacgtccgacgtacgccgtaaccggtcccttacccgtcgtaacccacgtaccgttcgtaccggtccgtacgtcggccgtacggacgtacggngtacgtacgttacttattaccgtcgtacgtacgtntaccagtaacaaaccgtaaattaaccggtaacttagggttcggttacgggttccgggaaccggtaccggtaaaccgtaaccgttaaccgcccggttaacccgtacggtacctaaccgaaccgtaccgtcccggtaccgtcccggttacgtacctcctccgttacccgtccccttaccccg

SEQ ID NO: 252748 - DNA, 593 bp, Homo sapiens
  misc_feature: GYAE6OF02JYLYS.49.35.D02.1.454.CMB.1.raw
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (497)..(497): a, c, t, g, unknown or other
  misc_feature (497)..(497): n is a, c, g, or t
tcagagtcgagagacacgaccggtgctcgatttagcacacgatagttgggtttggggggggtctcaggaggcagcgctctcgggacgtctccaccatggcctgggctctgctattcctcacccctcctcactcagggcacagggtcctgggcccagtctgccctgactcgagcctgcctccgtgtctgggtctccgtggacngtcgatcacatctcctgcacgtggaaccacatcgacgttcgtacttatattcgtntctcgtcgtaccaacactacccgactaaccgtacccaactcactgtacttcttgacgtcgagtcgacgtcgtcccgcgtacgggttctcgtactcgtcctcgtccgtctccgtagtcgngcacgcaccgctccncacctatctcgtgctacgngcncggacgacgtcgtcgttagtaacttgtacgngacgtnactactatacaactaactactacgtacgggttcggtcggtaccgggnggaacccggactaacgtccgtacgttacctaccgcgtaccgaccgtaaccgtccgtccgtacccgtcgaccttactcccgtacccgtcccgtaccc

SEQ ID NO: 252749 - DNA, 751 bp, Homo sapiens
  misc_feature: GYAE6OF02HH1LA.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctcgccctgactcagcctgcctccgtgtctgggtcctcctggacagtcgatcaccatctcctgctactacggaaacccaccaagtgtacgttggtacttaatattctgtcctctacgtaccaactaacgtaccccgacaaaccgtaccccaaactcatgtattcgttagacgtctagtacgacgtccggccgtacgtacggggtttctaccgtagttccgtccgttccgtcccggtactacccgtaacgttccgtacggacgacggacccgaacccgggtcccttaccccgtacgaccctacgtccgttcggtacgggtcctaccgcgggtacgtacgggacggtacgaacggtccgtaagttacgtttaacgtctcggacctacgtaccgttactaataaacctaaactaaaaccgttaaacgttaaaccgttagggtttcgggttaccgggttaccggggacgggtaacccggaaacctaaccggtaccggtaccccgttacgtacccggcgtaaccgaccccggtaagcccgttaccccggtccccgttaccggtaacctccgttacccgttccccgttaccccttaccccg

SEQ ID NO: 252750 - DNA, 771 bp, Homo sapiens
  misc_feature: GYAE6OF02HKK1Z.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcgatcaccatcctcctgctacgtcggaaccacaatcgacgttagtacttataattctgtctccgtacgtaccaacaacgtaccccgacaaaccgtaccccaaactccagtgtacttacgtttacgtaggtcagtacgacgtaccggccgtcggtaggggtttctctacgtcgtcttccgtccggacctccgaacgtcgtcggccacgccgtaccggtccctacccgtacgacctacttccgtccggtacgtcccgtaccgacggtcgtacggaacggtacggacggtccttaggttaacctttcgtttaaccgcggttaccgacgtaccttactaacgttaaactaaaccaaacgttaaccttaaacgttacggggtttacgggttaccgggttacccggggacggggtaaaccccggtaacggtaaacccgttacccggttacccgttaccggtacccggttaaccggaacccggtaacccggtacgggtaccccttccccgggtaccccgttaccggtaccgttaccccgtttcccgtttacccccggttacccccttaccccccgg

SEQ ID NO: 252751 - DNA, 752 bp, Homo sapiens
  misc_feature: GYAE6OF02HFYD5.49.35.D02.1.454.CMB.1.raw
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
  modified_base (349)..(349): a, c, t, g, unknown or other
  misc_feature (349)..(349): n is a, c, g, or t
tcagagtcgagagacacgaccggtgctcgatttagcacacgatagttgggtttgggggggtcgtcgaggaggcgagcgctctcgggacgtctccacatgcctgggctctgctattctcacctcctcactcagggcacagggtcctggcccagtctgccctgactcagcctcgcctccgtgtcgtgggtctccgtaggcagtcgatcaccntcgtcctgcactgaaccacaatgacttgacttatatctgtctctggtacaacaacgtacccgacaacgtacccaaacgtnaactgtactcgtttgaacggtcctagcgtactcccggccgtaccggtagggttttaccngtactcgtcgttcgtccgtactaccgtaagtcgtgacacgccgccggtacctccgacgacctactccgtcggtccggtacctaccggaggtacgtacgggtacggaaacggtcggtacgttagttaagtttacttacggtaacgtcgtacttacctacgtaaactaacgtaaaccgtaaaacgttaacctaaacgggttaaccgttttacggggtacggtttacccggggaccggggtaacccgggtaaaccgttaaaccgggtacccgttaacccggtacccgttaccggtaacccgaaccggaaccccgttaaccgggtaacccgtttccccggaccccggtttacccggtacccttaaaccggtttaccccgtttaccccggttacccccctaaccccgg

SEQ ID NO: 252752 - DNA, 680 bp, Homo sapiens
  misc_feature: GYAE6OF02JS7IM.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttgtacttatattctgtctctgtaccaacaactacccggacaaacgtaccccaaactcatgatcttagaggtcagtgacgtccggaccgcgtacgggttctcgactcgtcttccgtccggctctagtctggcacgcgaccgtcctcctagaccagtcctcgtcgggcctaccgacggtcgtacggacggacggtaggtctaggtactttaacgttacgtacgtcctacggtaccttacgtaattaacgtaaaccaaaacgtaaacgttaaaccgttaacggtttcggggttacggttccggggtaaccgggaccgggtaaacccgtaaaccggtaccggtacccgttaccgttaccggtaccgtaaccgtcccgtaaccggtccgtacccggtacccccggttacgtaccgtaccctcccgtttaccgtacccccgttaccccg

SEQ ID NO: 252753 - DNA, 682 bp, Homo sapiens
  misc_feature: GYAE6OF02JL18C.49.35.D02.1.454.CMB.1.raw
  modified_base (523)..(523): a, c, t, g, unknown or other
  misc_feature (523)..(523): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctcgccctgactcacgcctgcctcgtgtctgggtctccgtggacagtcgatcaccatcctctgcactcgaaccacaagtcgtacgttggtacttaatattctgtctcctacgtaccaacaacgtaccccggacaaaccgtccccaaactcatgtacttctttggacgtcacgtgacgtccggcccggcggtacgggtttcacgtacgttcgtcctttccgtaccggtcctaacctacggttcgtacgggtacgtacggccgtaaccggcccctttccccgacgtacctacgttccgtcggtaccgggtcctaccgacgggtctacgggacggggaaccgaggtccttaaggtactttaacggttancgtacgtacgctaactataactaacaacgtaataacgttacgggttggttacggttcggacggtaccgtaaaccacgtccgacccgttactaccggtcaaccgtcccgagtcccgtaccggtcccctcggtacctacctccgttccggtacccctcccg

SEQ ID NO: 252754 - DNA, 644 bp, Homo sapiens
  misc_feature: GYAE6OF02IWOEI.49.35.D02.1.454.CMB.1.raw
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccccggcaaagtccccaaactcatgatctttgaggtcagtgatcggccgcaggggtttctcatcgccttctccggctccgaatctggcagcacggctcccngaccatctctggctccgnggtctgaggacgaggtctgtattattacgtgccagctctataactactaaacaacttaaacaaccgtttggggtacggtttaccgggcggggaccgggaacccgtaaacgttccggaccccgttacccgttaccggttcccgtaaccgacccccggaaacgggtcccgttacccggtcccccccccggttagggttacccccgttaaccccgtcccggtttacccggtttcccccccggttaccccccg

SEQ ID NO: 252755 - DNA, 812 bp, Homo sapiens
  misc_feature: GYAE6OF02IHQCZ.49.35.D02.1.454.CMB.1.raw
tcagagtcgagagacacgaccggtgctcgatttagcacacgatagttgggtttggggggggggtctcaggaggcagcgctctcgggacgtctccaccatggcctgggctctgctattcctcaccctcctcactcagggcacgagggtcctcgggcccagtctgccctgactcagcctgcctcgtgtctggtctctggacagtcgatccaccatcctcctgcacgtacggaaccaccaagtcgtacgttcgtaacttatagttctgttcctcgtcgtaaccaacaacgttaccccgacaaacgtaccccaaactactatcgtacttctttaggacggtacgtaggtacgtcgtaccggcccggtacggttacggggtttacctacgtacgttcgttccgtttaccgtccggtaccgttaccggtaacgttccggtcggacgtacggccggtaccggtccctttaccgaccggtaaccctacttccggttccggttacggtccgttaccgggcggtacggttacgggaacgggtaaccgggtacggtcgttaactttaacggttttaaccttaacggtcgtccgtacgttaccgtaacttagtaaacctaaaccgtaaaaacgtaaacttaaaccggtttaggttccggggttacgggttaccggggacccggggtaaacgttaacccgtaaacgttaccgggtacccgttaccgtaacggtaacccgaccggtaaaccgtaccggttaccgtaccccggttcccggttaccggttcccttacccgttcgtttcccccgtaacccctttccccg

SEQ ID NO: 252756 - DNA, 731 bp, Homo sapiens
  misc_feature: GYAE6OF02IQJZ9.49.35.D02.1.454.CMB.1.raw
  modified_base (247)..(247): a, c, t, g, unknown or other
  misc_feature (247)..(247): n is a, c, g, or t
  modified_base (364)..(364): a, c, t, g, unknown or other
  misc_feature (364)..(364): n is a, c, g, or t
tcagagtcgagagacacgaccggtgctcgatttagcacacgatagttgggtttggggggggtctcgaggaggcagcgctctcgggacgtctccaccatggcctgggctctgctattcctcaccctcctcactcagggcacagggtcctgggcccagtctgccctgactcagcctgccttccgtgtctgggtctcctggacagtcgatcacatctcctgcactgaaccaccaatgacgttgtacttanaattctgtctctgtaccaacaactacccggacaaacgtaccccaaactacactagtaacttacgtttgacggttacgtaggtgtaacgtccgggccccgtcgtaacggggtttcctntactccggtcttccgtcccggctcctaaagtccggtcggctaacgccgaaccgggtccctaccgtccgtaacctactccgttcgtcgggtccgtcccgtaggtccgtagggtagggacgacggtcgtagtaacgttaacttacttagtaccgtagtcttaacctattaaactaaacctaaaaacctaaacgttaaaacttaccggtttaacgggttcggtccggggtacgggtaacccggaaacctaaacggttaccgacccgttacccgtaacggtaccgaacccggtacccgaaacggtcccgtacccgtccccgttccgggttaccctaaccggttccctttaccggttccccccttaaccccg

SEQ ID NO: 252757 - DNA, 906 bp, Homo sapiens
  misc_feature: GYAE6OF02JXDO7.49.35.D02.1.454.CMB.1.raw
  modified_base (556)..(556): a, c, t, g, unknown or other
  misc_feature (556)..(556): n is a, c, g, or t
tcagagtcgagagacacgaccggtgctcgatttagcacacgatagttgggtttggggggggtcgtcaggaggcagcgctctcgggacgtctccaccatggcctgggctctgctattcctcacccctcctcactcagggcacgagggtccgtgggcccagtctgccctgactcacgcctgcctccgtgtctgggtcctccgaggacagtcgataccaccactcctcctcaccgtactaccgggaacccaacctaatacggtacgtttacggttaacctttaagttaacttcttcgttacctccccgttacggtaacccaaaccgtaaaccgtaccccccggtaaccgtaaaaccctaaccccccaaacctaccgtatacgtaacttccgtttacgtacggtactaaggtcggaacgtcccggcccgtacggtacgggtttcctaccgtattccgtacttccgttacccgaccttcgtaacgttcgtacggtacgacgtcccgtaccggtccccttcccgtaacggaccctacgttccggttcggtcccgggttaccncggtacggtccgcggtacgggaccgaacggtcgttaggtaacttttacgtaccgtcggactaccggttactaacgtaacttaacgttaaaacccaaaactttaaaccgttaaaccggttttaccgggttaacggggtttccggggttacccggggcccggggtaaaacccgggtaaaaccctaaccggtttaccccgggttacccggtttaaccggtaccccggtaaccggtaacccggtaaccccgggttaacccgggttaccggttaccccccggttaacccccggttcccgggttaaaacccttcccgggttttaccctttcccccggttacccccgtttaaccccc

SEQ ID NO: 252758 - DNA, 732 bp, Homo sapiens
  misc_feature: GYAE6OF02HOVNX.49.35.D02.1.454.CMB.1.raw
  modified_base (255)..(255): a, c, t, g, unknown or other
  misc_feature (255)..(255): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctctgcacgtcggaaccacaatcgacgttgtactatattctntctctagtaccaacaactacccgactaaacgtcccaaactcagtgtattacgtttgaggtctaggtcgtacgtccgggcccgtggttacgggtttctacacgttccgtacttccgtccggtcctaccgaacgtccgtggacgtacggccgtaccggtccctacccgtacgtaacctaccgttcgttaccgtccgggtccgtacccggtacgggtacccgtagggaaccgggtacggaacggtccgttacgggttaatttaacgtacgttcgggtacaacgttcgtaataacttaactaaactaaaactaactaaacgttggttacgggttacggttaccgggaccgggaccgtaaaccgtaaacgtccgttaacccggttaccttaacggtaccggaccgtacccgtaaggtcccgttacccgtccccgttacgggttacccttacgtttccccgttacccggttccccttaccccg

SEQ ID NO: 252759 - DNA, 561 bp, Homo sapiens
  misc_feature: GYAE6OF02FJB66.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaagcctgggtcgtcggtgaaggtctcctgcaaggcttctggagacaccttcaacaacttcgctgtcagctgggtgcgacaggcccctggacaaggccttgaggtgggtgggaaggatcaccctatccttaatatagacaaactatgcacagactataccacgacagacgtcacccttatccgacggaacaaactccaacgaacacacgacctacgatacggaactgacgcacgaccgtaggactccgtagcccgaacgaccggtaccgttattacgtttctggtcgacggagacggagtacgtgttacctttacgtagttacgtaattacggtaccttagtcttatttatcg

SEQ ID NO: 252760 - DNA, 832 bp, Homo sapiens
  misc_feature: GYAE6OF02GXYOL.49.35.D02.1.454.CMB.1.raw
  modified_base (106)..(106): a, c, t, g, unknown or other
  misc_feature (106)..(106): n is a, c, g, or t
  modified_base (171)..(171): a, c, t, g, unknown or other
  misc_feature (171)..(171): n is a, c, g, or t
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (588)..(588): a, c, t, g, unknown or other
  misc_feature (588)..(588): n is a, c, g, or t
tcagagtcgagagacacgaccggtgctcgatttagcacacgatagttgggtttggggggggtctcaggaggcagcgctctcgggacgtctccaccatggcctgggntctgctattcctcacctcctcactcagggcacagggtcctgggcccagtctcgcccgtgactcgngccgttgccttccgttgtctgggtctccgtacggtacagtcgatccaactntcctcctntcgctacggaaccaccaagtgtacgttgttactattaacgttctcgtctccgtagtaccgtaactaacgtaacccgtaccgtaaactacccaaccgtactacttacgtaacttcgttttaacggaggttacgacggttacggtccgtcccggaccgggtaccggttacgggtttccgtaccgtaccgttcgttccgttccgtacccgggtccttaccgtaacgttcggtacgccgtacggtccgaaccgtcccttccgacggttactaccgtctccggtacggtccgtccggtacggtcgtaccgggtaagtacgggtacgtaccgttagtacgttaacctttacgacggttcgtacnccggttaatattaaacctaacgaaaactaaccgttaaccggttaaccgggttgggttaccggtttcccgggaaccgggtaccggtaaacccgtaaccggttaccgaacccgggttaccgtttacccggaaccgggttacccgaaccgggtaccccggtttaccgtaacccccgggttcccccggttaccgtttaacccgggtccccgttttaccgttaccccgggttcccccccttaaccccgg

SEQ ID NO: 252761 - DNA, 723 bp, Homo sapiens
  misc_feature: GYAE6OF02H23FY.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcacgtgaaccacaatcgacgttgtacttataattctgtctcctggtaaccaaactaacgtaaccccggacaaacgtaccccaaactcatacgtattctttgacggtctaggtgacgtccggccccggtacggttacggggtttcctcgtacgttccgtccgtttccgtccggtacctaccgtaacgttcgtggacctagaccgtacccggccttcccgtacgacctacgttccgtacgtcggtaccttccgaggtcgtaggacgggtacggaggtcgtaaggtactttacgttacgtacggtactacgtctactaaataccgttaaaacaaaccgtaaacttaaacgtacggtttcgggtacgggttaccgggtaccgggaacccggtaaccgtaacgtaccgtaaccccgttaccgtacggtaaccgtaccgacccgtaacggtccctaccccggtaccccgttcgttaccgtcccggttacccttacccgttcccctaacccccg

SEQ ID NO: 252762 - DNA, 765 bp, Homo sapiens
  misc_feature: GYAE6OF02JFY51.49.35.D02.1.454.CMB.1.raw
  modified_base (387)..(387): a, c, t, g, unknown or other
  misc_feature (387)..(387): n is a, c, g, or t
tcagagtcgagagacacgaccggtgctcgatttagcacacgatagttgggtttgggggggggtcgtcagggaggcagcgctctcgggacgtctccaccatggcctgggctctgctatcctcaccctcctcactcagggcacgagggtccgtcggcccagtcctcgccctgactcagcctgcctccgtgtcctgggtcctccgtggaccagtcgatcaccatcctctgcacgtacggaaccaccaatcggtacgttaggttacttaatatttcgtcgttactaccgtacggtacctaaccgacctaaccccggaacaaccgtaccccaaactcatacgtacttcgttagacgtacgtagtcgtacgtccggccgtcggtacgggttcncgtactccggtcttaccgtccgtcctcgacgttcgtacggaccacggcctacccggtccctaccgttaccgaccgtacgttcccgtcggtcggggtccctttaccggcggtaacggtcggaacgggcggtacggtacttataccggtttactacgtggtaaccgtcggttaccacttaaacgtaacctaaacttaaccgtaaaactttaacgggtcgttaccggggttcggtaccgggttcccgggaaacgttaacccaacgggtttaccgaccgttaccgccgttaacgtaaccccggaccgtacgtacccgtacccggtttaccccgtcggttaaaccccgtcccgttccccgttacccggtcccccctttcccgg

SEQ ID NO: 252763 - DNA, 746 bp, Homo sapiens
  misc_feature: GYAE6OF02H6BXJ.49.35.D02.1.454.CMB.1.raw
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtcctgccctgacctcagcctgcctccgtgtcgtgggtctcctggacagtcgatcaccatcctcctgcactcggaccacaatcgtacgttggtacttataacttctcgttctccgtacggtaaccaactaaccgtaaccccggacaaaaccgtacccccaaactcaagtgtattccgtttggacgttcgacgtgactccggacccgngttacggggtttcnctacgtcgtcgttccgtccggtcttaccgtacgtcgtggctacggcgtacccggtcctcccgtagtaccctcgtccgttacgtcggggtccctacggacggtcgacgggacggtacggtacgtgtacttagttacttacgtcggtactacggtactacaacttaacctaaactaaaacgtaaacgtaaaccgttacgggtttacggggtttacggggttcgggtaccccggggaacgggtaaaaccctaacgggttaccccgtaccgttacccgtacggtaaccgtacccgtaacccgggtaccgtacccgtccccggtcccccgttcgggttacccttaccggtcccgtttaccccgtacccttcccccg

SEQ ID NO: 252764 - DNA, 786 bp, Homo sapiens
  misc_feature: GYAE6OF02F0956.49.35.D02.1.454.CMB.1.raw
tcagagtcgagagacacgaccggtgctcgatttagcacacgatagttgggtttggggggggtctcaggaggcagcgctctcgggacgtctccaccatcggcctgggctctgctattcctcaccctcctcacctcagggcacagggtcctgggccagtctgccctgactcagcctgcctcgtgtctgggtcctcctggacagtcgatcgaccatcctctgactacgtaggaaccaccaattcgacgtttagtaacttactaatttcctgttacctccgtacggtaccaaactaactaccccgggacaaaaccgttaccccctaaaactcctaattacgactttacgttttacggaggttacctaagttcggtacgttacccgggacccggtacggttacggggtttttaccaccgttacgtccggtccttttaaccgtccgggtacccttacgtaaacggttcctaggaccgtacgaccggaaccgtcccgttaccccgtacggtaccctaaacgtttccgttcgtacggggtacctccggtaggtaccgtacgggacggaacggtacggtacgtagttaacgttactttacgtagtactacgtactactaacttaactaacgaaacgtaattaacgaacgttcgggttacgttaccgggaccgtaaccggacctaaacgttaccgtacccgttaccgtaacggtccgaaccgaaccggtaacggtcccttacccggtccccgtaacggttaccctaccgtcccgtttacccgttcccgtacccccg

SEQ ID NO: 252765 - DNA, 803 bp, Homo sapiens
  misc_feature: GYAE6OF02H7KXZ.49.35.D02.1.454.CMB.1.raw
  modified_base (201)..(201): a, c, t, g, unknown or other
  misc_feature (201)..(201): n is a, c, g, or t
  modified_base (257)..(257): a, c, t, g, unknown or other
  misc_feature (257)..(257): n is a, c, g, or t
  modified_base (349)..(349): a, c, t, g, unknown or other
  misc_feature (349)..(349): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacgaggtcctgggcccagtctgccctgactcacgctgcctccgtgtctgggtctccgtggacngtcgatcaccatcctcctgcactcggaaccacaatgacgttgtacttatacttctntctctgtaccaacactacccgacaaaccgtaccccaatctatagtattcgtttgacgtcgagtcgagtccggaccgtcggtacgggtttccncgtacgtcgtccgttccgtccgacctacccgtacgtccgtcggaccgacgccgaacccggtccctacccgtacggtaccctacgtccgttacgggttcgggtacccttacccggaacgggtaccgttagggaaccgggtacgggtacgtccgttaacggttacgtttaaccgttaacgtccggtaaccgaccgtaccgttaaccgtaaacttaaacccgtaaaaccgttaaaaccgtaaaaccgtaaaccgggttttaaccgggtttacggggttaccgggttacccgggggccgggtaaacccggttaaacccgtaaccgggtttacccgtacccgttcccgttaaaccgggcccgtaaaccggtacccccggtaacggtaccccgttcccgtcccccggttaaccgggttcccttaacccgttacccgtttccccgttacccgttacccccg

SEQ ID NO: 252766 - DNA, 658 bp, Homo sapiens
  misc_feature: GYAE6OF02JQ0F5.49.35.D02.1.454.CMB.1.raw
  modified_base (368)..(368): a, c, t, g, unknown or other
  misc_feature (368)..(368): n is a, c, g, or t
  modified_base (445)..(445): a, c, t, g, unknown or other
  misc_feature (445)..(445): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacgagggtcctgggcccagtctgccctgactcagcctgcctcgtgtctgggtctctggacagtcgatcactatcctctgacacgtacggaaaccaccaagtcgtacgtttagtacttataattctcgtctccgtagtaccaactaactaccccgataaaccgtaccccaaaactcgaatcgacttcgttgaggtctaggtacgacgtccggccggtacgtacgggtttcnctacgtccgtcgtttccgtacccggtactaccgtaacgtcgtacggctacgcgtaccggtcctcccgtactaacctntccgtcgtcgggtccctcgacggtatcggaacggcgtaagcttaagtactttattaacgctacgacgtcgtactaattaacgaactaaacgtaactaagtccgttagggtcggtccgagggtacccgaagtacgtaccggtaccgtacgtacgcgtaaccgacggtcgtcctaccggccctaggtacctcccggttcttacccgtcccgtccc

SEQ ID NO: 252767 - DNA, 785 bp, Homo sapiens
  misc_feature: GYAE6OF02F5R60.49.35.D02.1.454.CMB.1.raw
tcagagtcgagagacacgaccggtgctcgatttagcacacgatagttgggtttggggggggtctcaggaggcagcgctctcgggacgtctccaccatggcctgggcctctgctattcctcaccctctcactcgagggcacagggtcctggcccagtctgcctgactcagcctgcctccgtgtctgggtcctcctggacagtcgatcaccatctcctgcacgtggaaccaccaatcgacgttgtacttataattctgtctcgtgtaaccaacaacgtacccggacaacgtaccccaaactcatgtacttcgttaggaggtcaggtgacgtccggacccgtgtacgggtttctcgtatccgtccttccgtacccggtactaccgaagttcgtcggactacggccgtaaccggtcccttacccgtacggtaccgtacgttccgtacggttcggggtacccttaccggtacgggtccgttacgggaacgggtaccggtacggtacgttaggtaacttacgtttaccgtacgtaccgttacggtccttaacctacgtttaaaccgaaacccgtaaaacgtaaccgtttaaacgtaccggtttaacgggtttaccgggtttacccggggaccgggtaaacccgggtaaacccgtaaaccggtaccggttacccggttaacccgttaaccggtcccggtaaccgtccccggtaaacggtcccggttaaccccgtcccccgggttacggtacccctacccggttcccgtttaccccggtcccccttaccccgg

SEQ ID NO: 252768 - DNA, 608 bp, Homo sapiens
  misc_feature: GYAE6OF02IM40B.49.35.D02.1.454.CMB.1.raw
  modified_base (328)..(328): a, c, t, g, unknown or other
  misc_feature (328)..(328): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatcgtggggctgaggtgagaagcctgggtcgtcggtgaaggtctcctgcaaggcttcgtggagaccaccttcaacaactttcgctgtcagctgggtgcgacacggcccctggacaggccttggagtgggtggaaggntccgaccctataccgttaatactcgactaaacgtatcgactacagactacttaccaacgacaggtacgttccaacccttatccgaccggtaacaaactcccgaacgaacaacacgacctaacgactaggaacctgaccgtcaacgtcctaaggactaccgtcggaccgtaacgaccggtcgtaacttacttcgttagtcgacgtacggaagtacggaatttacgttcctttagtagttagtaacgttacgttaaccgttagtaccttagtttacgttccg

SEQ ID NO: 252769 - DNA, 915 bp, Homo sapiens
  misc_feature: GYAE6OF02FTG88.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatcctcctgcactcggaacccaccaatgtaacgttggtacttataattctgtctcctggtaccaacaataccccgacaaaacgtcccccaaaactccatgacttctttgaggtcagtcgacgtccgggccccgtacgaggggtttttctcaactccgtctttaccgtcccggccttaccctaacgttccgtcgggtaccaacggccgtaacccgggccccttacccccgtgaaccccacttcccggttcgtaccgggggtccttaccccggaaggggtccgttagggaacggggaacggtaaccggggtccgtttaacggtaacgttttaacgttttaaccgtggtacccgtaacgtaccggttactaaacttaaacttaaaacctaaaaaaccgttaaaaccgtttaaaaaacccgttaaccggggtttttacgggggggtttcggggttttaacccggggggttaacccggggggaaacccgggggttaaaaacccgaaaaacccggtttacccggggttaacccccggttaaccccggtttaaaccccggggtaaccgtaaacccgggtaacccccccgggttaaaaccggggtttccccgttaacccccgggtcccccccccggttttacccgggttacccttaaaccccgtttcccccggttttaccccgggttttacccccccttaacccccccccgg

SEQ ID NO: 252770 - DNA, 694 bp, Homo sapiens
  misc_feature: GYAE6OF02JJX3K.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctgggctgaggtgagaaagcctgggtcgtcggtgaaggtctccgtgcaaggtcttctggagtacgaccttcaactaactttgctgtcagctgggtgcgacaggccccgtggacaacggccttggacggtggggtaggggaagggtactacccgaacccctattacccgttaaattactacggacctaaaactagttacgactaacgacgactactttacccgaaccgtaacgacggtaacgtccgtaacccctttagtaccgaccgggaactaaacgttaccccgaaacgaaaccacgaacgtaccctaacgaacgttacggaacctcggaccgaccgtaacgtccgtaacggtactacccgtacgaccccgtaaccgaccgggtacccgttaactttacgtttccgttaggtcgacggagaacggacggtacgttcgtttacctttacgtaagttgtaacgttacggttaacgttaccgttacgttactttagttaccgg

SEQ ID NO: 252771 - DNA, 643 bp, Homo sapiens
  misc_feature: GYAE6OF02F343U.49.35.D02.1.454.CMB.1.raw
  modified_base (297)..(297): a, c, t, g, unknown or other
  misc_feature (297)..(297): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatcgtgggctgaggtgaagaagccgtgggtccggtcggtaggaacggtctccgtcgacgaaggtcttcgtggagacctactacaactaacttgctgtcagcgtggngcgacgcggtcccgtaggacagccgttggaggtgggtggaaggtgtaccgtaccctattaccttaagtacgttacgaacaaactgtacgacaacacactacgtaccgaccgtaacgagtacgtacctaacccgttacgtccggaacgtaactaaacctaccgaaacgaacgacgtacgctaacgacgttaacggaacttcggacgacgtacgaaccgtagtaaccttcgaccggtaccgacgtaaccgtcgttaattacgtttacggtcgacgtagacggtaacgtagtaagttcgtttctttaagtctagttacgttacgttagttaccgtacttagttgtaacg

SEQ ID NO: 252772 - DNA, 769 bp, Homo sapiens
  misc_feature: GYAE6OF02FXJQV.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagccctgcctccgtgtctgggtctccgtggacagtcgatccaccatcctcctgcacgtcggaacccacaatcgacgttaggtacttataattctgtctcctcggtaccaacaactaaccccggacaaaaccgtccccaaactctatcgtacttacgtttaggacggtcagtgacgtccggaccgcgtaggggtttctacgtacttcgtccttccgtcccggtcctaccgtaacgttaccgtcggacctacggacccgtaccgggtccccttaccccgtacgacccgtacttccgtacgtcgggtcctacccgaggtcgtacgggaaggtaccggacggtacgttaggttaacttaagtttaccgtacggcgtacgtacgttactaacttaactaaaccaaaacctaagttaaaacgttacgggtttacgggttacggttccggggaccgggtacccgggaaaccgttaaccgtaccggtaccccgttacgtaacccggtaccgaacccgggtaacccgtaaccgggcccgtttaccccgggtacccccgttcggtaccccgttaacccgttccgttaccccggttaccccccttacccccg

SEQ ID NO: 252773 - DNA, 660 bp, Homo sapiens
  misc_feature: GYAE6OF02IFVC4.49.35.D02.1.454.CMB.1.raw
  modified_base (246)..(246): a, c, t, g, unknown or other
  misc_feature (246)..(246): n is a, c, g, or t
  modified_base (597)..(597): a, c, t, g, unknown or other
  misc_feature (597)..(597): n is a, c, g, or t
  modified_base (612)..(612): a, c, t, g, unknown or other
  misc_feature (612)..(612): n is a, c, g, or t
  modified_base (653)..(653): a, c, t, g, unknown or other
  misc_feature (653)..(653): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctgggaggttcctctttgtggtggcagcagctacaggtgcccagtcccggtccagcgtggtcgcaatcgtgggctggaggtgagaagccgtggtcgtcggtgaggtctctgcgagctnggagactactcaactactttgctgtcagcgtgggtcgacgtacaccgggtccctaggaccgaacggtccgttacggtacggtggggtacggggaaacggtccgacccgtaacccgttaaccgttacccgtttaaagtacgttaacggaacctaaaactcgtacgtacaacgtacgactaccgttaccgaacgtaacgaagtaccgtaccgtaaccctttacaccggtaaccgaaactaacgtaacccgaaaccgtacgaaccgtagaccctaacgtacgtacggaacgtagaccgtgaaacgtccgtaacgtcgtactcggacccgtacgaccgtaccgttcttagttcgngtacgacgtagacgngtaatccgttcttaacgagttgtactacgtcgtagtacttntacgtcg

SEQ ID NO: 252774 - DNA, 685 bp, Homo sapiens
  misc_feature: GYAE6OF02IQJ60.49.35.D02.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (468)..(468): a, c, t, g, unknown or other
  misc_feature (468)..(468): n is a, c, g, or t
  modified_base (505)..(505): a, c, t, g, unknown or other
  misc_feature (505)..(505): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcagacgggtcctcgggcccagtctgccctgactcagcctgcctcgtgtccggtctccgtgacngtcgatcaccntccgtctgctactcgaaccacctatggacgttgtacttaatattctgtctcctacggtaaccaacaacctacccggactaaaccgtcccccaaactcaatgacttacgtttcggaaggtctaggtcgacgttccgggcccgtcggtacgggtttacctccgtagtccgtcttccgtaccggctacctagtctgggcagccgacgtccctaccgtagaccttatccgtacgtccggactccgaggtccagggaccggngaggtcgtatagtttactacgtgacgtactccgtaanaacgtaacttaaaccaactaaaccttaaacgtcgggttacggtcggttccgggaacgtaccggaaacctaaacgtccgtaacccgtttcgaacccgtaacgtaccgtaaccgggtaccgtccgtaacccggcccctttacgggtctccccgttacgtttccgttaccccgttcctacccg

SEQ ID NO: 252775 - DNA, 716 bp, Homo sapiens
  misc_feature: GYAE6OF02I76X2.49.35.D02.1.454.CMB.1.raw
  modified_base (252)..(252): a, c, t, g, unknown or other
  misc_feature (252)..(252): n is a, c, g, or t
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (682)..(682): a, c, t, g, unknown or other
  misc_feature (682)..(682): n is a, c, g, or t
tcagagtcgagagacacgaccggtgctcgatttagcacacgatagttgggttttggggggggtctcaggaggcagcgctctcgggacgtctccaccatggcctgggctctgctatcctcaccctctcactcagggcacagggtcctgggcccagtctgccctgacctcagcctgcctccgtgtctgggtctcctggacagtcgatcacatctcctgcactggaaccacaatgacgttgtaacttataattcngtctcctgtacaacaactacccggacaaacgtaccccaactcatgattcgttgngtcaggtgagtccggccggcgtagggtttcacgtacncgtccttcgcccggtctacctaagtctggctacgcgaccggtccctaccctcgacccgtatccgttcgtcgggccttacccggaggtccgttgggaacggacggtcgggtacgtagggttaacctttacgttaccgtgaccgtacgtcttactaacgtaaacctaaccgtaaaaataaaccgttaaacgtaccggtttacgggttccggtttaccggggaaccggggtaccccgggaaaacgtaaccctaccgggttaaccccgtcccgtttaaccgggtccgtaacccgaacccggtaaccgggtccgtaccccggtcccccggttacgggttacccncctttacccgttaccccggttacccgtacccccg

SEQ ID NO: 252776 - DNA, 807 bp, Homo sapiens
  misc_feature: GYAE6OF02IQO3D.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctcgccctgactcagcctgcctccgtgtctggtctcctggacagtcgatcaccatctcctgcactgaaccacaatgacgttggtacttatattctgtctcctggtaccaacaactaccccggcaaacgtccccaaactcatgatctttgaggtcaggtgagtccggcccgcgtaggggttttcctctacgtccgtccgtttcctcccggggtccttacccgtaaacggttccgtcggggtccgtaacggtccgaacccgggtccccgttcccccgttacgaaccccgtaacgttccgttacccggtcggggacccttcccgaagggtccgtagggaccgggtaaccggagggtctaaggttaacttttaagttaaccgttcgtaccgtagtaccgttactaagttaactaaaccgaaaaaccttaagttaaaaccgtacgggttttaggggttaccgggttacccggggaccggggtaaccgggtaaaccccgtaaaaccgttccgggtaaacccccgttacccgttaacccggtaccgtaaccccggtaccccggtaaaccgggttacccgttaccccggttcccccccgttacgggttaccccgtaacccgtttccccgtttaccccggtttacccccctaaccccccg

SEQ ID NO: 252777 - DNA, 663 bp, Homo sapiens
  misc_feature: GYAE6OF02FW42P.49.35.D02.1.454.CMB.1.raw
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (371)..(371): a, c, t, g, unknown or other
  misc_feature (371)..(371): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcatctgggctgagtgagaagcctgggtcgtcggtgaaggtctctgcaggcttcnggnacacttcaacactttnctgtcagntgggtgcgacacggcccctggacgaacggtccttacggaggttggggtagggaaggacgtaccaccctattaccttaataactacgactaaacctatcganacgaagacacttaccaacgaacacgtagtacctaccttagtcgaacggaacaaactaccgaacccaaacaaccgacgaccctaacgaacgtacggaaaccgtcgccgttaacggccgaccggtacggaaccttccgtacgggtacccgacccgtaacccgggtaccgttaattaaccgtttacgttggtacgtaccggtagtaacggtaagtcggtttcgtttacgttttaccgttaggtttaggtaactttacggttaaaccgttaagttacccttaatttaacgttacgg

SEQ ID NO: 252778 - DNA, 545 bp, Homo sapiens
  misc_feature: GYAE6OF02GZDZL.49.35.D02.1.454.CMB.1.raw
  modified_base (299)..(299): a, c, t, g, unknown or other
  misc_feature (299)..(299): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactcggaaccacaatgacgttggtacttataattctgtctctgtacaacaatacccgacaaacgtccccaactcatgactnttgagtcagtgactcggccgcgagggttctcatcgtctcgtccgctccaagtctgcngcgacgtccctccncgaccntcctcgtcggcctcgnggctggaggacgagctgattattcngcgatctntatataacaaacgtaataacgtcgttggtagtcggccgggacgaacctaacgtcgaccgtccgtacgtacgacgaccgacgcctccgtccccgtcgtcctacctccttcgtcccctcccg

SEQ ID NO: 252779 - DNA, 788 bp, Homo sapiens
  misc_feature: GYAE6OF02GF61M.49.35.D02.1.454.CMB.1.raw
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
  modified_base (482)..(482): a, c, t, g, unknown or other
  misc_feature (482)..(482): n is a, c, g, or t
tcagagtcgagagacacgaccggtgctcgatttagcacacgatagttgggtttgggggggggtctcaggaggcagcgctctcgggacgtctccaccatggcctgggctctgctattcctcacccctcctcactcagggcacagggtcctgggcccagtctcgccctgactcagcctgcctccgtgtctgggtctcctggacagtcgatcaccatctctgcacgtcgaaccacaatgacgttgtacttanattcngtctctgtacaacgacgtacccngacaaacgcccccagactcatgtatttagcggtcggtacaaggtaaggcccggacccttacggaccggggttcccctaggtactccggtcctttacgtccgttcggtccctaccgtaaggttccgttacgggacctaaaccgaccggtccccttaccccgttacggaccccgttccgtaccggtcggggtacccggtcccgggtntaaacgggtaaacggtcgtacgggtaacgggtcttaacgttacgttttaccgttttcgaagttacccgacgttaccttaccctaggttaacgtcgtaaacccggtaggggtaccgaacctaaaccgttaaaccgtttttaagtttttacggacgttaaagtttaccgggttaccgggggtaccgggaacccgggttaacccaacgggttccgtaaacccgggtacccgttaacccgggtacggttaacccgaacccgggtacccgtaaccgggtcccgttaccccggtaccccccgtttaaccggg

SEQ ID NO: 252780 - DNA, 602 bp, Homo sapiens
  misc_feature: GYAE6OF02HCX6N.49.35.D02.1.454.CMB.1.raw
  modified_base (254)..(254): a, c, t, g, unknown or other
  misc_feature (254)..(254): n is a, c, g, or t
  modified_base (367)..(367): a, c, t, g, unknown or other
  misc_feature (367)..(367): n is a, c, g, or t
  modified_base (427)..(427): a, c, t, g, unknown or other
  misc_feature (427)..(427): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatcctcctgccactgaaccacaatgacgttgtacttatattctntctcctgtaccaacaactaccccgacaaacgtccccaaactcatgacttcttaggagtcagtgacgtcggccgcgtagggttctcactcgtcttcgtccgtctaccgaagtcnggtacagccgccggcctccgtcgacacttcctcgtcggctccgaggtctaggcggaacgnggctagtaattatcgttgacagtctactaatactaacaaactaactaaacgtacgttgggttcggttccgggacggtaccggaaccgtaaacgtcgacccgttcgtaccgtacgaccgaccgaacgtcctacccgccccgtacggtccctaccgtccgtcccgttcccgtccccg

SEQ ID NO: 252781 - DNA, 832 bp, Homo sapiens
  misc_feature: GYAE6OF02HOJM3.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcacccctcctcactcagggctacagggtccgtcggcccagtctcgcccgtgacctcacgccctagcccgtcccgtgttacgtcggggttcctccctagggaccacggtccgtaactcaacccatttcctcccttgacaacccttagggaaacccctaacctaaaatccggtaacggtttcggtaaacttttaataaacgtttcctgttaccgttccgttaccggtaacccaaaaactaaccgtaaaccccgggaccaaaaccggttaaccccaaaacttactaactacgtaacgttcctttacggtagtaccgtaggtcggtaacgttccccgggacccgttacgtacggggttttccctaagtactaccggtcccgtttccggtacccggtccgtaaccgtaaacggttccgtacggggacccaaggggccccttaaacccggggtccccttcccgggtaacccgtaaccgttacctaccggttccgtaacggggtcctacccggtacggacggtacggaacggacggacgtacgttagtagtttacgtaacgtcgtacgactagtacgtactaacgtaacaaacgtaactaacacggttaggtcggttacgaccggtacggaactaacgcgtaccgtaccgtacggtaacacggtccgaacggtccgtaccgtccccgtcggtaccacgtccgtaccgttcccgtaacccg

SEQ ID NO: 252782 - DNA, 707 bp, Homo sapiens
  misc_feature: GYAE6OF02JPL8B.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctggcccagtctgccctgactcagcctgcctcgtgtctgggtctcctggacagtcgatcaccatctcctgcactggaaccacaatgacgttgtacttataattctgtctctgtaccaacaatacccggacaaacgtcccaaactcatgatcttagagtcagtgataccggccgcgtagggttctacacgtcgtccgttcgtcccggctacccgaagtcgtcggtcctacggcgtaacccggtcccttcccgtacgaacccgtacttcccgttcgtccggggtacctaccggacggtcgttacggacgggtacggagggtccttaggttaactttacgttaccgtacgccgtaacgtcctaactaacgtaactaaacctaaaacgtaactaaaccgtacggttttaggggtacgttaccggggtccgggaacccggtaaccgtaaaccgttcgggtaccccttacggtacccgttaacgaaccggtacccggtaaacgtcccgttacccggtccccggtaccggtcctaacccggttccgttaccccgttccccgttcccccg

SEQ ID NO: 252783 - DNA, 630 bp, Homo sapiens
  misc_feature: GYAE6OF02FSMGV.49.35.D02.1.454.CMB.1.raw
  modified_base (358)..(358): a, c, t, g, unknown or other
  misc_feature (358)..(358): n is a, c, g, or t
  modified_base (361)..(362): a, c, t, g, unknown or other
  misc_feature (361)..(362): n is a, c, g, or t
  modified_base (372)..(372): a, c, t, g, unknown or other
  misc_feature (372)..(372): n is a, c, g, or t
  modified_base (392)..(392): a, c, t, g, unknown or other
  misc_feature (392)..(392): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgcactggaaccacaatgacgttgtacttataattctgtctcctggtaccaacaataccccggcaaacgtccccaaactcatgatctttgaggtcagtcgatccggccgcgtagggtttctcgatcgtcttctccgctcagtcngcnncacgcctccnaccatctcgtcggctcgcgntcgaggcgaggctgtattacttactgacgagtctacgtactaacttaacaaactaaattaaaccgtacgtttacgggttcggttaccggggaccggaccgggtaaacccgtaaaccgtacggtaccccgttacccgttaccggttccgaaccggtacccggtaacggtcccgtaccggttccccccggtcgggttaccctaaccggtttccctttcccggttaccccccttacccccg

SEQ ID NO: 252784 - DNA, 777 bp, Homo sapiens
  misc_feature: GYAE6OF02FGPY6.49.35.D02.1.454.CMB.1.raw
  modified_base (384)..(384): a, c, t, g, unknown or other
  misc_feature (384)..(384): n is a, c, g, or t
  modified_base (734)..(734): a, c, t, g, unknown or other
  misc_feature (734)..(734): n is a, c, g, or t
tcagagtcgagagacacgaccggtgctcgatttagcacacgatagttggggtttggggggggtctcaggaggcagcgctctcgggacgtctccaccatggcctgggctctgctatcctcaccctcctcactcagggcacgagggtcctgggcccagtctcgccctgactcagcctgcctccgtagtcctgggtctcctggacaggtcagtccaccattccgtcctgccactcggaaacccaccaatcggtacgttcggtactttactaatttctgttcctccgtacggttaccaacgaacgtacccccggacaaacgtcccccaaaactccagtcgtacttcgttagtagtcgagtacgcgtaccggccgtcgtaggggtttcncgtacttccgtcttaccgtccgggtcctaccgtaaggttccgtcgggacgtaccggacccgtaccgggtacccccgtttacccgtaccggttaaaccctccggttacccgttccggttccgggggacccctttaccggacgggttaccgaacggggtaaccgggaccggttacgggtaccgttaggttaactttaaccgtttacgtcgggactacgtaccctactaacttaacttaaacctaaaacctaacgttaaacgttacggtttgggttacggttccgggaaccggtaccgggaacctaaccgtaccgtaccgtacaccggtaaccaccggacccgtaacggtccncccgtaccccgtggaccctcgtcccttaccggtacccctcccg

SEQ ID NO: 252785 - DNA, 894 bp, Homo sapiens
  misc_feature: GYAE6OF02H93ZH.49.35.D02.1.454.CMB.1.raw
  modified_base (129)..(129): a, c, t, g, unknown or other
  misc_feature (129)..(129): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctnactcgagggcacagggtcctgggcccagtctgaccctgactcagcctgccttaccgtgtcgtcgggtctccgtggactacgtcgatctaccgattcctccgtgccgtaacgttacggaaccctaaccgaaagttcggtaaccgggtttcgttaacgtttaacttaacgtttcttacgtttaccgttaccgttacgggtaacctaaaccgtaaccggttaacccccggaactaaaaccggtaacccccgtaaaaccgtacctaacgttaacgtacgttacccgttttacggtacggttaccgtaaggtacgtaaccggttcccgggacccggttaaccggttacgggggttttacctaccgtaacgttcccggtaccgtttaccgtcccggtaacgttacccgtaaacggtcgttcggactacggtccgtaaccggtcccctaccgtaccgtacctacgttacgtccggttacggtacccgtcgtacggtaccgtacggaacggtacggacggtactacgtaagttttataccggtacgtaccgtaactcgttaacgtaactaaacgtaactaaaaccggttaacttaaaccgtacgggtttacgggttaccggttaccgggtaaccggtaccggaaacctaaccgggttacctaacccgggtcctttaaaccggcctaaacccggtaccggtaaccgtccccgttacccgtaccccggttaccgtacccgttaccgtttacgttaccccgttccccttaaccccg

SEQ ID NO: 252786 - DNA, 863 bp, Homo sapiens
  misc_feature: GYAE6OF02JNY1P.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacgaggtgcccgagtcccgggtccagctggtgacatcgtggggctggaggtgaagaagcctgggtcgtcggtgaaggtctccgtgcgaaggcgttcgtgggactaccgacctttacgaaacctaactttcggtactgtcaggtcgtggggtcgacgaaccgaccggccccgtaggaccgtaacgggtccgttaggagggtttacgggggtacggggaacggtaacgtccccgtaaacccctacggttttaacctaaaagttaacgttaaccggaacccgtaaaaacgttacgtcggtaaccccgaagaacccgtaaacgtaaccgtttaaccccaaccggtaaaccggtaaggtaaacccgtttaccctaaccccgttttaaaccgtaaccgggtaaaccgggtaaaacccttaaaacccgttaaccccgaaaacccggtaaacccgaaaccggtaaaccgttaacccgtaaccgtaaacggtaacggtaaaccggtttacggacccgtaccgtaaaccggtaccgttaaaccgggtacttaccggttaccgacccggaccggttacccggtaaccgttaacgttacgtttaacgtccggttagaacggtcgaaacggtacgtaacggtttactttacggtttaccgttagttaaccggttaagttaccgtttaacgttaacgttacgtttacgttacgttcgg

SEQ ID NO: 252787 - DNA, 766 bp, Homo sapiens
  misc_feature: GYAE6OF02JDUYK.49.35.D02.1.454.CMB.1.raw
  modified_base (168)..(168): a, c, t, g, unknown or other
  misc_feature (168)..(168): n is a, c, g, or t
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
tcagagtcgagagacacgaccggtgctcgatttagcacacgatagttgggtttggggggggtctcaggaggcagcgctctcgggacgtctccaccatggcctggctctgctattcctcaccctcctcactcgagggcacagggtcctgggcccagtctgccctgactnagcctgcctccgtgtcgtcggtctccgtggacagtcgatccacatctctgacactgaaccncaatgacgttgtacttatattcntctctagtacacactacccgacaacgtaccccaatcatcgtacttcttagaggtcagtcgacgtccggcccgtcgtacgggttctacgtcgtccgtcttcgtccgtctcgtacgtcgtcggcagccgaccggtcctccgacgacctacgtccgtcgtccggtccgtaccgtacgggtcgtacgggtaacgggaccgtacgggtcttacggtaacgtttaacgtttagtacgtaccgtcggttacctacgttaaagttaacgtaaaacgttaaacctaaaacgtttaaacccggttacgggttttaaccgggggttacgggttccccgggggaacgggttaccccggggtaaaacctaaccgggttaaccgttaccccggtaccgtttaacccggtaacggtaaccccggttaacccgggaacccgggttaccctacccccgggttcccccggttaacccggtttaccggttaaccccgttccgtttaaccccccggtttcccccgttacccccg

SEQ ID NO: 252788 - DNA, 708 bp, Homo sapiens
  misc_feature: GYAE6OF02JNX2G.49.35.D02.1.454.CMB.1.raw
  modified_base (400)..(400): a, c, t, g, unknown or other
  misc_feature (400)..(400): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgactcaccgatcctcctgcactcggaaccacaatgaccgttgtacttatattctgctctgtaccaacactacccgcaaacgtccccaaacgtcatcgtacttacgttgaggttaccgagttagtactccggaccgcggtacgggttctacgacttccgtcttccgtccggtctaccgtacgtcgacgtcgaacgtccncggtccctcccgttacggacctacgtccgtccgtcggtccgtccgaacggtcgtaggcggtacggtacggtcgtagttacgttaacgttacgtcgtaccgtaacgtctacttaactaactaaaccgtaaaataaaccgtaaacgttaccggtttgggttaaccgggttccggggtaaccgggaccgggttaaaccgtaacgttacccgtacccgttacccgttaccgtaaccgaccgtaccggtaaacgtcccggtcccgtaaccccgcggttaccctacccttcccggttccgtccccccgtacccg

SEQ ID NO: 252789 - DNA, 733 bp, Homo sapiens
  misc_feature: GYAE6OF02J0F1T.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggctacagggtcctgggcccagtctcgccctgactcacgtcctgccttccgtgtcgtgggtctccgtggacagtcgatcacctatctcctgcctacgtacggaaccacaagtgacgtttcgtacttataattcgtagtctacgtacgtaaccaacactaccccggactaaccgtaccccgtaaatcgatgtacttcgttaggacgtacacgtgcgtaccggccgtaggtcggttactcgtacgtcgtacgttcgtaccgctaccgtacgtcgtcggacgtcgaccggtctccggtcctcgacctcgttctcggcggtccctacggtacggcgttacgggcggtaacgtcggtacgtagttacgttagtccgtaccggtatacggtacctaagtacgtaactaaaccaaacgttaactaaccggtttcgggttacgggttacccggttaaccggggacccgggtaaacggaacccttaacggtaaccggttacccggtaccttaaccggtccgtaaccggtacccgtaaccgggtcccgttcccgtaccccggttcctaccggttccccttaccggttccccgtttaaccccggttcccc

SEQ ID NO: 252790 - DNA, 767 bp, Homo sapiens
  misc_feature: GYAE6OF02HND20.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtcctgccctgactcacgcctcgcctccgtgtcgtcgggtcctccgtggactagtcgatccacctctcctcctgcacgtacggaaccaccaagtcgtacgtttgaacttaatacttctgtcctcctcggtaccaacaacctacccggactaaaccgtaccccaacctacatagtacttcgttacggtacggtgacggtgtaccgtccgggccccgtcggttacggggttcctactacgtccgttcccgttccgtccggtacccgttacctaaacggttccgtacggaccgtacggacccgtaccggtccctacccgttacgaaccttaccgtcccgtttacgggtccggtacccgtacccggtacggtacggtacgggacggaccgggttagtaccgttagttaactttacgtacgttctacgaacgtccgtaacactaacgtaaacctaaacgtaaattaacccgttaggttcgggttaacggttccggggaacggtaccggaaccgtaaccgtaccggtccgttaaccgttccgtaacggaccgtaccggaaccgtccgacccggttcccgtccgtacccgttacccttccgttcccttccccttaccccg

SEQ ID NO: 252791 - DNA, 734 bp, Homo sapiens
  misc_feature: GYAE6OF02I7IMP.49.35.D02.1.454.CMB.1.raw
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
  modified_base (683)..(683): a, c, t, g, unknown or other
  misc_feature (683)..(683): n is a, c, g, or t
tcagagtcgagagacacgaccggtgctcgatttagcacacgatagttgggtttgggggcatcacataacaaccagattcctcctctaaagaagcccctgggagcacagctcatccaccatggacctggacctggacggtttcctctttggtggtggcagcgagctacgaggtcgcccgaggtccccgggtccaggcctgggtgctagtcgtgggcgtgtaggtagagaaacgtccgttggggtcgttacgggtaggtaacggtccgtccgtgacgtaacggtctttcggnggaacgtaacctccgtacaacctacgtttntacgtgtctagcgttagggtcgaccgaaccgccggtaccccggtaggaacgtacggtaccgtagggagggtgggtaacgggacggtaccgtacccgtaacccttaccgttaacgttaacgtaacgtacggtaaactaactacgtactacccgaagtaacgtactaacgtccgtaagtaacgccgtaagtacggtacccttaacgtaccgtacgaacggtaaacctaaacccgtaccgaaactaaaccgactaaccgaaccttacgaacgttacggtaacgacgaccgtccgactaccgttagacttaccgccgtaccgacgtaccgtacgtttacgtactttgccgttaagctacggaggttntacgggttcctagtttacctgaacgttagtacctacgttattactattacg

SEQ ID NO: 252792 - DNA, 694 bp, Homo sapiens
  misc_feature: GYAE6OF02GAG6T.49.35.D02.1.454.CMB.1.raw
  modified_base (256)..(256): a, c, t, g, unknown or other
  misc_feature (256)..(256): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccacaatgtacgttgtacttataattctntctctgtacaacaactaccccgacaacgtaccccaaactcatgattcttgaggtcagtgacgtcggcccgcgtagggtttctctacgtcgtcttccgtccggtcctaccaagtcgtggtacgacgcgaccggtccctcccgtcgaaccctacttccgtcgtacgggtcctaccgacggtacgtacgggaacgggacggtacggtacgttacggtaactttaacgttaacgttcggtactacgtcctactaacgtaaactaaaaccaaactaaaacttaaaccgttaccggtttagggttaccgggttaccggggaccgggtaaccgggaacctaaaccggtaccgtacccgtaccgtacgtaccgaccggtacccgtaacggtcctacccggtaccccgttcggtacctaccgtcccgttacccgttcccctaccccg

SEQ ID NO: 252793 - DNA, 675 bp, Homo sapiens
  misc_feature: GYAE6OF02G9EEF.49.35.D02.1.454.CMB.1.raw
  modified_base (141)..(141): a, c, t, g, unknown or other
  misc_feature (141)..(141): n is a, c, g, or t
  modified_base (182)..(182): a, c, t, g, unknown or other
  misc_feature (182)..(182): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
tcagagtcgagagacacgaccggtgctcgatttagcacacgataggttgggtttgggggggggtctcaggaggcagcgctctcgggacgtctccaccatggcctgggctctgctattcctcaccctctcactcagggcacngggtcctggccagtctgccctgactcagcctgtcctccgtntcgtgggtctcgtggacngtcgntcaccatcctcctgcactacgaaccacaatcgacgttcgtacttataactttcgtcgtctcgtcggtaccaacaactacccgagaaccgtacccaaactcatagtacttcgttggacggtctacggttgacgttccggccgtcgttacgggtttccactacgttccgtccttcgccggtacctccgaacgtcgtacgctacggtccgaccgtcctcccgacgtacctcttaccgtcgtccggggtaccctcgtaccgggtcgtaacgggacggtacggtacggttcgtagtttaacttacgttaactcgtactacgtactacgtaacttaacgaactaacgtaaacgtacgtaggtttacggtcgggttaccgacgggtaccgaactaccgtaccgaccgttacgtaccgtcgtaccgaccgacgtcccgtccgcccgttcggacctcgtaccttcccgtacccgttccc

SEQ ID NO: 252794 - DNA, 808 bp, Homo sapiens
  misc_feature: GYAE6OF02F9SP4.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcaggcacagggtcctgggcccagtctgccctgactcagcctgcctccgtgtctgggtctccgtggacagtcgatcaccatctcctgcacgtcggaaccacaatcgacgttggtacttataattctgtctcgtcggtaccaacaacgtaccccggacaaacgtccccaaactcatgacttcttagaggtcagtgagtccggccgtcgtacggggtttctctactcgtcttccgtccggtacctaccgtaacgtcgtcggtaccacggccgaccggccctacccgtacggaaccctacgttcctcggtacggggtccctaccgtacgggtacctagggaccgggacggtacgggtacctaggttaactttaacgttacgttacggtacctaccggtaccttaacgtaacttaactaaaaccgtaaaacgtaaacttaaaccgttaacgggttttcggggttaaccgggttacccgggtaaccggggtaacccgggttaaacccgtaaaaacccgggtttccggaaacccccgggtttacccgtttaaacccggttacccggaaacccgggttaccccgggtaaaacccgggttcccgtttacccccgggtacccccggtttacccgggtaacccttaacccggtttccttaccccgggtttacccccccttaacccccg

SEQ ID NO: 252795 - DNA, 684 bp, Homo sapiens
  misc_feature: GYAE6OF02JOGS0.49.35.D02.1.454.CMB.1.raw
  modified_base (501)..(501): a, c, t, g, unknown or other
  misc_feature (501)..(501): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacgagggtcctgggcccagtctcgccctgactcagcctgcctccgtgtctgggtctccgtggacagtcgatcactacgtctcctgacacgtacgaaaccacaatcggacgttagtacttaataattcgtgtcctcgtacggtaacctaaacgtaacgtaccccggactaaaccgttaccccgaaactactatacgtaacttcgtttaggacgtacgtaagtcggtaacgtccggcccgtacggtacgggtttcacgtaacgttcgtaccgttcgtcccgtacgtaccgtaacgttcgcgtacacgtccgaccggtcctccacgtaacctatcgtacgtcgctacgacggtcgaggacgacgngtactagtactattacgagtactaggctacgtataacaacgaaactattaaaccgtgttacgggtacgtcggtaaccggtacgtaaacgtacggtacgtacccgttacgtaaccggtcgtaacgccgaacgtcccgtaccccggaccttccgggactttacccgaccgttcccttccccgtcc

SEQ ID NO: 252796 - DNA, 672 bp, Homo sapiens
  misc_feature: GYAE6OF02JYQN2.49.35.D02.1.454.CMB.1.raw
  modified_base (138)..(138): a, c, t, g, unknown or other
  misc_feature (138)..(138): n is a, c, g, or t
tcagagtcgagagacacgaccggtgctcgatttagcacacgatagttggggttgggggggtctcaggaggcagcgctctcgggacgtctccacatggcctggctctgctattcctcaccctctcactcagggcaacgnggtccgtcgggacccagtctcgccctggactcgacgcctgcccttcgtgtcgtcgggtcctccgtggacctagtcgatccgacctatccctctcggcctacgtacggaacccactagtcgtacggtttcggtacttaagtacttcgtgtctccgtggtaacccaaactaaccgtaccccggacaaaccgttccccaaacgtcagtcgtattacgttaggacgtcgtagcgtacgtccggcccgtaggttacggtttcctacgacgttcgtccgtccgtacggctaccgaagtttcgcgcgacgccgtcgtccctcgtaccaccgtcttccgtcgtccgggtactaccggtacggtccgtaggacgggtaccgtagggtcttaagtaacgttcgtaacgcgtcgacgtcctatactacctaaagaactataaccgttgttcggtacgtcggacgtcgaaccgtaacgcgaccttcgacgcgcctaccggacgtccgaccgtcccgaggtccttaccgtccgtccgttcctacccg

SEQ ID NO: 252797 - DNA, 924 bp, Homo sapiens
  misc_feature: GYAE6OF02IUS2C.49.35.D02.1.454.CMB.1.raw
tcagagtcgagagacacgaccggtgctcgatttagcacacgatagttggggtttggggggggtctcaggaggcagcgctcgtcgggacgtctccaccatggcctgggctctgctattcctcaccctcctcactcagggcacgacgggtcctgggcccagtctcgccctgacctcacgtcctgcccttcgtgtccgtgggtcctccgtggacctaggtcgactccacccgtatcctccgtagcgtacgtacggaaaccacctaagtcggtaaccgtttacggttaacctttaattaacttccgttaacgttccgttacccgttaacggtaacccgtaaaacctaaccggtaaccccccgggtaaccgtaaaacccgttacccccgaaaaccgttacgtacgtacggttaacctttccggttaacggtaaccggttaccgtaacgggtacggttaacccggtaccccggggtaccccgtaacgggtttaccgggggttttacctaccggttaaccgttccggttacccgtttcccggttaaccccggtaccgttaacccggttaaacgttccgggtaccggtaccgaaccggttacccggacccggtttaaccccgtcccgtacgtaacccgttacgtacccggtttcggttaccgggacccgttccggaacgggttacccgggtaacgggtaacggggtaccggttaacgggtaccgttaacgggtttaacctttaacgtacggttaccgtacgtaacgttacctacgtaaaccgttacctaaaaccgtaacttaacggtaaccgttacggttcgtcgggtaccgggacggaccggtaaactacgtaccgaccgtacgtacctaacggcctaccgtacgtcccgtacccgacgtccgtactacccgtcgttaccctccttacccg

SEQ ID NO: 252798 - DNA, 813 bp, Homo sapiens
  misc_feature: GYAE6OF02G1UG8.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcacctatctcctgcactggaaccacaatgacgttgtactatatctgtctctcgtacaacacgtacccgactaaccgtacccaaacgtcagtagtacttcgttacggaggttcaggtcgtacggtcccggcccggtacggttacgggttcctagtcgtccgtccttccgtccggcctacgacgttcgtacggacgcgaccgtaccgtcccgtcccgtacgtacctactccgtacggtccgggtaccgtaccggtcgggtacggtacgggaacgggtaccgggtacggtaccgttaggttaacgtttaaccgttacgtacggtaccgaccgttacctaacgtaaacgtaaacctaaacctaaaaccgttaaacgttaaaccggttttaggttaaccggggtttacggggttaacccggggttaacccggggaaacccggttaaacccgttaaccggtcccgggttaacccgttacccggttaaccggtaacccggtaacccggtaacccgggacccgggttaccccggtaccccgttaccccccgggttaccggttaacccgttaccccggtttcccggtttacccccggttccccccgggtttaccccc

SEQ ID NO: 252799 - DNA, 690 bp, Homo sapiens
  misc_feature: GYAE6OF02INOZN.49.35.D02.1.454.CMB.1.raw
  modified_base (273)..(273): a, c, t, g, unknown or other
  misc_feature (273)..(273): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (366)..(366): a, c, t, g, unknown or other
  misc_feature (366)..(366): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacctatcctcctgcactcggaaccacaatgtacgtttgacttatacttctgtctccgtgtaaccaanactacccgaacaaacgtccccaaactcatcgtacttnttagagtcgtagtnacgtccggccgtacggttacggtttcatacgtcgtccttccncggtcctaccgtaacgtcgtggctacgccaccggtccctccgtacgacctagtccgtcgtcgggccctcgtacggtctacggaacgggacggtaggtctaggttaacttttaacttacggtgtaaccgtacgtaccttactaaataaccggtaaactaaaccgtaacttaaaccgtacgggttttgggtaaccggtttcggggaaccggtacggtaaacctaacgttaccgacccgttacgtaccgaccgtaccgacccggtaacggtccgtaccccgtacccggttccgtaccttccgttccgtttacccgtaccctcccccg

SEQ ID NO: 252800 - DNA, 812 bp, Homo sapiens
  misc_feature: GYAE6OF02ISWK4.49.35.D02.1.454.CMB.1.raw
  modified_base (200)..(200): a, c, t, g, unknown or other
  misc_feature (200)..(200): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacgagggtcctgggcccagtctgccctgactcagcctgcctccgtgtcgtggtctctggacngtcatcacattctcctgcacgtacggaacccacctaagtcgtacggtttcgtaacttaataactttctcgtcttccgtaggtaccaacaacgtaccccggactaaaccgtaccccaaactcatcgtacttcgtttagaggtctaggtgtacgtccggcccgtcggttacggggtttcctcgtactccgtaccgtttcctccggtcccttacccgtaaacgttccgtacgggaccgtacggaccgacccgggttcccctccccgtacgaaccctacttcccgttaccggttccgggtcccgtacccggtacggtccgttaacgggaacggggtaaccggtacgggtacgttaacgtaacgttttaacgttaaccgtcggtacctagttaccctaacttaactaaacttaaaaccaaaacgttaaacttaaacgttacgggtttcgggttaccgggttacccgggacggggtaaacccggtaaacccgtaaccggtccgtaccccgggttaccttacccgggacctaaccggtacccgtaaccggcccgttacccggtacccccggtacggttacccctaccgttccccgtttacccggtacccccttaccccg

SEQ ID NO: 252801 - DNA, 826 bp, Homo sapiens
  misc_feature: GYAE6OF02GOR3U.49.35.D02.1.454.CMB.1.raw
tcagagtcgagagacacgaccggtgctcgatttagcacacgatagttgggtttgggggggggtctcaggaggcagcgctcgtcgggacgtctccaccatggcctgggctctgctattcctcaccctcctcactcagggcacgagggtccgtcgggcccagtcctcgccctgacctcacgcctcgcctccgtgtcgtggtcctccgtggacgagtcactcaccatcctaccgtcgccacgtacggaacccacctaagtcgtacggttacggttaaccttaagttattaccgtcgttccgttaccgttaccggtaaccaaaccgaaaccgttaacccccggtaacaaaacccgtacccccgaaactaccatacgtattccgttacggtaggtccgtaggtcggacgtaccgggccccgtacgggttacgggtttctacgtacgtccgtaccgttccgtccgtccgtacgtaccgtgtcgcgacgcgtaccgccgttccacgacctacgtctcggtcgccgtcgtacgtccgtggacggacggtacgtccgttaagtacttaacgtcgtacgtcgtaccgtctaacctaagtaacctaaaccctaaaactaaccgtttaaacggtacggtttttaacgggtcccggggttaccgggtaacccggggccggtaaaccggtaaccgggttacccgtaacccgtacccggttaccggttaacccgaacccggttaacccgggtaccggtaccccggttaccccggtccccccggttaccggttaccccgttacccgtttaccccggtttacccgtacccccggtttaccccc

SEQ ID NO: 252802 - DNA, 731 bp, Homo sapiens
  misc_feature: GYAE6OF02HMTDK.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcgatcaccatctcctgcacgtacggaaccacctaagtcgacgttggtacttataattctgtctccgtgtaccaacaactacccgactaaacgtcccaaactcatgattctttagacggtctaggtgacgtccggcccgacgtacgggtttctctacgtccgtcttccggtccgtactccgtaacgtcgtagaccgacgtaccgaccggtccctccgtacgacctacgtaccgtcgtcgggtcctccggacgtcggtaggacgggacgtacggactagttacgtttacgtaccgtcgtacacgtcctaactactaactaaactaaaaccgaacgttaaaaccgtacggttacgggttacgggttaccgggaccggggtaaacccggtaaacctaaaccggttccggtaacccggttacccggtaaccgtaaccggtaaccgaaccccggtaacgggttacccgtaccccggtcccccggttacggtacccgttacccgttcccggttccccggttacccccgttacccccg

SEQ ID NO: 252803 - DNA, 724 bp, Homo sapiens
  misc_feature: GYAE6OF02GE6MW.49.35.D02.1.454.CMB.1.raw
  modified_base (197)..(197): a, c, t, g, unknown or other
  misc_feature (197)..(197): n is a, c, g, or t
  modified_base (382)..(382): a, c, t, g, unknown or other
  misc_feature (382)..(382): n is a, c, g, or t
tcagagtcgagagacacgaccggtgctcgatttagcacacgatagttgggtttgggggggtctcaggaggcagcgctctcgggacgtctccaccatggcctgggctctagctatcctcaccctctcactcagggcacagggtcctggcccagtcctgcctgactcagtcctgcctccgtgtctgggtactctggacncgttcgatcacatcctcctgcctacgacgaaacccacgtaagttcggaaccgtttggactttaattacttccgtcgttaccttcgtacggtaaccaaacaacgttaccccgactaaacgtaccccaaacttcatcgtacttcgttcggacgtctagtacgcgtccggaccgtcggtacggtttcncgtacgtccttacgttccgtccggtactccgtacgtcgtcggactacggccgacgtccgtacccgtacgtaccgtactccgtacggtccggtcctacggtcggtacgtacggtacggtacggtacggtctaacggtattaacgttacgtagtccgtagcttacgtaactactaaaaccgacttaacgtacttaaacggttcggttaaccgggttcggtaaccggtaccggtaaccgtaaccgttaccgacccgttacgtacccggtaactaccgtaacccgaacggttccgtacccgtacccggttacgtcccgtacgtcccgttaccgttaccccgttccg

SEQ ID NO: 252804 - DNA, 762 bp, Homo sapiens
  misc_feature: GYAE6OF02ITOPY.49.35.D02.1.454.CMB.1.raw
  modified_base (294)..(294): a, c, t, g, unknown or other
  misc_feature (294)..(294): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccaggtctgccctgactcacgcctgcctccgtgtcgtgggtcctccgtggacagtcgatcaaccatctcctgctacgtcgaaccactaatcgacgttagtactatacttctagtctcgtacgtaccaacaacgtaccccganaaaccgtaccccaaactcatgtacttcttagtacggtacaggtctaacgtccggtccgacggtacgggtttacctacgacgtccgtaccttccggtccgtacctaccgtaactccggtcggactacggaccgtaacccggccgttacctacggtaaccctacttccgtttaccggtagggtccccttaccggaagggtaccgtacggaacggggtaccgggtaacgtaccggttaatttaaccgtttaacttaacggtacggtaccgtacgacccttaattaaacgtaactaaacaaaaccgttaaataaaaccgtcggtttagggtcgttaccgggtaaccgggtaccggtaaaccgaacttaccgggtacccttaccggtaacggtaccgaaccggtaaccctaacgggcccttacccgcccggtaccgttacgaacccttccggttaccctacccccgttacccg

SEQ ID NO: 252805 - DNA, 788 bp, Homo sapiens
  misc_feature: GYAE6OF02IRO7F.49.35.D02.1.454.CMB.1.raw
  modified_base (462)..(462): a, c, t, g, unknown or other
  misc_feature (462)..(462): n is a, c, g, or t
  modified_base (560)..(560): a, c, t, g, unknown or other
  misc_feature (560)..(560): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctcctcactcagggcacgacgggtcctcgggcccagtctgccctgacctcacgcctgtcccttccgtggtccgttgggtcctccgtaggaccaggttaccgatccaacctacgtccttaccctcgacctaacgtacgggaaaccccaccaaagttcggtaaccgtttggtaaccttaagtaactttctcgttccttccgtacggttaaccccaaactaaccgttacccccggactaaaacccggtcccccaaaacttccaagttcgtaacgtttcctttagggacggtacctaggttacggacgtcccggggcccggtacggttaacggggttttcccngttacgtccctcttacccgtcccggtactacccgaaggttcgtcggactacgccgtaaccgtccccgtccacggaccctagtccgttccggcggtccnccggtacgcgacggacgggacgtggacgtgtacttacgttcgacgtcgacttccgacaacgttacaacgaaactaacctaacgtcgggttaggttaccggtcgggaccggtaccgaaacgtaaccgtccgtaacccgttcgtaccgtaacggacctacccggtactacccggttccccgtaccccggttcggtccctaccgttcccgtacccggttcccccttacccg

SEQ ID NO: 252806 - DNA, 851 bp, Homo sapiens
  misc_feature: GYAE6OF02IYMM1.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatccaccatggactggacctagggacggtttccttcttttgtggtggccagcagctacgaaggtgcccaggtccccgggtccagtccgtggtcgactaagttccgtgggggtcctgggtaacgggtaggaaacggtaaaacggtccggttcggggtccggttacggggtacggtaaacgggttccttcccgtacggacggaaacgggttccgtttacggtaggggaaccgtaaccctaacccgtttaaacaaaacccttaaccgtttgtaccgttggtacgacgggtccgtgggggtccggaccgaccgtaccgggtcccccggtaggtaaccgacgggttccgttgggtagggtgggggtaacgggtaaacgggtactaccccgtaacccttacgttaaccttaagttaactaacggaacctaaacgtacttcggacctaacgacgtaaccttaccgttaaccaaccgaacgtaggtaaccgtaccctttaacgttacgtacggaaccgaaaccaaaccgtacccgtaaccgaaacaacccgtaaccgaaccgttaaccgtacgtaacggaaccgttagaccgacgaacgtacgtaacggtacggtcccgtacggtacccgaaccggtaccgggttaacctttccgtttagttccgtggaccgtacggtagacgtaagttcggtttgttcttaagttcgttacgtaacgtttacttacgttacgtagttacttgtaccg

SEQ ID NO: 252807 - DNA, 648 bp, Homo sapiens
  misc_feature: GYAE6OF02GQGGO.49.35.D02.1.454.CMB.1.raw
  modified_base (230)..(230): a, c, t, g, unknown or other
  misc_feature (230)..(230): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
tcagagtcgagagacacgaccggtgctcgatttagcacacgatagttgggtttgggggggggtctcaggaggcagcgctctcgggacgtctccaccatggcctgggctctgctatcctcaccctcctcactcagggcacagggtcctgggcccaggtctgccctgactcagcctgcctccgtgtctgggtcctcctggacagtccgatcacatcctctgcactggaaccnccaatcgacgttggtacttataacttctgtctctcggtaccaacgaactaccccggacaaaacgtccccaaatcatgatcttggacgtcagtgatccggaccgcgtagggtttcncacgtccgctttccncccggtctaccgaagtccgaggtcgacggcaccggcccgtcccgtacgacctacttccgtcgtcggggcctacgcggtcgttaggacgggacggtacgggactcggtaacttcttaacgtgcctacggcttaccgataacgaaactaaaccaattaaacgtccggtttgggtcgttacggggtccggaaccgggtaactaaccgtcgacccgttctaacgtccgaacgaccccgtaggtacctcccggacccggttccgtaccacccttcgtcccgtacccctacccg

SEQ ID NO: 252808 - DNA, 914 bp, Homo sapiens
  misc_feature: GYAE6OF02IZZ42.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatcgtgggctgaggtgagaaagccgtgggtcgtcggtgaaggtctcctgcgagtcttcgtggagactaccttacaactaactttgctacgtcaagtcgtgggtcgacgacgtacggccccgtaggaacgaaacgggtccgttaggaggttagggggtacggggaaaggtactacccgtaacccccgttaattacccgtttaaaagtaagttaaacggaaccctaaaaaccttaagttaccggaacctaaccgtaaacggtaaaccttaactttaccccgaaccggtaaaccgtaacggtaaaccggttaccctaaacccccgttttaagaccccgggtaaaccggtaaacccgtaaaaaccgttaacccccgaaaacccgggtaaaaccccaaaaccggaaacccggttaaaccccctaaaccgttaaacccgggttaaaacgggtaaaaaccgtttaccgggaaccccggtaacccgtaaacccgggtaacccggttaaacgggtaacccttaaaccccggttaccggaacccccgggtaaaccggaaccccgggttaacccgtttaaacttttaacggtttttaccggtacgggttaacggtaaccgggaaggtaacgggtaacggttaacgtttccgtttaaccgtttttacgaacggtttacgttaacgtaacggttttaaccggttacgtttaaccgttaagtttacggtttaaccgg

SEQ ID NO: 252809 - DNA, 751 bp, Homo sapiens
  misc_feature: GYAE6OF02HGJZG.49.35.D02.1.454.CMB.1.raw
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacacgggtcctcgggcccagtctgccctgactcagcctgcctccgtgtcctgggtcctccgtggaccngtcgntccaccatcctccgtgctacgtacggaaccaccgaatcgtacgtttacggtacttaatacttcgttgtccttcctacggtaaccaacgtaacctaccccggactaaaccgtaccccaaacgtacctatcgtaacttcgttgagttcaagtcacgtccggccggtcgtaggggtttcctacgtacgtccgtcttccggtccggtccttacccgtaagtcgtacgggcacgtaccgacccggtcccttcccgtcgaaccctacgtccgtttcgtcgggtccgtccgacggtccgtaggaacggtacggtaggtccttaagtacgtttttacgacgttacgtccgtagtaccttacgtaacttaaccgtaaaccaaaaccttaacgttaaaccgttaccgtttagggggttacggttaaccggggtaccgggtacggtaaaccgtaaccggtaccgtacccggttagtacccggtcaacccggtcgaacgttcccgtaccgtccccgtagggtccctacgttcccgttaccgtccccgttaccc

SEQ ID NO: 252810 - DNA, 844 bp, Homo sapiens
  misc_feature: GYAE6OF02H98S1.49.35.D02.1.454.CMB.1.raw
tcagagtcgagagacacgaccggtgctcgatttagcacacgatagttgggtttgggggggggtctcaggaggcagcgctcgcgggacgtctccaccatggcctgggctctgctattcctcaccctcctcactcagggcacgagggtcctcgggcccagtctgccctgactcagcctgcctcgtgtcgtgggtctccgtggacagtcgatcacctatctcctgcacgtcgaaccacaatgacgttaggtacttataattctgtcctcgtagtaaccaacaacgtaccccggacaaaccgttaccccaaacgttcaagtcgtacttccgtttaggacgtaccgtagtaggtaccgtcccgggtacccgtacgggttacggggttttcctactaacgtcccggttccgttacccggttcccggtactaacccggtacggttccgtcggaccgtaacggtcccgtaaccgggtccccttccgacggaaccctcggttacccgtcggttaccggggcccttaaccggacggtacgtttacgggaacggggtaaccggtaccgtacggttaacgttacgtttttaaacgaccgttacggacccgttaacgttccccgtaataaccgtttaaaccaaaaccgttaaaaacccgttaaataaacccgggtttgggtttaacggggtttaccccggggttaccgggggaaacccggggtaacccgggttaaaaccctaacggtttaccgacccccggtttacgtaaccggtacccgaaccggtaacccgtaaggttcccgtaccccgtacccggttcggtaacctcccgttacctacccgttcccttaacccg

SEQ ID NO: 252811 - DNA, 720 bp, Homo sapiens
  misc_feature: GYAE6OF02H20KX.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccacaatgacgttggtacttatattctgtctctgtacaacacgtacccgcaaacgtcccaactcatgatctttgaggtcagtcgacgtcggcccgtcgtacggggtttcctacgacgtcgtcctttaccgtcccggtaccgttacccgtaacggttccgtacggtccaacggaccgacccggtccccttcccgtacgaccctatccgtcgtcgggtccgtacccgtaggtccgtacgggacggaccggagtaccgttagtaactttagtttaccgtgtacgtacgtcgttactaacgtaacttaacaaaacctaacgtaaaaccgtacggtttacggggtaccgttaccggggtaccgggaaccggtaaacctaaaccggttaccgtacccgttacccgtacgtacccgaaccggtacccgacgggttacccgtacccggtccccgttaccggttaccctaccggttcccgttacccggttaccccgtcccccg

SEQ ID NO: 252812 - DNA, 683 bp, Homo sapiens
  misc_feature: GYAE6OF02G7OLV.49.35.D02.1.454.CMB.1.raw
  modified_base (169)..(169): a, c, t, g, unknown or other
  misc_feature (169)..(169): n is a, c, g, or t
  modified_base (297)..(297): a, c, t, g, unknown or other
  misc_feature (297)..(297): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactnagcctgcctccgtgtctgggtctcctgacagtcgatcaccatctctgcactcggaaccaaccaatcgacgttggtacttatattctgtctctgtacaacaactacccgacaaacgtccccaaactcanagtatcttgagtacgagtgagtccggccgcgtagggttctcgatcgtcttctccggactactaacgtcgtagcagcgaccggcctacccgtcgaacctactccttacgtcgggcctaccgtacggtcgtaggtaacgggacgtacggcctagtaacttacgttacgtcgacgtacgtctacgtaaataacgtaaacaaaacgtaaacttaaaccgtaacggtttcgggttacggttaccggggtaccgggtaaacggggtaaacctaaaccgtacccgtaccgttaacccgttacggttacccgaaccggacccgtaaacgggttccctaccggttaccccccgttcggtacctacccgttccgttcccgttccccggttaccccc

SEQ ID NO: 252813 - DNA, 802 bp, Homo sapiens
  misc_feature: GYAE6OF02IL1QQ.49.35.D02.1.454.CMB.1.raw
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctagaggtcgcccgagtccccgggtccagcgtggtgcaatcgtgggctgaggtgaagaaacgccgtgggttcgtcggtaggacggtcctccgtggccaaggtccttcgtggacgacctacctttacaacttaactttgccgttagctacgcgttagggtgccggacgacccggaccccgttggaaacgtaacggccgttgggacgggtttacgggggtagggaaacgtacctaccccgaaccccgttagttaacccttaaattacgtaacgtaacctaaaacgtagtacgacaaccgaagtaccttaactaccgaacgacgaacgtcgttaccctaaacccgtttacgtaccgacggaaaccctaaagtaccccaaaccggtaaccaaacgacgtaccgtaaccgtaagttacgaaccgttacggcgtaactccgaaccggtaacgttaccgtccgtaccggtaacccgaccgggtaaaccgttccccggttaaagttttaccctttacgggtcccgtaaggttaacccgggtaaggtaaacggttacggttaagttttacccggttaccgtttttaacgtacgtttaagtaaccgttttaaccggttaacgtttaacggtaaccttttagttaaccgtttccgg

SEQ ID NO: 252814 - DNA, 827 bp, Homo sapiens
  misc_feature: GYAE6OF02F6FU2.49.35.D02.1.454.CMB.1.raw
  modified_base (128)..(128): a, c, t, g, unknown or other
  misc_feature (128)..(128): n is a, c, g, or t
  modified_base (645)..(645): a, c, t, g, unknown or other
  misc_feature (645)..(645): n is a, c, g, or t
tcagagtcgagagacacgaccggtgctcgatttagcacacgatagttgggtttggggggggtctcaggaggcagcgctctcgggacgtctccaccatggcctgggctctgctattcctcacccttccncactcagggcacagggtcctgggccagtctgccctgactcagctgcctccgtgtctgggtctaccgtggacagtcgattcaccatctctgcactggaaccacaatgtacggttgtaacttatagttcctatcctctaggtaccaaagtaactaccccggacaaacggtacccctaaaactccaagttacgtaacttcttttagggacgttaccgtacggtacgtaacggtcccgggtaccccggtcggtaaccgggggttttaccttcgaaccgtttaccgccgttttccgtaccccggggttacctaaacccgttaaacggtcccgttaggaacccgtaacgggaccgtaaaccggggtccccctttacccccgttacggaaaccccttaccgtttaccgttacggtccggggacccttaccggacgggttaccgacgggtaacggggaccgtaagggtacctagggttaacttacgttaacgttcgaacgtggtaccactaataaaccgttaaanaaaccgtttaaacgaacgtttaacggtcggggtttaacgtttcgggggaaccgttcccgggaaactaaccgtaccggtacccgttccggtaccgtacggaaccttacccgggaacggttcccgttaccggtaccccgaccgggttacctacgggttacccgttcccgttacccgttcccccg

SEQ ID NO: 252815 - DNA, 794 bp, Homo sapiens
  misc_feature: GYAE6OF02GDJT1.49.35.D02.1.454.CMB.1.raw
  modified_base (293)..(293): a, c, t, g, unknown or other
  misc_feature (293)..(293): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacagggtcctgggcccagtctcgccctgactcagcctgcctcgtgtctgggtctccgtggacagtcgatcacctatctcctgcactggaaccaccaatgaccgttaggtacttattaacttctgtctcctggtaccaactaacgtaccccgganaaacgtaccccgaaactctatgtaacttcgtttcggagggttcaggtcgaacgttcccgggaccccgtcggtacgggggttttcctacgtacttccggtccgttttaccgttaccgggtccttacccgtaaagtttcgtacgggcaacggaccgtaaccggtccccttacccgtcgaaccctacggttcctacggttcggggccctttacccgggaggtcccggttagggaacgggtaccgggacgggtcgttaaggttaactttaattaccgttcgaccgtagtcctacaagttaactaactaaacgttagtaaaccgtcggtttaggggtacggttcggggacccggtaccgggtaaaccctaagttcccggtaccgtttacccggtaacgtacccggtaaccggtacccgtaaccggggtccctttccccgggtaccccccgggtttacgggttacccctccggttaccggtttcccccggttcccccgttacccccg

SEQ ID NO: 252816 - DNA, 663 bp, Homo sapiens
  misc_feature: GYAE6OF02IZFAW.49.35.D02.1.454.CMB.1.raw
  modified_base (409)..(409): a, c, t, g, unknown or other
  misc_feature (409)..(409): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtgcccagtcccgggtccagctggtgcaatctgggctgaggtgagaagccgtgggtcgtcggtgaaggtctcctgcgaaggcttcgtggacgacacttcaactaactttgctgtcagcgtgggtgcgacacggcccgtggacgaacggtccgttggaggtgggtgggagactccgaccctataccgttaatagtacgacaaactatcgacacagactactacacgacagtaacgtccaacctttanacggtaccgaaacaacctaccaaccggaaccaacgacgacccgtaacacgtacggtaactcggtaccgacgtacgtacccgtaggacgttccgtaccggtaccgaaccgtaccggtaaccgttatttaaaccgtttcgttacggtcggtaccgtagggacgtaacggtaagtttaccggtttaccgttttacgtaacgtttacggtaacgttaacggtttaaccgttacggtttacctaatttaaggttcccgg

SEQ ID NO: 252817 - DNA, 837 bp, Homo sapiens
  misc_feature: GYAE6OF02JQ56H.49.35.D02.1.454.CMB.1.raw
  modified_base (326)..(326): a, c, t, g, unknown or other
  misc_feature (326)..(326): n is a, c, g, or t
tcagagtcgagagacacgaccggtgctcgatttagcacacgatagttgggtttggggggggtctcaggaggcagcgctctcgggacgtctccaccgatggcctgggctctgctattcctcgaccctcctcactcagggcctacgacgggtcctgggcccagtctgccctgactcgagcctgcctccgtgtcgtggtcctcgtggactagtcgtactcaccgactctcctgcctaactcggaaccacgtactgtaacgttgtaccttaatacttcgtcgtctactcggtaccaaacgtacgtacccggactaaccgtacccaacgtntagtagtactttcgtagacggtctagtacgtacgtccggtaccgtaggtacggtttcctagtaccgtccgtcgtcccgtaccggtactaccgtaagtcgttcgtacgaccgtacccgtccgtaccctccgtacgtacctacgttccgtacgtccggtactccggtaacgtccggagggaacgggtaccggtacgttaacgtagtttaacccgttaacgttaccgtacgggtacaacccgttcgtaactaaacggtaaactaacccggtaaaaattaaccccgttaaacggttccggggttaggtttacccgggtaacgggtaccgggttaaacccggaacccttaaacggtttacccccgcccgggtttaaaccggaaccccgggttcccgaaacccggttaacccgggtaaccgggttacccccgttaaccccgggttaacccccggggttacccgttaaggttacccccggtttaccccggttacccccggtttaccccccgttccccg

SEQ ID NO: 252818 - DNA, 722 bp, Homo sapiens
  misc_feature: GYAE6OF02FICLB.49.35.D02.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (534)..(534): a, c, t, g, unknown or other
  misc_feature (534)..(534): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacagggtcctgggcccagtctcgccctgactcagcctcgcctccgtcgtcttgggtctcctggacngtcgatccaccatctcctcgcacgtacggaacccaccaatcgtacgttgtacttatattctgtctctcgtacaacacaccgacaacncccaacncatnattcttgagtcagtcgacgtccggccgacggtacgggtttctcgacgttccgtccgttccgtcccggtactacctacggttcgtacgggacgtacggtacccggaccggtccctaccccgtacgaccctaccttccgtccgtcggtaccctaccggtacggcggtaacggaccgggacgcgggttactaacgtactttacgttacgtcgactacgtacctagtaacctaanaaacaaactaacgttaacgtacgggttttacgggtacggtttaccggggacgggtaacccggtaaaccgtaacccggtacgttacccgtacctaccggtaaccgaaccggcccgtaaccggtcccgttaccccggaccccgttccgtccgttacccgttacccgtttccccgttaccccgttcccccg

SEQ ID NO: 252819 - DNA, 785 bp, Homo sapiens
  misc_feature: GYAE6OF02HOW1Q.49.35.D02.1.454.CMB.1.raw
  modified_base (202)..(202): a, c, t, g, unknown or other
  misc_feature (202)..(202): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtaggacngtcgatccacatcctcctgctacgtcggaaccacaatcggacgttgtacttattacttctgtctccgtagtaaccaacaacgtacccggacaaacgtccccaaactcatcgtaattctttagacggtctaggtaagcgtccggcccgtaggttcgggttttccacacgttccgtccgtttccgtaacccggggtccttaccgtaacggtttcccgtagggccgttaacggacccgtacccgggtccccctttacccgttacggaaaccccttgtttccccggtcggttacccggggtcccgttacccgggtaaccggttccggttacgggaaccggggaacgggtacgggtccttaggttaacgttttacgtaacggtcgtaccgtacggtacctaacttaacggtaaaccgttaaacaaaaccgttaacttaaaccggtacgggtttcgggttacggttcgggaccgggtaaccggtaccgtaaaccgtccgtaccgttaccgtacgtccgtaccggaccgtacgtacccgtcccgtaccccgttacgtcccgttacgttcccttacccgttcccttacccc

SEQ ID NO: 252820 - DNA, 743 bp, Homo sapiens
  misc_feature: GYAE6OF02G33C4.49.35.D02.1.454.CMB.1.raw
  modified_base (477)..(477): a, c, t, g, unknown or other
  misc_feature (477)..(477): n is a, c, g, or t
tcagagtcgagagacacgaccggtgctcgatttagcacacgatagttgggtttggggggggtctcaggaggcagcgctctcgggacgtctccaccatggcctgggctctgctattcctcacccctcctcactcagggcacagggtcctgggcccagtctgccctgactcagcctgccctcgtgtcgtgggtcctccgtggacagtcgactccaacctatccgtcctgcctacgtacggaaccccaaccaatcggtacgtttggttaacctttataatttcgtcgttcctccgttcggtaacccaaaccaacgttacccccggactaaacgtacccccaaactcactgtacttcgtttaggacggtccaaggtctacgtacccggccggtcgtacggggtttccactacgtctccgttcgtcccggtacctaccgtagtccgtacggccgtacggccgtaccggtccccttcccgtanacccgtacgttacccgttcggtccgggtccctaccgggacggtcctaagggacgggtacgacgtaccgtagtactttacgttacctcgacgtacgtcctaacgtaactaacgtaaaccaaagtaaaccttaaggtccgttggggttaccgtcgggtaccgacggtaacctaacgtccgtacccggttcctaccggtaccaaccggtaccgtacgcccgttccggaccccgtcggtacctacccgttccgtacccgttccctccccg

SEQ ID NO: 252821 - DNA, 804 bp, Homo sapiens
  misc_feature: GYAE6OF02IXNEI.49.35.D02.1.454.CMB.1.raw
  modified_base (251)..(251): a, c, t, g, unknown or other
  misc_feature (251)..(251): n is a, c, g, or t
  modified_base (410)..(410): a, c, t, g, unknown or other
  misc_feature (410)..(410): n is a, c, g, or t
tcagagtcgagagacacgaccggtgctcgatttagcacacgatagttgggtttgggggcatcacataacaaccagattcctcctctaaagaagcccctgggagcacagctcatcaccatggactggacctggaggttcctctttgtggtggcagcagctacaggtcgcccagtcccggtccagctggtgcaatcgtgggctgaggtgagaacgctggtcgtcggtgaggtctcctgacaggcttcgtgganacaccttacgaaactaactttgacttgtcacgcgtgggtcgcgacgtacggcccctagggacctaacggtccgttaggacggttgggggtacgggacggtaacttacccgaaccccgttaattacccgtttaaataacgttacgtaacgtaaaaccgtntacgacaaccgtacgactaacgttacccgaagtaaccaagtaccgttacctaaccccgtttagtacccgtacggtaactaaacctaccgtaaaccggtaactaaacgaccgtacccttaacgtaacgtacggttaaaaccgtcgacccgacgttaacccgacccggttaaaggtcctttaacccggacgggtaaccccgtaaaccgggtacccggttaacccgtttaaactttttccgggttaaacccttcgggtaacggttaaccggtaagggttacggtaaccggttaagttttacccggttttaacctttaaccgtttaacgttaaagggtttaaccctttaacggttaaccccgtttaagggttaacctttaacgttttacggttaccgg

SEQ ID NO: 252822 - DNA, 686 bp, Homo sapiens
  misc_feature: GYAE6OF02FGIEL.49.35.D02.1.454.CMB.1.raw
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (317)..(317): a, c, t, g, unknown or other
  misc_feature (317)..(317): n is a, c, g, or t
tcagagtcgagagacacgaccggtgctcgatttagcacacgatagttgggtttgggggggtctcaggaggcagcgctctcgggacgtctccaccgatggcctgggctctgctattcctcaccctcctcactcaggcacagggtcctgggcccagtctgcctgactcgagcctgcctccgtgtcgtggtctcctggactggtcgatcaccatctcctgcacgtggaaccacgaatgacggttgtacttagtaattcngtctccgtgtaccaacaagacccgnaaacgtccccgaaatcatcgatcttagagtctagtntacgtcggccgcgtaggtttcatacgtgcttctaccggctaccgtaagtctacggctacgtcgtacgtcccgtcccgtagtacccgactttccacgttcgggtaccgttaccgtacggaccgtacggtacggtaaccggacggtacgttacgtaacgtttaacgttaaccggttacgacgtacggtacgtaccgttaactaactaaaccgtaaaacgttaagtaaaacccgttacgtttaagggttacgtttaccggtccggacggtaaccgtaacgttacgtacccgtacgtaaccggttcaaccgtaccgtaacgtaccgtcgttaccccgtacgtaccgaccgtttcgttacgttcccgtaccccg

SEQ ID NO: 252823 - DNA, 1180 bp, Homo sapiens
  misc_feature: GYAE6OF02F3NY0.49.35.D02.1.454.CMB.1.raw
tcagagtcgagagacacgaccggtgctcgatttagcacacgatagttgggttggggggggtctcaggaggcagcgctctcgggacgtctccaccatggcctgggctctgctattcctcaccctcctcactcaggtcacgacgggtcctgggcccagtctgaccctgactcagcctgcctccgtgtcctgggtctcctggacagtcgatcaccatcctcctgcactggaccctacgatgaccgttaggtaccttacgtaacttccgtagttcctaccgtaccggtaaccctaaaccgtaaccgtacccccggtaaccgtaaacccggtaaccccctaaaaccgtaccgtaaccgttaccgtaaccgtttaccggtttacggtaacggttaccgtaacggttacggtaaccggttcccgggtaccccgggtaccggttaaccggggttttacccctacccggtacccggttaccccggtttaccccgttaccccgggttaaccccggtacccgttaacccggttaacccgggttaccggtaccgggtaaccggtaaccccggtaacccggttaccccggtaccccgttaacccggtaacccgtacccgttacccggttacccggtacccgggtacccggtaacccgttaccgggtaccgggttaaccgggtaaccgggtaacccggggtaccggttaaccggttaacggtttaaaccgtttaacccggtttaaacgttacccgggttacccgtaacccgggttaacccgttaacccggttaaacgtaaaaccccggttaaaacccgttaaaaaccgtttaaaaaccccggttaaaaccccgggttttaaacccggggttttaaccggggttttaaacccgggggtttaacccggggttaaaccccgggggttaaaccccggttaaaaccccggggtaaacccgttaacccccgggttaacccgggttaacccccggtttaaaccccgggtaaacccccggttaaacccggggttaaacccccggttaaccccggggtttaaacccccggggttacccccccgggttaaaccccccggggttttaacccccgggttaaccccgggtttaaacccccggtttacccccgggttttaacccccccggggttttacccccgttacccccccgggtttaccccccgg

SEQ ID NO: 252824 - DNA, 740 bp, Homo sapiens
  misc_feature: GYAE6OF02F5G8L.49.35.D02.1.454.CMB.1.raw
  modified_base (183)..(183): a, c, t, g, unknown or other
  misc_feature (183)..(183): n is a, c, g, or t
  modified_base (228)..(228): a, c, t, g, unknown or other
  misc_feature (228)..(228): n is a, c, g, or t
  modified_base (315)..(315): a, c, t, g, unknown or other
  misc_feature (315)..(315): n is a, c, g, or t
tcagagtcgagagacacgaccggtgctcgatttagcacacgatagttggggtttggggggggtctcaggaggcagcgctctcgggacgtctccaccatggcctgggctctgctattcctcaccctccgtcactcagggcacaggggtcctgggcccagtctgccctgactcagcctgcctcgngtctgggtctcgtggcagtcgatcactatctctgcatcggaaccncaatcgacgttgtacttatattcgtcgtctcctggtaccaacactaccccggacaaacgtccccaactcagtcattcgttgtacgtnagtcgacgtccggccgcggtacgggtttctcgtagtccgtcttcgtccggtactacccgtaaggtcctacgggccacggaccgtacccgggtccctacccgtcgaaccctcgtaccgttcggtcgggccctaccggacgggtacgtacgggaacgggacgggtacggtacgttacgttagtttaacgtttccggtacgtacgtccgtaccttacgtaaacttaaactaaaccgtaaaacttaaacgttaaacgttaacgggtttgggtccggttccggggacggtaaccgggaaacctacgggtaccgtacccggttacccgtaaccggtcggtaacccggtacccggtacggtaccccgtccccggttaccccggtttccggtacccgttaccgttcccggtttaccccgtccccgttaccccg

SEQ ID NO: 252825 - DNA, 711 bp, Homo sapiens
  misc_feature: GYAE6OF02HAIUA.49.35.D02.1.454.CMB.1.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (459)..(459): a, c, t, g, unknown or other
  misc_feature (459)..(459): n is a, c, g, or t
tcagagtcgagagacacgaccggtgctcgatttagcacacgatagttggggtttggggggggtctcaggaggcagcgctctcgggacgtctccaccatggccgtgggctctgctattcctcaccctcctcactcagggcacgagggtcctgggcccagtctgccctgactcagcctgcctccgtgtctggtcctctggacnggtcatccaccatcctctnacacgtcgaaccaaccaatcgacgttgtaattaatacttctgtctccgtaggtaaccaaactaacctaccccggactaaaccgtaccccaaacgtcatacgtattccgtttagacggttcaaggttcgaccgtccggccgtacggttacgggttctacgtacgttcccggtactttccgccggttactaccgtacgttcgtcgacgtacgacccgtccgttaccctaccgtacgtaccncgttccgtcggtcggtccctacggtacggtcgtacgaccgggtacgtaacggtcgttaacgtattacgtgtacgcgtacgctaacgtataacgtaacgaaataacgtaactcgggtttaacggtccgtcgggtaaccggacgtaaaccgttacgaccggttaccgtaccgacggtaccgaccggtacccgtacgccccgttacccggtcccgttaccgtccttaacccgtcctaccccgtcccttacccccg

SEQ ID NO: 252826 - DNA, 788 bp, Homo sapiens
  misc_feature: GYAE6OF02HWGR8.49.35.D02.1.454.CMB.1.raw
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacgaggtcctgggcccagtctcggccctgactcagcctgcctccgtgtccgtgggtctccgtaggacngtcgatcaccactcncctgcacgtacggaaccacgtaatcgtaccgttggtaaccttataacttcgtcgtctcgtcgtaaccgtaacaccgtaccgacgtaaccgtaacccaactcgagtacgtacttcgttacgacgttaccgtagtagtaccgtaccgtcccggtacggttacgggtttccgtactaaccggtcgttcccgttctacccggctaccgtaacgtcgacggcgtacgccggaccggtcccctccgtaccgactacgttcgtccggtcgtccgtaccgacggtccggtaggaacgggcgacgggtactgtacgttaactcggttacgtacgacgacgttaacgtaacttaacgaaaccgtaaaaccgtaaacttaaaccgtcggtttaacgggttaccgggtaccggtacccggggtaaaccggtaaaacggtacccgtaacggtaccccgttaacccgttaacccggcggtaacccggtacgtaaacccggtcccgttaccccggttccccgggttaaccgttacccggttaccctttacccgggttaccccgtttacccccgtaacccccgg

SEQ ID NO: 252827 - DNA, 757 bp, Homo sapiens
  misc_feature: GYAE6OF02F7UFX.49.35.D02.1.454.CMB.1.raw
tcagagtcgagagacacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtcggaacccaccaatgtacgttgtacttatattctgtctcgtaggtaccaaactaacgtaccccggacaaaccgtaccccaaactcatacaacttcgtttggaggttccagtgtacgtccggtccgcggtacgggtttctacgtacgtccgtccgttccgtccggtccttaccgaacggttcgtacgggcaacggtccgacccgggttccccttacccgacgtacccgacgtttccgtaccggttacgggtccctcccgggaacggttcccgggtggaaacggggacggtacgggtacgttaaggtaacttttacgtacgttcgacgtacgttcctacgtaaattaaaccgtaaacgtaaaacctaaacgtttaaaccggttacggttttccggggttaagggtcccggggtaccgggaaccgggtaaaccctaacggtacccggtacccgttaccggtacgttaccgaccggacccgtaacggtcccgtcccgcccgttacgtcctcgttacccttcccgtaccccttccccg

SEQ ID NO: 252828 - DNA, 783 bp, Homo sapiens
  misc_feature: GYAE6OF02G5YZH.49.35.D02.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (254)..(254): a, c, t, g, unknown or other
  misc_feature (254)..(254): n is a, c, g, or t
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcacgcctgcctccgtgtctgggtcctcctggacngtcgatcaccatctctcncactcgaaccacaatgacgttgtacttatattctntctctcgtacaacaactacccgacaacgtaccccaactcatgattctttgagtcagtgacgtccggccgtcgtacgggtttcctacgtacttccgtccttccgtccggtaccttacccgtaacgtcgtaccggcaacggtacccgacccggtccccttaccccgtaccgtaccctacgttccgttacccggtcccggggtcccgtaaccggtcgggtaccgggttacgggaaccgggtaccgggtaacgggtacgttacggtaaagttttaccgttacgttaccggacgtaccgtaccgttacctaaacgttaactaaacccgtaaacctaagttttaaacccgtacgggttttacggggtacgggttaccggggaccggggtacccggaaaccgtaacgggtacccgttacccggttacccgttaccggtaaccgtaccggtaacccggtaccggtcccgtccccgggtaccccccttccgggttacccttaccccgtttccgtcccccggttccccgttaccccccg

SEQ ID NO: 252829 - DNA, 742 bp, Homo sapiens
  misc_feature: GYAE6OF02IMQ9L.49.35.D02.1.454.CMB.1.raw
  modified_base (203)..(203): a, c, t, g, unknown or other
  misc_feature (203)..(203): n is a, c, g, or t
  modified_base (271)..(271): a, c, t, g, unknown or other
  misc_feature (271)..(271): n is a, c, g, or t
  modified_base (427)..(427): a, c, t, g, unknown or other
  misc_feature (427)..(427): n is a, c, g, or t
tcagagtcgagagacacgaccggtgctcgatttagcacacgatagttggggtttgggggggggtctcaggaggcagcgctctcgggacgtctccaccatggcctgggctctgctattcctcaccctcctcactcagggcacagggtcctgggcccagtctgccctgactcacgcctgcctcgtgtcgtgggtctccgtggacngtcgatccaccatctcctgccacgtcggaacccaccaatcggtacggttgtaacttagtaattccgtnttcttccgtacggtaccaactaaccgtaccccggataaaccgtaccccaaacgtcaagtgtactttcgttggacggttctaaggcgtacggtccggaccggtcggtaggggtttcctagtactccgtccttcgtccggaccttaccaacgttccgngacgacgcgtaccggtcctacctcggaactacgtccgtcgtacggcctcggacggtaccgtaggacggacggtacggtacgttagtaacgtttacgtacgcggtacacgttacctactaacgtaacttaaacaaacgtaactttaaacggtaccggttcgggtacggttaccgggacgggaaccggtaaacccgttacggacccgtaccggttaacctacggtacccgtaccggtaaccggtccggttaccgttaccccggaccccggttagttacccggtaccctttcccggttacccggtaccccttccccgg

SEQ ID NO: 252830 - DNA, 906 bp, Homo sapiens
  misc_feature: GYAE6OF02I1MGE.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccactctcctagcacgtggaacccaccctaaagtcggtacgttacgggtaacctttaagtaaatttccgtacgttccgttcccttaggttaacccaacctaaactaccccccggtaactaaaaccgtaccccccgaaaaccttaccaacgtaggtaacttccttttgggaacggttctaacggttgtaaccgtacccggtcccggtccgttaacgggggtttcctacgtacgttccgtccgtttccgtacccggtctcccgaaggttcgtagcgtacgccggtacggcccgtttacccgcgtaaccgtacttccgtttccggttacgggtcccgttaacccgcgggtaccggtacgggtaaacgggtacgggtaacccggggtcgttaacggtaacgtttttaacctttaccgtaccggttaccgtaacgggtcccttaagtaaccttaaacggttaacctaaaaaccgttaaaccgtaaaaccgtttaacggttttaccggggttaccggttttcccggggaaaccggggtacccggtaaaccccgttaaccggttaccgtacccggttacccggttaaccccgtaacgtaacccggtaccccgtaacgggttaccccgtttacccgacccccccggtttccggttaccccgttacccgtttacccggttccccgttaaccccccgttaacccccccg

SEQ ID NO: 252831 - DNA, 726 bp, Homo sapiens
  misc_feature: GYAE6OF02IILD0.49.35.D02.1.454.CMB.1.raw
  modified_base (224)..(224): a, c, t, g, unknown or other
  misc_feature (224)..(224): n is a, c, g, or t
  modified_base (320)..(320): a, c, t, g, unknown or other
  misc_feature (320)..(320): n is a, c, g, or t
tcagagtcgagagacacgaccggtgctcgatttagcacacgatagttgggtttggggggggtctcaggagcagcgctctcgggacgtctccaccatggcctgggctctgctattccctcaccctcctcactcgagggcacgagggtcctgggcccagtctcgccctgactcgagcctgcctcgtgtcgtggtcctccgtggacagtcgatcacatccgtccgtncgtactacggaaccacaagtgtacgttgtacttatattcctgtctcgtacgaacctaactacgtacccggactaaacgtccccaatcgtatacgtnttacgttgacggtctagtgtaccgcggtccgtaggtcgggtttcacctcgttccgccgtttccgaccgtctaccgtacgtcgtacgcctagtccggacctccctaccgtaccaccgtacttccggtacgtccggtaccgtaccggaccgtcgggtaacgggacgggtaacggacggttcgttaaggttacgttaacgttcgtacgtaccgtacgtacgtcgtaaacgtaacctaactaaccggtaacttaaccggtcgttacgggggtccgttacccggggaccgggtaaccggtaaaccgtaccggtaccgttacccgttaccgtaccggtaccgaccgtaccggaacgttccgtacccgtcccggtacctccggttacccgtcgttaccccgtccctaccccgg

SEQ ID NO: 252832 - DNA, 819 bp, Homo sapiens
  misc_feature: GYAE6OF02GLRFW.49.35.D02.1.454.CMB.1.raw
tcagagtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagctgcctcgtgtctgggtctctggacagtcgatcacatctctgcactcggaaccacaatcgtacgttaggtacttaataattctagtctccgtacgtaaccaactaactaccccggacaaacgtacccctaactacgatacgtacttacgtttgtacggtactacggttaggacgtccggcccgtacgggttacgggtttacctccgtacgttccgtccgtttacccgtcccggtacttacccgtacggttccgtcgggtaccgtacgtccgtaacccggtcccttcccgtacgtacctacgtttccgtaccggtccgggtccctacggtccggtacgttacggggacggaaccgtacgggtacgttacggttaactttaaaccggttccgtacggtccgtaacggttcttaacgttaaacgtaaactaaaacccgttaaaccgttaaacttaaacccggtttcgggtttaggggttacccggtacggggacccggtaaacccgggtaacccttaaacggggtcccgtacccgttaccgtaaccggttaccggacctaacccgggaacccgttcccgtacccccggttaccccggttacgggttacccttacccgggttccccgtttacccgggttccccccggttcccc

SEQ ID NO: 252833 - DNA, 718 bp, Homo sapiens
  misc_feature: GYAE6OF02H3O20.49.35.D02.1.454.CMB.1.raw
  modified_base (237)..(237): a, c, t, g, unknown or other
  misc_feature (237)..(237): n is a, c, g, or t
tcagagtcgagagacacgaccggtgctcgatttagcacacgatagttgggtttggggggggtctcaggaggcagcgctctcgggacgtctccaccatggcctgggctctgctattcctcaaccctcctcacgtcaagggtccacgacgggttcctaggggccctaggtctgcccctgactcagcctgcctcggtgtctcgggtctccgtagggacagtcgatcaaccagttcctccnggcctacacggaaccacgaatcgtacgtttggtacttaataactcgtagtctactagttaaccaacaacgtacccgacaaacgtcccaaatcgatcgtatcgtttgagtcagtagacgtcggaccgacgtacgggttccagtactacgtcttcgtccggtctaccgagtctcggacaacgcgaccgtacctccgacactactcgtacctggtacctacgacgtcgaggtacgaaccgaggtactacggtaactttcgtaacgttcaaccgtagtaccttagaactaacttaaacggaaaactaagtaaaacgttacggtttaacggggtacgttaccggggacgggtaaacccggtaaacgaacccgttaccggaacccttaccggttaacggccggaaaccgtccgggtaaaccgtccgtaacccggttccccgtacggttaaccctaccgttaccgttaccccggttacccctacccgg

SEQ ID NO: 252834 - DNA, 662 bp, Homo sapiens
  misc_feature: GYAE6OF02G2KHT.49.35.D02.1.454.CMB.1.raw
  modified_base (390)..(390): a, c, t, g, unknown or other
  misc_feature (390)..(390): n is a, c, g, or t
  modified_base (426)..(426): a, c, t, g, unknown or other
  misc_feature (426)..(426): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcagggcacgagggtcctgggcccagtctcgcccgtgacctcacgcctgcctccgtgtcgtgggtctcctgggacagtcgactcacctatcctcctgcctacgtacggaacccacctaagtcgacgttgtactattatcgtgtctcgtgacacactaccggacaacgtacccaactcatgtactcttgacgtcagtacgtcgccggccggtgtacgggttacctcgtactcgtccttcgtccgtactccacgtcgtcgngtacgacgccgtcctcctacgacactcgtcgtcgcncgagcgtaggacgtacgcggtactacttacgttactacgtcgacgttacgtctaacgtactaacgttaacgaaacgttaacgtacgttacgttcgggttccggtacgggacccgggtacgaaaccggttacgtaccgtacccgtccgtaaccggtcgacccgtacccgaaccgggtccctcccgttacccggtaccgttaccgtcccgttaccccggtcccgttaccccttccccg

SEQ ID NO: 252835 - DNA, 907 bp, Homo sapiens
  misc_feature: GYAE6OF02JLI2Y.49.35.D02.1.454.CMB.1.raw
  modified_base (204)..(204): a, c, t, g, unknown or other
  misc_feature (204)..(204): n is a, c, g, or t
tcagagtcgagagacacgaccggtgctcgatttagcacacgatagttgggtttgggggggggtctcaggaggcagcgctctcgggacgtctccaccatggcctgggctctgctattcctcaccctcctcactcaggcacccagggtcctgggccagtctgccctgactcacgcctgcctccggtgtcgtggtcctccgtggacngtcgatcacatctctgcacgtcgaaccacatcgtacgttcggtacttaagtaactttcgtcgttccttaccgttacggaacctaaaccgtaaacgttacccccgggacctaaaaccgtaccccctaaaacttccgagttcgtaactttccgtttcgtaacggtacaacggtggtaaccggttaccggcccggtaccggtacggggttttaccacgtaccgtccggtccttttcccgaccggtccgtaacctacggtttccgcgggtaccaacgggcccgtaccggtccccttcccggtacgaaacccttcgttaccggtcccggggttacgggacccgttacccgggtaacgggtccgttaaacggggaccggttaaaccggggacggttaccgttaacgggttaaagttttcccgttttaaacgtacccggtacggtaacgaccgttaacctaaccgttaaacggtaaacaaaacccgtaaatttaacccgttaacggttcggggggtttacctacccgggggtaacccggaaaccggggtttaaacccaaccggttacccggttacccgggttaacccgttaccgtaaccccgggtaaccggtaccccggtaagggttacccccgtcccggttaacccccggtttcccgggtaccccgttaacgtttccccccggttaccggttaccccccctttaacccg

SEQ ID NO: 252836 - DNA, 720 bp, Homo sapiens
  misc_feature: GYAE6OF02GW63L.49.35.D02.1.454.CMB.1.raw
  modified_base (157)..(157): a, c, t, g, unknown or other
  misc_feature (157)..(157): n is a, c, g, or t
tcagagtcgagagacacgaccggtgctcgatttagcacacgatagttgggttggggggggtctcaggaggcagcgctctcgggacgtctccaccatggcctgggctctgctattcctcaccctcctcactcagggcacagggtcctgggcccagtcngccctgactcagcctgcctccggtgtctggtactccgtggacagtcgactcgaccatcgtcctgcctactcggaacccacaagtcgtacggttcgtacttataattctgtctccgtcgtacaactactacccgactaaacgccccgtaactcatgtacttcgttagacggtcagtgacgtccggcccgacggtcggggtttcctcgtacgttccgtaccgttccgtccggtaccttccgaacggttcttacggactacggaccgtaaccgggtccccttacccgtacgtcccgtacgttccgtaccggttacgggcccttaccgacggtcggtagggaccgggtacgcggtacgttacggtaattaccgttacggttcgtaccgtacggtcctacgtaacttaccgaaactaaaccgtaaagttaacgtaaccgtttagggtaccggtttacgggaccgggtacgtaaaccggtaccgtaccggtacgtaccgtacggtaaccgaccgtcgaaccgtcgtcccgccccgttcgtccgtacgtcccttaccgttcccgtacccg

SEQ ID NO: 252837 - DNA, 525 bp, Homo sapiens
  misc_feature: GYAE6OF01CX29T.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctgtctcccaggtgccagatgtgccatccagatgacccagtctccgtcctccctgtctgtatctgtaggagacaaagtcaccatcacttgccggcaagtcaggacattagaaatgaattagcctggtttcagcagaaaccaggaaagcccctaagctcctgatctatgctgcatccactttacaaatgagtccatcaagattcagcggcagtggatctggcacagctttcactctcaccgtcagcagccctgcagtctagaagtattttgactaactttattactgtactaacaagtactttccttacttaccctacggtaccgtttccggccgtacggggtaccgacgggtaggagtcggttacaaggcgaacgtggtcggctcgacaccagtcgttacg

SEQ ID NO: 252838 - DNA, 505 bp, Homo sapiens
  misc_feature: GYAE6OF01CLEU9.43.60.F05.1.454.CMB.1.raw
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaatgaattagcctggtttcagcagaaaccagggaaagcccctaagctcctgatctatgctgcatccactttacaaaatggagtccatcaagattcagcggcagtggatctggcacagtctttcactctcaccgtcagcagcctgcagtctagaagtattttgctaactttattactgtactaacaagtactttccttcttaccctcggtacgttcgccgagggaccacggtggagtgtcaaggcgaacgtgtggttcgcacnctntgttc

SEQ ID NO: 252839 - DNA, 568 bp, Homo sapiens
  misc_feature: GYAE6OF01BHFNJ.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagccttggtttcagcaagaaaccagggaaacgcccctaagcctcctgatctatgctgcatccaactttacaaaatggactccatcaagatcagcgcagtggactctagacactagtcctttcactctccaccgtcacgcacgccctgactagtctagtaagttattttgaccttaactttattactgttactaactaagttactttaccttacctttacccgtcgggtaccgttaccgggaccgtaacggggtacccgtacgggtggtacttcggtacaacggtcgaacgttggtacggttcgacaccgtacttcgttcgttccg

SEQ ID NO: 252840 - DNA, 497 bp, Homo sapiens
  misc_feature: GYAE6OF01B8RYH.43.60.F05.1.454.CMB.1.raw
  modified_base (493)..(493): a, c, t, g, unknown or other
  misc_feature (493)..(493): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaaagctcctgatctatgctgcatccactttacaaaatggagtcccatcaagattcagcggcagtggatctggcacagctttcactctcaccgtcagcagcctgcagtctgaagtattttgctaacttattactgtctaacaagtatttcttcttaaccctcggacgttcggccaggggaccacggtggatgtcaagcgaactgtgttgcacactntgtc

SEQ ID NO: 252841 - DNA, 585 bp, Homo sapiens
  misc_feature: GYAE6OF01CMODV.43.60.F05.1.454.CMB.1.raw
  modified_base (419)..(419): a, c, t, g, unknown or other
  misc_feature (419)..(419): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctgtaggagacaaagtcaccatcacttgccgggcaagtcaggacattagaatgaattagcctggttcagacaagaaaccgagggaaacgcccctaagctctgatctatgctgctactcctaactttaacaaaagtggacgtacccaatacaagtattcagacggcaggtggatcgtggacacagtctttacacttctaccaccgtcagcagccctgctagtctagtaagttntttacgacttaactttattactgtactaacaagttactttacctttaccgttacccgtcgggtaccgtttccggaccggtaacggggtaccctacgggtacggtagtcggtacgtaacggtccgtaacgttggttcggacgttacgacctaacctgttccgttacg

SEQ ID NO: 252842 - DNA, 538 bp, Homo sapiens
  misc_feature: GYAE6OF01EIHGV.43.60.F05.1.454.CMB.1.raw
  modified_base (349)..(349): a, c, t, g, unknown or other
  misc_feature (349)..(349): n is a, c, g, or t
  modified_base (407)..(407): a, c, t, g, unknown or other
  misc_feature (407)..(407): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggtttcagcagaaaccagggaaagcccctaagctcctgatctatgctgcatccactttacaaaatggatccatcaagattcagcgcagtggatctggcacngtctttcactctcaccgtcagcagccctgcagtctagtaagtattttgactaactttnttactgtactaacaagtactttcttcttaacccgtcggtacgttcggaccgacggggacctacgggtggagttcggtacaaggtccgaaacgttcggtacgggtcttacgacctaaccctagtccttacgg

SEQ ID NO: 252843 - DNA, 630 bp, Homo sapiens
  misc_feature: GYAE6OF01E07DN.43.60.F05.1.454.CMB.1.raw
tcagtgtgagtagtcacgaccggtgctcgatttagtacgtcatcagggaaaggggagtcagacccactcaggacacagcatggacatgagggtcccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggttcagcagaaccagggaaagcccctaagctccttagtatctatgctgtacaacttacctaactttaacaaaactacggacgtacccaactacaagacgttacgacgcggacgagtggagtctacggcactacgtctttactacctcctccaccgtacacgcacgcctcgcagttcttagaagtaattttcgtactaactttaatttaacttacgttaccttaactaaacgtaactttacctttacctttaacccgttaccgggtaaccggttaccggtacccggtaaccggggtaacccggaaccgggtacgggtaagttacggttaccgtaacggtaccggtaaccgttacggttacgggtaccgtcgtccgacccgtac

SEQ ID NO: 252844 - DNA, 548 bp, Homo sapiens
  misc_feature: GYAE6OF01A5D5R.43.60.F05.1.454.CMB.1.raw
  modified_base (402)..(402): a, c, t, g, unknown or other
  misc_feature (402)..(402): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggtttcagcagaaaccagggaaacgcccctaagctcctgatctatgctgcatccactttacaaatggatccatcaagattcagcggacagtgatcgtaggcacagtctttcacttcctacacccgtcacgcacgtcctagcagtctagaagttntttacgactaactttattacgtgtactaactaagtctttacttccgttacccgtcggtaccgttcggaccgtacggggaccgtacgggtggtacgtcgtacaacggcgtaacgttggttaggttcgacgtacctactcgttgttcc

SEQ ID NO: 252845 - DNA, 508 bp, Homo sapiens
  misc_feature: GYAE6OF01BWJJ6.43.60.F05.1.454.CMB.1.raw
  modified_base (381)..(381): a, c, t, g, unknown or other
  misc_feature (381)..(381): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (484)..(508): a, c, t, g, unknown or other
  misc_feature (484)..(508): n is a, c, g, or t
tcagtgtgagtagtcacgaccggtgctcgatttagtacgtcatcagggaaaggggcctaggagtcgggtggccgaataataacggaaagatggagaaaagatacactacatggactctgtgggagggccgattctaccatctccagagacaaacgccaagacgttcgcctgtttctccaaatgagtagtctgagagtcgaggacacggctgtgtagttattgtgcgagagactcgagcccctcccaaagtgggatctactatgatgcatttgatatttggggccaggggacagtggtcacagtctcttcgagcctccaccaagggcccatccggtccttcccccgtggcgcccctgcctccgaggagccacccgtccgagngcgacagccggccctgggacctcgcctgggtcaacgggacctaccgtaccactaccctcaactactggacgcgggcgtagggccaaggccgacatagnangcnnnnnnnnnnnnnnnnnnnnnnnnn

SEQ ID NO: 252846 - DNA, 539 bp, Homo sapiens
  misc_feature: GYAE6OF01AL2L8.43.60.F05.1.454.CMB.1.raw
  modified_base (310)..(310): a, c, t, g, unknown or other
  misc_feature (310)..(310): n is a, c, g, or t
  modified_base (391)..(391): a, c, t, g, unknown or other
  misc_feature (391)..(391): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaaagtcaccatcacttgccggcaagtcaggacattagaaatgaattagcctggtttcagcagaaaccagggaaacgcccctaagctcctgatctatgctgcatccactttanaaatgagtccatcaagacttcagcgcagtgatcgtggcacagtctttcactctcacctcagcagcctgcagtctagaagtntttcgactaactttatactgttactactagtactttccttacttacccgtcggtaccgttcgaccgtagggtaacccgtacggtacggtagtcgtacggaagtccggtaactgggtacggtcgtacgtacctaacccgtgttcgtcgg

SEQ ID NO: 252847 - DNA, 520 bp, Homo sapiens
  misc_feature: GYAE6OF01EVPWW.43.60.F05.1.454.CMB.1.raw
  modified_base (513)..(513): a, c, t, g, unknown or other
  misc_feature (513)..(513): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctagaagtattttgctaactttattactgtactaataagtactttcttaccttaccctcggtaccgttcggtccgaggggtaccgacggtggtacgtcgtacaaggcgaacgtgtcggtctgcaccgtntcgttcg

SEQ ID NO: 252848 - DNA, 466 bp, Homo sapiens
  misc_feature: GYAE6OF01EIZBZ.43.60.F05.1.454.CMB.1.raw
  modified_base (448)..(448): a, c, t, g, unknown or other
  misc_feature (448)..(448): n is a, c, g, or t
  modified_base (454)..(466): a, c, t, g, unknown or other
  misc_feature (454)..(466): n is a, c, g, or t
tcagtgtgagtagtcacgaccggtgctcgatttagtacgtcatcagggaaaggggctggagtgggtggccaatataaggaaagatggagaaaagatacactacatggactctgtggagggccgattcaccatctccagagacaacgccaagagttcgctgtttctccaaatgagtagtctgagagtcgaggacacggctgtgtattattgtgcgagagactcgagccccctcccaaagtgggatctactatgatgcatttgattatttggggccaggggacagtggtcacagtctcttcagcctccaccaacgggcccatcggtccttccccctggccgccctgcctccaggacgccaccctccgagacgccacacggccggccctggggctcggcctggtcaaggacctacttccactacctcacactgacgcgggctggcaaggcncatagnnnnnnnnnnnnn

SEQ ID NO: 252849 - DNA, 571 bp, Homo sapiens
  misc_feature: GYAE6OF01DPJ8R.43.60.F05.1.454.CMB.1.raw
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (528)..(528): a, c, t, g, unknown or other
  misc_feature (528)..(528): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggttcagcaagaaccgaggaaacncccctaagctcngatctatgctgcatacctaatttaacaaaagtcggaacgtacccaattacaaagtacttacgaaggcggactaaggtggaatcgtggcacgagtcctttcactctcaccgtnacgcagtccctgcagttctagtaagttntttcgacttaagtttattactgtacttaacaagttctttaccttaccttacccgtcggtacgttccggaccgtacggggaccgtagggtacggtacgtcggtanaacggacgtacgttaggcggtctacgaccactagttcgttccg

SEQ ID NO: 252850 - DNA, 526 bp, Homo sapiens
  misc_feature: GYAE6OF01AVB16.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtccatcaagattcagcggcagtggatctggcacagtctttcactctcaccgtcagcagcctgcagtctagaagtattttgactaactttattactgtactaactaagtatttccttaccttaccctcggtacgttccggaccgtacggggacctacgggtggacgtggtacgaacggtcgaacgtgtggttcgcacctatcgtgttcc

SEQ ID NO: 252851 - DNA, 508 bp, Homo sapiens
  misc_feature: GYAE6OF01EJQ48.43.60.F05.1.454.CMB.1.raw
  modified_base (272)..(272): a, c, t, g, unknown or other
  misc_feature (272)..(272): n is a, c, g, or t
  modified_base (424)..(424): a, c, t, g, unknown or other
  misc_feature (424)..(424): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggttcagcaagaaaccagggaaancccctaagctcctgatctatgctgcatccaacttttacaaaatggagtcccaatcaagattcgagcggcaggtggatcgtggcacagctttcactctcaccgtcagcagcctgcagtctagaatattttgactaacttattactgtactaanaagtacttcttcttacccgtcgacgttcgccgagggaccacggtggagtgtacgagtcgaactgtggttcnctacntctgttcc

SEQ ID NO: 252852 - DNA, 614 bp, Homo sapiens
  misc_feature: GYAE6OF01C4L1X.43.60.F05.1.454.CMB.1.raw
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
  modified_base (373)..(373): a, c, t, g, unknown or other
  misc_feature (373)..(373): n is a, c, g, or t
tcagtgtgagtagtcacgaccggtgctcgatttagtacgtcatcagggaaagggggagtcagacccactcaggacacagcatggacatggagggtccccgctcagctccgtggggctcctgctgctctggctcccaggtgccagatgtgccatccagatgacccagtctccgtcctccctgtctgtatctgtaggagacaaagtcaccatcacttggccggnaagtcaggacattaagaatgaattagcctggttcagcagaaaccaggaacgccctaagctccngactctagtgctgacacttcctaactttaacaaaagtgggacctaccaatacaagtacttcaaggcggactaggtggtatcgtgcacngtctttacactctacaccgtcacgctacgccctagacgtaactcgtagtaacgttattttacgactttaacttttagttaccttagttacctaactaagttctttaccttcccgttacccgtcgggtacccgtttcgggacccgtacggggtaccgtacgggtcggtaacgttcgggtaagaacggtaccggtaaacgttcgggtcggtacctacggtaccacccgttagttcgtttaccg

SEQ ID NO: 252853 - DNA, 531 bp, Homo sapiens
  misc_feature: GYAE6OF01BNRVK.43.60.F05.1.454.CMB.1.raw
  modified_base (524)..(524): a, c, t, g, unknown or other
  misc_feature (524)..(524): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtccatcaagatcagcggcagtggatcgtggcacagtctttcactctcaccgtcagcagcctgcagtctagtaagtacttttgactaactttatttactgtctaactaagtactttcttccttaccctcgggtacgttccggaccgtacggggacctacgggtggacgttcgtacgaaggcgaacgttggtacggtctcgaccactntcgttcg

SEQ ID NO: 252854 - DNA, 540 bp, Homo sapiens
  misc_feature: GYAE6OF01EUBN1.43.60.F05.1.454.CMB.1.raw
  modified_base (414)..(414): a, c, t, g, unknown or other
  misc_feature (414)..(414): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcacatcacttgccggcaagtcaggacattagaaatgaattagcctggtttcagcagaaaccagggaaacgcccctaagcctcctgatctatgctgcactccaactttaacaaaagttcggaacgtccccaatacaagtattcgagcggacaggtggatcgtggcacagtctttcactctcaccgtcacgcagtctgactagtctagtaagtnttttacgacttaactttattacctgtactaactaagttactttccttacttacccgtggtaccgtcggaccggacgggtaccgtgggtgtagtcgtacaaggctagtgtcggtcncactntctgtc

SEQ ID NO: 252855 - DNA, 608 bp, Homo sapiens
  misc_feature: GYAE6OF01B3T37.43.60.F05.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (274)..(274): a, c, t, g, unknown or other
  misc_feature (274)..(274): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctgtagganacaaagtcaccatcacttgccggnaagtcaggacattagaaatgaattagctggttcagcaagaaaccgagggaaacncccctaagctcctgatctatgctgctactcctaactttaacaaatggactaccatacaagtacttcaggcggacaggtggatcgtggcaacgacgtctttacacttctccacccgtcacgcacgcctgcagttctagtaagttatttacgaccttaatttacttactacgttactaactaagttactttcctttaccgttaccccgttcggttacgttccgggaccggtaaccggggtaccgtaccgggttaggtacgttcgggtaccaacggtaccgtaacgttgggttacggttaccgaccttaacccgtacgtttccgttcggtttacccg

SEQ ID NO: 252856 - DNA, 590 bp, Homo sapiens
  misc_feature: GYAE6OF01A53QV.43.60.F05.1.454.CMB.1.raw
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
  modified_base (345)..(345): a, c, t, g, unknown or other
  misc_feature (345)..(345): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggnaagtcaggacattagaaatgaattagcctggtttcagcagaaaccaggaagcccctaagctccngatctatgctgcatccattacaaatggactccatacaagattcgagcggacaggtgatcgnggcacgtagtcctttcaccgttctaccgaccgttacacgccacgtcctagctagtcctagtaagttatttagacttaactttattactcgtactaactaacgttactttcctttacctttaacccgttcgggtaaccgtttccgggacccgtaacgggggtaccctacgggtacggtacgttcggtacgtaaacggtccggtaaacgttggttacggccttacggacccaccgtagttcgttacg

SEQ ID NO: 252857 - DNA, 588 bp, Homo sapiens
  misc_feature: GYAE6OF01D4HEY.43.60.F05.1.454.CMB.1.raw
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
  modified_base (576)..(576): a, c, t, g, unknown or other
  misc_feature (576)..(576): n is a, c, g, or t
  modified_base (581)..(581): a, c, t, g, unknown or other
  misc_feature (581)..(581): n is a, c, g, or t
tcagtgtgagtagtcacgaccggtgctcgatttagtacgtcatcagggaaagggggagtcagacccactcaggacacagtatggacatgagggtccccgctcagctcctggggctcctgctgctctggctcccaggtgccagatgtgccatccagatgacccagtctccgtcctccctgtctgtatctgtagganacaaagtcaccatcacgttgccgggcaagtcaggacattagaatgaattagccttgttcagtacaagaaaccgaagggaaacnccccgtaaagcctcctgacttctatgctgctactacctaactttaacaaagtcggactacccatactaagtacttcgaggtcggacgtaggtgactcgtaggacctacgtacgttctttaccacttcctccgaccgtcacgctacgcctgctagtctagacttatttcgacttaacgtttatctagttacaagtacttctttacctccgtttaccctaccgggtacgtccggaccgtaacgggtaccctagggtcggtattcggtacagtaccgtagcggtacgcgtcgactaacctnttcgngttaccc

SEQ ID NO: 252858 - DNA, 702 bp, Homo sapiens
  misc_feature: GYAE6OF01CL1R4.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctccaggtgccagatgtgccatccagatcgacccagtcctccgtcctccctgtctgtatctgtaggagacaaagtcaccatcacttgccggcaagtcaggactattaagaaatgaattagcctggttcagcaagaaaccgagggaacacctaagctacctagactctatcgactgactaacttacctaactttaaacaaaagtcggtaacttacccaagtactaaagtacttacgaacggtcggtacgtaggtacgggacttcgtagggacctaacgtacggtttaccttttaccaaccttcctacccgtaaccgttcaacgtccaacggtccctagactacgttcgtaacgtaaggtttacttttacgaactttaacgttttattaaccgttagttaaccgttaactaaacggtttcctttttaacccgtttacccgtttaaccccggttacggttacccggtttacccgggaccgggttaaccggggtaacccgtacggggttagtacgttcggtaaccgaacggtcgtaaaccggttggtacggtacttacgaccgtacctgtttcttccg

SEQ ID NO: 252859 - DNA, 543 bp, Homo sapiens
  misc_feature: GYAE6OF01EHQ2H.43.60.F05.1.454.CMB.1.raw
  modified_base (219)..(219): a, c, t, g, unknown or other
  misc_feature (219)..(219): n is a, c, g, or t
  modified_base (272)..(272): a, c, t, g, unknown or other
  misc_feature (272)..(272): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggnaagtcaggacattagaaatgaattagcctggttcagcagaaaccagggaaacncccctaagctcctgatctatgctgcatccaactttacaaaatggatccatacaagatcagcgcagtgatcgtggcacagtctttcactctcaccgtcagcacgcctgcagtctagtaagtatttgacttaactttattactgtactaacaagttactttctttaccttaccccgtcggtaccgttccggaccggacggggtaccgacggtggtaacgtcgtacgaacggtaccgtaacgttggtacggtctacgaccacctgttcgttacg

SEQ ID NO: 252860 - DNA, 545 bp, Homo sapiens
  misc_feature: GYAE6OF01BKO5X.43.60.F05.1.454.CMB.1.raw
  modified_base (392)..(392): a, c, t, g, unknown or other
  misc_feature (392)..(392): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggtttcagcagaaaaccagggaaagcccctaaagctcctgatctatgctgcatccactttacaaaatggagtccatcaagattcagcgcagtggatctggcacagctttcactctcaccgtcagcagccctgcagtctgaagtnttttgctaactttattactgttactaacaagtatttccttactttaacccttcggtaaccgtttccggacccgtacggggtacctacgggtaggtatcggtacaaggaccgtaacgtggttacggttcgaccgaacctacttcgtgttacccg

SEQ ID NO: 252861 - DNA, 560 bp, Homo sapiens
  misc_feature: GYAE6OF01A12J0.43.60.F05.1.454.CMB.1.raw
  modified_base (354)..(354): a, c, t, g, unknown or other
  misc_feature (354)..(354): n is a, c, g, or t
  modified_base (399)..(399): a, c, t, g, unknown or other
  misc_feature (399)..(399): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccgagggaaacgcccctaagcctcctgatctatgctgcatccactttaacaaatggactccatcaagatcgagcgcagtgactcgtgcacncgctttcactctcaccgtcagcacgcctgctagtctagtaagttntttagacttaactttacttactacgttacctaactaattacttttccttaccgttacccgttacgggtaccgtttccgggaccgtacggggtaccgtacgggtaggtacgtcgtacgaaggtccgtaacgtgtacggtctacgacctacctgttccgttcg

SEQ ID NO: 252862 - DNA, 549 bp, Homo sapiens
  misc_feature: GYAE6OF01DOJ8E.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaatgaattagcctgttcagcagaaaccaggaaagcccctaagctcctgatctatgctgcatccactttaacaaaatggagtcccatcaagattcagcggcagtggatcgtggcacagtctttcactctcaccgtcagcagcctgctagtctagaagtattttgacttaactttattacttgttactaactaagtacttttcctttaccttaccccgttcgggtaccgttccggaccgtaacggggaccgacgggttggacgtgtacgaaggtcgtaacgttggttacggttcgacctaccattcgttgttaccc

SEQ ID NO: 252863 - DNA, 564 bp, Homo sapiens
  misc_feature: GYAE6OF01B38YY.43.60.F05.1.454.CMB.1.raw
  modified_base (194)..(194): a, c, t, g, unknown or other
  misc_feature (194)..(194): n is a, c, g, or t
  modified_base (336)..(336): a, c, t, g, unknown or other
  misc_feature (336)..(336): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctcctgtctgtatctgtagganacaaagtcaccatcacttgccgggcaagtcaggacattagaatgaattagcctggtttcagcaagaaaccaggaaacgccctaagctcctgatctatgctgcatccactttaacaaatggactccatacaagtatcgagcgnagtgatctggcacagtcttcactctcaccgtcacgcacgctcgctagtcgtagtaacgtattttacgactaactttattaccttgttactaaactaagttactttaccttacccttaccgttccggtacgttccggtaccggtaacgggaccgtacggtaggtacgtacggtacgaacgccgggtaaacttcggtacggccgttacgaccgtactacgttcgttaccg

SEQ ID NO: 252864 - DNA, 538 bp, Homo sapiens
  misc_feature: GYAE6OF01EJTBY.43.60.F05.1.454.CMB.1.raw
  modified_base (397)..(397): a, c, t, g, unknown or other
  misc_feature (397)..(397): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctgtctcccaggtgccagatgtgccatccagatgacccagtctccgtcctccctgtctgtatctgtaggagacaaagtcacatcacttgccggcaagtcaggacattagaaatgaattagcctggtttcagcagaaaccagggaaagcccctaagctcctgatctatgctgcatccaacttacaaaatggatcccatcaagattcagcgcagtggatcgtggcactagctttcacttctcaccgtcaagcagccctgaccagtctgaacgttntttcgactaacttatttactgtactaacaagttctttcttacctttacccgtcggtacgttccggaccgaacggggtacctacgggtggaacgttgtacaaggccgtaaacgttggtacggtctcgacacctagtcttacg

SEQ ID NO: 252865 - DNA, 583 bp, Homo sapiens
  misc_feature: GYAE6OF01CZPC6.43.60.F05.1.454.CMB.1.raw
  modified_base (194)..(194): a, c, t, g, unknown or other
  misc_feature (194)..(194): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtctccctgtctgtatctgtagganacaaagtcaccatcacttgccggcaagtcaggacattagaatgaattagcctggttcagcagaaaccaggaaacgcccctaagctcctgatctatgctgcactcctaactttaacaaaagtcggacgtccaatcgaagtatcgaagcggacaggtgatcgtggctacagttctttacacttcctaccaccgtcagcacgtcctgctagtctaggtaagttcttttacgacttaacctttatttaccgttacgttacctaaataacgttaaccttttccgttacccgtttaccccgtcggttaaccggttcggaccgtacggggtaccgacgggttggtacgtacgtacgagaccgtacgttggttacgttcgactactcgtcttgttcc

SEQ ID NO: 252866 - DNA, 584 bp, Homo sapiens
  misc_feature: GYAE6OF01E2OZ6.43.60.F05.1.454.CMB.1.raw
  modified_base (273)..(273): a, c, t, g, unknown or other
  misc_feature (273)..(273): n is a, c, g, or t
  modified_base (575)..(575): a, c, t, g, unknown or other
  misc_feature (575)..(575): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggttcagcagaaaccagggaaacncccctaagctcctgatctatgctgccacttacctaacttttaacgaaaatcggtaacgtcccaatactaacgtacttcgacggcggtcgaaggtcggagtcgtacggacactagtcctttcacctcctcaccgtcacgcacgccctgtctagtacgtagtaagtatttagacttaactttattactgtactactaagtcttaccgttaccgttacccgtcggtaccgttcggccgtacggggtaccgtacgggtaggtagtcgtacgaacggtacgtacgtcggtcgccgtacgactacctntcgtttccg

SEQ ID NO: 252867 - DNA, 552 bp, Homo sapiens
  misc_feature: GYAE6OF01AMCW6.43.60.F05.1.454.CMB.1.raw
  modified_base (354)..(354): a, c, t, g, unknown or other
  misc_feature (354)..(354): n is a, c, g, or t
  modified_base (431)..(431): a, c, t, g, unknown or other
  misc_feature (431)..(431): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaacgccctaagctcctgatctatgctgctatccactttacaaatggactcccatcaagtattcagcggcagtgatcgtggcacngtcttcactctcaccgtcagcagcctgctagtctagaattatttcgacttaacttattactgtactaactaacgttntttccttacttacccgtgtaccgggtttccgacccggtagggtaccgtacgggtacggtacgttcgtacggaacggtaccgtacgtacggttcggccttgaccctacctacgttgttaccg

SEQ ID NO: 252868 - DNA, 524 bp, Homo sapiens
  misc_feature: GYAE6OF01EHBZW.43.60.F05.1.454.CMB.1.raw
  modified_base (345)..(345): a, c, t, g, unknown or other
  misc_feature (345)..(345): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcaagaaaccagggaaacgcccctaagctcctgatctatgctgcatccactttacaaatggatccatcaagtatcagcgcagtgatcgnggcacagtctttcactctcacgtcagcagcctgcagtctagagtatttgactaacttattactgtactaactaagtactttcttccttacccgtcgacggttcggaccgagggtaccgacgggtgagtcgtacgaagtcggaacgtggttacggttcgactaccgtacttcgtcgttcc

SEQ ID NO: 252869 - DNA, 560 bp, Homo sapiens
  misc_feature: GYAE6OF01DM2L0.43.60.F05.1.454.CMB.1.raw
  modified_base (220)..(220): a, c, t, g, unknown or other
  misc_feature (220)..(220): n is a, c, g, or t
  modified_base (273)..(273): a, c, t, g, unknown or other
  misc_feature (273)..(273): n is a, c, g, or t
  modified_base (360)..(360): a, c, t, g, unknown or other
  misc_feature (360)..(360): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggnaagtcaggacattagaaatgaattagcctggttcagcaagaaaccagggaaancccctaagctcctgatctatgctgcatcctactttaacaaaatggacgtcccatacaagtattcgagcggcgagtggatcgtggcangtctttcactctcaccgtcagcacgcctgcctagtcctagtaagttattttcgacttaactttattacttagtctaactagttactttcctttccttacccgtcggtaccgttccggaccgtacggggacctacgggtggagtcggtacgaacggtcgaaacgttggttacggttcgacctacctacttcgttcgttacc

SEQ ID NO: 252870 - DNA, 594 bp, Homo sapiens
  misc_feature: GYAE6OF01BIQL7.43.60.F05.1.454.CMB.1.raw
  modified_base (220)..(220): a, c, t, g, unknown or other
  misc_feature (220)..(220): n is a, c, g, or t
tcagtgtgagtagtcacgaccggtgctcgatttagtacgtcatcagggaaagggggagtcagacccactcaggacacagcatggacatgagggtccccgctcagctccgtggggctcctgctgctctggctcccaggtgccagatgtgccatccagatgacccagtctccgtcctccctgtctgtatctgtaggagacaaagtcaccatcacttgccggnaagtcagacattagaaatgaattagcctggtttcagcaagaaaccgaggaaacgcccctaagctcctgatctatgctgcatccatttacaaatgactccatacaagattcagcggcagtgatcgtggacacgagtcctttacgacttctaccaccgttacacgccaagtccctagactagtctagtaaagttacttttagaacttaactttacttacgtcttacgtaactaacgttactttccgttacctttacccgtacgggtaccgttaccggaaccggtacggggtaacccgttgggacggttacgtcggttacgaacggtcgaaaccgtttggtacggtttacgaccgtaacctcgttcgttcgttaccg

SEQ ID NO: 252871 - DNA, 657 bp, Homo sapiens
  misc_feature: GYAE6OF01E02L2.43.60.F05.1.454.CMB.1.raw
  modified_base (271)..(271): a, c, t, g, unknown or other
  misc_feature (271)..(271): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcagacattagaaatgaattagcctggttcagcagaaaccagggaaacncccctaagctacctgactctatgctgcactcctaactttaacaaaagtggacgtccatacaagtatcgagcgacagtggatcgtggacacgtacgtctttacacttcctacacccgtcgacgcgtacgcccttcgacgtagttaccgtagtaacgtttacgtttttacgaaccttaacgttttaactttaaccgttacgttaacctaacgtaaacgtttaccttttacccgttttacccgtttaacccggttcgggtaccggtttaccgggacccggtaacgggggacccgttacggggtaggtacgttacggtacgtaacggtaccggttaaacgttcggtttacggggttaccgtactaacccgtcgtttccgttcgtttaccc

SEQ ID NO: 252872 - DNA, 813 bp, Homo sapiens
  misc_feature: GYAE6OF01AEYH8.43.60.F05.1.454.CMB.1.raw
  modified_base (189)..(189): a, c, t, g, unknown or other
  misc_feature (189)..(189): n is a, c, g, or t
  modified_base (753)..(753): a, c, t, g, unknown or other
  misc_feature (753)..(753): n is a, c, g, or t
tcagtgtgagtagtcacgaccggtgctcgatttagtacgtcatcagggaaggggagtcagacccactcaggacacagcatggacatgaggtcccgctcagctcctgggctcctgctgctctggctcccaggtgccagatgtgccatccagatgacccagtctccgtcctcctgtctgtatctgtagganacaagtcaccatcacttgccggcaagtcaggactattaggaaatgtaattagcgtgtttcagcaagaaccgtagggaaaccgccccgtaagcctacctgtatactactagccttgactactacctaacctttacaaaagtcgggtacgtacccctataccgtaaagtactttccaacgggaccggtccgaaggtttcggaacgttccgttacggggacctaacggtaccggtttaccttttaccctacgttaccccgttccgttaacccggtaccgtaacggtccgtaaaccggtcccccgttacgtaaccggtaacgtttccggttaacggttaaaccgttaccgttttttacgtaaacccgtttaacgttttaaccttttaacgttaccggtttaactaaacccggtttaacgttaccttttaaccccgggttttacccttttaaccccgggtaccggtaccggttttacccgggtaacccggtaaccgggggtaaccctaccgggggtccgttaaaccggtttgggtaaaccccggttacggtaccgtttaaaacccgggnggttttacgggttaccggacccgttaacccgttacggtttcccgtttaccgggtttaccc

SEQ ID NO: 252873 - DNA, 734 bp, Homo sapiens
  misc_feature: GYAE6OF01BX963.43.60.F05.1.454.CMB.1.raw
  modified_base (269)..(269): a, c, t, g, unknown or other
  misc_feature (269)..(269): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctgtaggagacaagtcacatcacttgccggcaagtcaggacattaagaatgaattagcctgttcagcaagaaaccaggaacnccctaagctctgatctatgctgacactacctaactttaacaaaagtcggaacgtacccaatacgaaagtacttacgacggacggtactaggtcggtaactcgtacgggacctaacgtacggttacctttaccgaaccttaccgttacccgtaacccggttacgaacggtacccgaacggtccccgttaggtacccgttacggttaccgttaaggttaaacggtttaacgtttttacggtaaccctttaaacttttaacgtttaccttacggtttaaccttaaacgttaaagttacctttttacccgtttacccgtttaaccccggttaccgggttaccgggttacccggaaccgggtaaccggggtacccgtacggggttaacgtacggttacggtaaccgaacggtaccgtaacgttcggtttagggttaccaccgttaaccctacgttccgttcgtttacccg

SEQ ID NO: 252874 - DNA, 542 bp, Homo sapiens
  misc_feature: GYAE6OF01DXOWI.43.60.F05.1.454.CMB.1.raw
  modified_base (495)..(495): a, c, t, g, unknown or other
  misc_feature (495)..(495): n is a, c, g, or t
  modified_base (507)..(507): a, c, t, g, unknown or other
  misc_feature (507)..(507): n is a, c, g, or t
  modified_base (531)..(531): a, c, t, g, unknown or other
  misc_feature (531)..(531): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttggccgggcaagtcaggacattaagaatgaattagcctggtttcagcaagaaaccaggaaacgacccctaagctcctgtatctatgctgcactccaactttaacaaaatggactacccatacgaagtattcgagcggctagtgatcgtggacacagtctttacaccttctaccaccgtcacgcacgtctgactagtcagtagttatttacgacttaactttattactgttactaactagtactttccttccttaccgttcgtaccgtcggaccgacgggaccncggtgtgtcgtnaagcgtaactggtagtcgacactntcgttcgtacc

SEQ ID NO: 252875 - DNA, 586 bp, Homo sapiens
  misc_feature: GYAE6OF01ALE7N.43.60.F05.1.454.CMB.1.raw
  modified_base (219)..(219): a, c, t, g, unknown or other
  misc_feature (219)..(219): n is a, c, g, or t
  modified_base (270)..(270): a, c, t, g, unknown or other
  misc_feature (270)..(270): n is a, c, g, or t
  modified_base (434)..(434): a, c, t, g, unknown or other
  misc_feature (434)..(434): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggnaagtcaggacattagaatgaattagcctggtttcagcagaaccagggaacnccctaagcctctgatctatgctgcatcctaactttacaaatcggactccatcaagacttcaggcggcagtggactcgtaggaccactacgtcctttacacttcctacacccgtcacgcacgcccgtagctacggtctaggtaagttacttttcgactaactttnttactcgttactactaagttactttaccttaccgttaccccgtcggtaccgttccggaccggtacggggaaccctacggggtacgacgttacgtacgaacggtacgtaaccgttggtcggtttacgacctaaccgtgttccgttcgttaccg

SEQ ID NO: 252876 - DNA, 544 bp, Homo sapiens
  misc_feature: GYAE6OF01E3QAU.43.60.F05.1.454.CMB.1.raw
  modified_base (394)..(394): a, c, t, g, unknown or other
  misc_feature (394)..(394): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccaggggaaagcccctaagctcctgatctatgctgcatccactttacaaatggagtccatcaagattcagcggcagtggatctggcacagtctttcactctcaccgtcagcagccctgcagtctagaagtntttgactaactttattactgtactaactaagtatttccttacctttaccccgtcggtaccgttccgggcccgtaacggggaccctagggtacggtagttcggtacgaacggcgtaaccgtggacggtctacggccaccctgttcgttccg

SEQ ID NO: 252877 - DNA, 555 bp, Homo sapiens
  misc_feature: GYAE6OF01BS4DG.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaacgcccctaagctcctgatctatgctgcatccactttacaaatggagtcccatacaagtattcagcgcagtggatctggacacgtagtctttacactctcaccgtcacgctacgcctagcagtctagtagtatttgactaacttattactgtctaacaagtacttcttaccttacccgtcggtaccgttccggccgtacggggtacctacgggtaggtacgtacggtacaacggccgtaaacgttcggtacggtaccttacggaccctactacgttcgttaccg

SEQ ID NO: 252878 - DNA, 624 bp, Homo sapiens
  misc_feature: GYAE6OF01BX05T.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcacatcacttgccggcaagtcaggacattaagaatgaattagcctggttcagcaagaaaccagggaaacgcccctaagcctacctgactctatgctgcatccacttaacaaagtgacgtccagtcaagtatcgagcgacagtgatcgtggacacagtcttaccacgttcctacgacccgtcacgtccgacgtccctgacctagttaccgtaggtaacgtttatttacgtaaccttaaacgtttaactttacgtacgttaactaacgtaacgttaccttttcctttacccgttaacccgttcgggttaaccgttcgggacccggtaacgggggtaccctacggggtaacgtacgttccggtaagaacggtaccgtaacgttgtaccggtacttacgacccgttaccctagttccgtttacccg

SEQ ID NO: 252879 - DNA, 518 bp, Homo sapiens
  misc_feature: GYAE6OF01AHGGR.43.60.F05.1.454.CMB.1.raw
  modified_base (219)..(219): a, c, t, g, unknown or other
  misc_feature (219)..(219): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
  modified_base (511)..(511): a, c, t, g, unknown or other
  misc_feature (511)..(511): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacctagtctccgtcctccctgtctgtatctgtaggagacaaagtcaccatcacttgccggnaagtcaggacattagaaatgaattagcctggtttcagcagaaaccagggaaagcccctaagctcctgatctatgctgcatccactttacaaatggacgtccatcaagattcagcggcagtggatcgtggcacagctttcactctcaccgtcagcagcctgcngtctagtaagtntttgctaacttattactgtactacaagtactttcttccttaccgtcggtacgttccggccgacgggcctacgggtggacgtcgtacgaagtccggtaactggtcggactgacctaccntcgtacg

SEQ ID NO: 252880 - DNA, 537 bp, Homo sapiens
  misc_feature: GYAE6OF01DGJU4.43.60.F05.1.454.CMB.1.raw
  modified_base (495)..(495): a, c, t, g, unknown or other
  misc_feature (495)..(495): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggtttcagcaagaaaccagggaaacgcccctaaagctcctgatctatgctgcatcactttaacaaaatggatccatacaagattcagcggcagtggatcgtggcacagtctttcaacttctcaccgtcaagcagccctgcagtctagaagtattttgactaacgtttaattacttgtactaactaagtactttctttccttaccctcggtacgttccggccgacgggaccgaccggtggagtcgtanaacggcgtaacgtgttggttgacgtaccaacttcgtgttacc

SEQ ID NO: 252881 - DNA, 578 bp, Homo sapiens
  misc_feature: GYAE6OF01D9S77.43.60.F05.1.454.CMB.1.raw
  modified_base (282)..(282): a, c, t, g, unknown or other
  misc_feature (282)..(282): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtccctccctgtctgtatctgtaggagacaaagtcaccatcacttcgccgggcaagtcaggacattaagaaatgaattagcctggtttcagacaagaaaccgaggggaaacnccccgtaagcctacctgatctatgctgcactcctaactttaacaaagtggactcccgaatacaagtactcaggcgcaggtggactctcggcacagtctttacactctaccacctcagtcagtctgacagtctagtaattnttgactaacttnttactntactaatagtactttccttaccgttacccgttcggtaccgtcgggacccgtaacggggaccgtacggtaggtacgtcgtaaccgacggttaccgaacgtttggtacggtttcactaacccgtgttcccgttcggttcc

SEQ ID NO: 252882 - DNA, 623 bp, Homo sapiens
  misc_feature: GYAE6OF01CQ5TP.43.60.F05.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (454)..(454): a, c, t, g, unknown or other
  misc_feature (454)..(454): n is a, c, g, or t
  modified_base (611)..(611): a, c, t, g, unknown or other
  misc_feature (611)..(611): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatcgacccagtctccgtcctccctgtctgtatctgtagganacaagtcaccatcacgttcgccgganaagtcaggactataagaatgaatagcctggttcagacaagaaccgaggaacgaccaagctacctgatctatgctgactactacctaacttaacaaagtcggactccaatacaactatcgagacgacgtaggtagtactcgacgaccacgtacgttcttaccacttcctaccgtaaccgtcaacgccacgtcctcggactacgtctaagtaagttcgtttacacttaactttnttactacgttactaagtaacgtttacctttaccttcccgttaacggttcccggttacggttcccgggaccggtaaccgggtaaccggtcgggttacggacgttacggacgaaacggttaccggaacgttcggtacggtcgttacgccttaaaccgtntttcgttacccg

SEQ ID NO: 252883 - DNA, 647 bp, Homo sapiens
  misc_feature: GYAE6OF01BHDEP.43.60.F05.1.454.CMB.1.raw
tcagtgtgagtagtcacgaccggtgctcgatttagtacgtcatcagggaaagggggagtcagacccactcaggacacagcatggacatggagggtccccgctcagctccgtggggctcctgctgctctggctcccaggtgccagatgtgccatccagatgacccagtctccgtcctccctgtctgtatctgtaggagaacaagtcaccatcacgttggccgggcaagtcaggacattagaatgaattagtcttggttcagacgaacgaaacgaggaaaccgtcccctaagtctccgtagactactagtcgctcgactactaccttaactttaacaaagttcgactaccatacaagtactgacgtcggtacaggtcggactcgtacggacctacgtacgttctttacctaccttccgtaccgtaacccgtcacggtacctacgtccctcggtactacgtcgtaagtaacgtttattacggtaaccttaagttttattaccttagtacctaacgtaacgttcttttaccctttacccgttacccggtccgggttacgtaccgggacggtaaccggggacgttacgggtacgtgtacggtacgaggtcgtaacggtggttacgggtcaccgtacctcgttgtccgttacc

SEQ ID NO: 252884 - DNA, 808 bp, Homo sapiens
  misc_feature: GYAE6OF01DA51D.43.60.F05.1.454.CMB.1.raw
  modified_base (222)..(222): a, c, t, g, unknown or other
  misc_feature (222)..(222): n is a, c, g, or t
tcagtgtgagtagtcacgaccggtgctcgatttagtacgtcatcaggggaaagggggagtcagacccactcaggacacagcatggacatgacgggtccccgctcagctccgtggggctcctgctgctctggctcccaggtgccagatgtgccatccagatgacccagttcctccgtcctccctgtctgtatctggaggagacaaagtcacatcactgcgganaagtcagacatagaaatgaatagcctggttcagacaagaaaccgaggaacgacccctaagctccgtagactctagtggctgactatacctaacgtttaacaaaagttcggaactacccaatacaagtacttacgaggtacggataggtaggtatcgtacgacgactacggtctttaaccacttccgttaccgaacccgttcgaacggtacctaacggtcccgttacggaaccgtaaggtttcgtaacgtaaaggtttactttttaacggaaacctttaaacgttttaccttttaaccgtaacggttttaacccgtaaaacttaaaccgtttaacgtttttaccccgttttaacccgtttaacccccggtttaacgggttaacccccgggttttacggggaaccccggggttaaaacccgggttacccggggggtaaacccgggtttaacgggtaaacgggtttttaccggtaaaacccgggtaaacggttaaaccggtttaaacccgggtttaaggggttaacccgggtttaccggaaccggggtttaacccttaaacccccttaaggtttacccgttttacccgg

SEQ ID NO: 252885 - DNA, 567 bp, Homo sapiens
  misc_feature: GYAE6OF01BMLZT.43.60.F05.1.454.CMB.1.raw
  modified_base (196)..(196): a, c, t, g, unknown or other
  misc_feature (196)..(196): n is a, c, g, or t
  modified_base (559)..(559): a, c, t, g, unknown or other
  misc_feature (559)..(559): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctgtagganacaagtcaccatcacttgccggcaagtcaggacattaagaatgaattagctggtttcagcaagaaaccgaggaaacgcccctaagctcctgatctatgctgcatcctaacttaacaaatggactccatacaagtacttcgagcggactagtcggatcgtcgacactacgtctttcacttctcaccgtcacgcacgtcctagcgtacgttcagtaagttactttacgacttaacgtttactttacctagttactaactaagttactttccttaccttacccgtcggtaccgttccggaccgacgggtaccgtagggtagtacgtgtaccgtaaggccgttacgtgcggtactacgactaccgtntccgttcg

SEQ ID NO: 252886 - DNA, 642 bp, Homo sapiens
  misc_feature: GYAE6OF01D3GT0.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtggccatccagatgacccagtcctccgtcctccctgtctgtatctgtaggagacaagtcaccatcacgttgccggacaagtcaggacattagaatgaattagccttggttcagacaagaaaccgagggaacacccctaagcctacctgatctatgactgacatacctaactttaacaaaatggaactccaatacaagtacttacgagtcgggactaggtcgtactcgtacggacctacacgtcctttacaccttcgtccgacgtcacgcacgccctggactacgtcgtagtaacttagtttacgtacttaacctttactttactacggttaacttaacgtaacgttactttacccgtttaccccgtttaccgttacccgggtaccgttaccgggacccggtacggggtacccggtacgggtacggtacggtacggtacgaacggtccgggtaacgttggttacgggtacgtaccctacttacgtctttcggttaccc

SEQ ID NO: 252887 - DNA, 720 bp, Homo sapiens
  misc_feature: GYAE6OF01B97C0.43.60.F05.1.454.CMB.1.raw
  modified_base (200)..(200): a, c, t, g, unknown or other
  misc_feature (200)..(200): n is a, c, g, or t
  modified_base (464)..(464): a, c, t, g, unknown or other
  misc_feature (464)..(464): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggcctcccgaggtgccagatgtcgccatccagatcgacccagtcctccgtcctccctgtctgtatctgtagganacaagtccacatctacgtcggaccggacaagtcgaaggactattaagaatagtaattacgccgttggttaccaagacgaaacggaaaaccgaaggggaaacccgtacccccgttaagccttaccgtagtaacttctagtcgcctagcctacttacctaactttaaagaaagtccggacctaccaatacgtaactctacgaggccggagtaggtcgtatccgacggactacgtcttaccttccgaccttccgtaccgtaccgacnccgactccgccctgacctagtataacggttattacgtttacaacctttaattaacgttacgtattaacctaacgtttaactttccctttaaccgtttacccccggttaaccggtcccgggtttaacccgggtaccggtaacccggggcgggttaaacccggacgggtttaaccggtacggttaacgtacccgggtaaggccccgttagggttcgacccggttcgaaacctccggtaaacttcgttacggtttcccg

SEQ ID NO: 252888 - DNA, 591 bp, Homo sapiens
  misc_feature: GYAE6OF01CREND.43.60.F05.1.454.CMB.1.raw
  modified_base (146)..(146): a, c, t, g, unknown or other
  misc_feature (146)..(146): n is a, c, g, or t
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (385)..(385): a, c, t, g, unknown or other
  misc_feature (385)..(385): n is a, c, g, or t
  modified_base (421)..(421): a, c, t, g, unknown or other
  misc_feature (421)..(421): n is a, c, g, or t
  modified_base (450)..(450): a, c, t, g, unknown or other
  misc_feature (450)..(450): n is a, c, g, or t
  modified_base (482)..(482): a, c, t, g, unknown or other
  misc_feature (482)..(482): n is a, c, g, or t
  modified_base (554)..(554): a, c, t, g, unknown or other
  misc_feature (554)..(554): n is a, c, g, or t
  modified_base (566)..(566): a, c, t, g, unknown or other
  misc_feature (566)..(566): n is a, c, g, or t
  modified_base (574)..(574): a, c, t, g, unknown or other
  misc_feature (574)..(574): n is a, c, g, or t
tcagtgtgagtagtcacgaccggtgctcgatttagtacgtcatcaggggaaagggggagtcagacccactcaggacacagcatggacatgacgggtccccgctcagctcctggggctcctgctgctctggctcccgaggtgccagntgtcgccatccagactgacccagtcctccgtcctccctgtctgtatctgtagganacaagtcacatcacttcggaccggnaacgtcaggactaattaagaatgtaattagccttaggttcgagaccaacggaaaccgacgggaaacgtcccctaaaggctcctagtactacgtagtcgcgtgaccacttaccaacgttttaaacaaagtggactaccatacaagtctacgagacggacngttagacttcgaggcacgtacgtcctttacacttcnccgtactacgactcgacgtctgatacgtntaacgtaattcttagtacctaatttacttacngttaactacacttcgtttaccttaccgttacgtcgtaacgttccggaccggaggtaccgaggtagtgcgtanacggtcgacgtnacggtacnctacacccatcgttacc

SEQ ID NO: 252889 - DNA, 666 bp, Homo sapiens
  misc_feature: GYAE6OF01B4S0D.43.60.F05.1.454.CMB.1.raw
  modified_base (276)..(276): a, c, t, g, unknown or other
  misc_feature (276)..(276): n is a, c, g, or t
  modified_base (285)..(285): a, c, t, g, unknown or other
  misc_feature (285)..(285): n is a, c, g, or t
tcagtgtgagtagtcacgaccggtgctcgatttagtacgtcatcagggaaagggggagtcagacccgactcaggacacagcatggacatgagggtccccgctcagctcctgggctcctgctgctctggctcccaggtgccagatgtgccatccagatgacccagtcctccgtcctccctgtctgtatctgtaggagacaaagtcacctatcacgttgccgggacaagtcaggactagttagaatgaattagcctggttcagcaagaaccaggaacncctagctcngactctatgctgctactaccacttaacaaagtcggactccatacaagtcttacgagtcggcgtagtggtactcgtggacacgtgtcctttaccgacttccgtactaccgtacacgtaccgtacgtccccttaggaccgtacggttacgtacggttaaagttttacgttttacggtacctttaaacgttttactttaacgtacgttactaacggttaacgtttacgttttacccgtttaaccgtttaccccggttaccggttacccgggtttcccggtacccgggtaacgggggtacccgtacgggttacggtagttaccggtacgaacgggtccgtaacgttggttacggttcgaccgtaccgtcgttcgtcgtttacccg

SEQ ID NO: 252890 - DNA, 586 bp, Homo sapiens
  misc_feature: GYAE6OF01EHH09.43.60.F05.1.454.CMB.1.raw
  modified_base (274)..(274): a, c, t, g, unknown or other
  misc_feature (274)..(274): n is a, c, g, or t
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatcgacccagtcctccgtcctccctgtctgtatctgtaggagacaagtcaccatcacttgccggacaagtcaggacattagaatgaattagcctggttcagacaagaaccagggaaacnccctaagctcctgatctatgcngcatccatttacaaagtgactccatcaagntacagcgcagtgatcgngacacacgtctttcactctccgaccgtcagcacgtcctgctagtctagtaacgttatttcgacttaactttattacgtgtacctaagtaattacgtttcctttaccgttacccgtacgggtaccgttccgggacccgtaacggggacccgttacggggagtacgttcggtaaccgaacggtccggttaaacgtcgggtttacggttaccggaccctaacccgttcgttccgttcgtttacccg

SEQ ID NO: 252891 - DNA, 668 bp, Homo sapiens
  misc_feature: GYAE6OF01EHT9X.43.60.F05.1.454.CMB.1.raw
  modified_base (279)..(279): a, c, t, g, unknown or other
  misc_feature (279)..(279): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctgtaggagacaaagtcacatcactggccggcaagtcaggactattaagaaatgaattacgccttggttacagacaagaaaccgaggaaacnccctaagctacctgatctatgctagctacttacctaactttaaacaaagttcggacgtacccaatacgaaagtcttacgaggcggtataggtgacgtcgaggacacgtacgtactttaccgacttccaccgaaccgtcaacggtccacgtcctcggactacggttactaggtaacgtttattttacgaaccgttaaacttttactttactaggttaacctaaacgttaacgtttccctttaccgtttcccgttaaccccgttacgggtaacccggttaccgggtaccgggaaccgggtacccgtacgggggtacgtagttaccggtacgaaccgggtcgttaacggtgggttaccggttacaccaaccgtttgttccgttcgttacccg

SEQ ID NO: 252892 - DNA, 757 bp, Homo sapiens
  misc_feature: GYAE6OF01BCH0U.43.60.F05.1.454.CMB.1.raw
  modified_base (221)..(221): a, c, t, g, unknown or other
  misc_feature (221)..(221): n is a, c, g, or t
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
tcagtgtgagtagtcacgaccggtgctcgatttagtacgtcatcagggaaagggggagtcagacccactcaggacacagctatggacatgagggtccccgctcagctcctggggctcctgctgctctgtctcccaggtgccagatgtgccatccagactgacccagtcctccgtcctcctgtctgtatctgtaggatacaagtcaccatcacttgccgganaagtcaggacattagaatgaattgaccgtggttnagcaagaaaccagggaaacnccctaaagcctccgagtactcttagtacgtctacgcaactaacctaactttaaacaaaagttcgggtactacccgaattacgaaacgtaacttccgaacggtacccggtacgtaaggttggaacttccgtacgggtaacctaacgtacgtttaccgtttaacctaaccttccgttaaccgtaaccccgttacgaacgttccggtaaccgttacccgtaacggacccttaaaggtacccgttaaaggtaaacgttttaaccgttttacgaaaccctttaaaccggttttactttaaccgttaaccggttaactttaaacgttaaacgttccttttaacccgttttacccgttacccgttagggttacccggtttacccggacggttacgggggtaacccctggggttaaaccggtagttacggttaacgacgggtacaacgggtcgttacgcgttaccgacgtaccctgtttccgttacccgg

SEQ ID NO: 252893 - DNA, 671 bp, Homo sapiens
  misc_feature: GYAE6OF01AWCFN.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatcgacccagtcctccgtcctccctgtctgtatctgtagagacaagtcacatcacttggccggacaagtcgaggactataagaatagtaattacgccttaggttacacgacaacgaaaccgagggaaccacccctaagcctaccgtagtactactagtcgtacctgacctactaccctaaactttaacgaaagttcgggaacctacccgaataccgaagtacttacgacggcggacgtacggtggtactcgacggactacgtacgttccttaccacccttcgtacccacgtacgacgtaccgtacgtctagcgtacgtacgtacgtatttacgttacgtaaccttaacgtttacttacttacgtaacttaacgtaacgtttaccttccgtttacccgtaccggtacggttaccggttaccggaccggtacgggtacgtacggttcggtaacgtaccgtaggaacggtcgtaacggtcgttaccggacttacgacccgtacgttacttcccgttacg

SEQ ID NO: 252894 - DNA, 559 bp, Homo sapiens
  misc_feature: GYAE6OF01DNH7G.43.60.F05.1.454.CMB.1.raw
  modified_base (279)..(279): a, c, t, g, unknown or other
  misc_feature (279)..(279): n is a, c, g, or t
  modified_base (345)..(345): a, c, t, g, unknown or other
  misc_feature (345)..(345): n is a, c, g, or t
  modified_base (551)..(551): a, c, t, g, unknown or other
  misc_feature (551)..(551): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggactattaagaaatgaattagcctggtttcagacaagaaaccgaggggaaacncccctaagcctcctgatctatgctgcactacctaactttaacaaaagtggacgtcccatacaagtnttcagcgcagtggactcgtgcactacgtctttcacttcctaccaccgtcaacgcacgcctgactagtctagagttattttcgacttaactttattacctagtactaatagtactttccttaccgttacccgtcggtaccggttcgaccggagggtaccgacggtgtacgtagtacacggtacgaacgtggtcggtctacgctaccngtcttacg

SEQ ID NO: 252895 - DNA, 705 bp, Homo sapiens
  misc_feature: GYAE6OF01CM1NW.43.60.F05.1.454.CMB.1.raw
  modified_base (275)..(275): a, c, t, g, unknown or other
  misc_feature (275)..(275): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatcgacccagtctccgtcctccctgtctgtatctgtaggagacaagtcacatcacgttgccggacaagtcaggacattaagaatgaattagtccttgttcagacaagaaaccgaggaacncccctaagcctcctagtatctatcgctcgctacttacctaacttttaaacgaaagttcggaaccgttacccaatacgaaacgtacttaccgacggtaccggtacgtaaggttggtaacttcggtacgggaccctaacgttaccgtttccctttacctaccctttacccgtaacccgtaccccggtacaaccgccgtacgtcccgttacgaccgtaacgttccgtaaggtaacgtttacgttttacgaacctttaacttttaactaccgtttacgtaacttaaccgttaacgtttacccttttacccgttacccgttaccccggttacggttacccgggttaccggaaccggacggggttacccgtaggttcggagttcgaaggtaacgtcgtaacgtcggtacggtcctacacctactcgttcgttaccg

SEQ ID NO: 252896 - DNA, 831 bp, Homo sapiens
  misc_feature: GYAE6OF01ED4S6.43.60.F05.1.454.CMB.1.raw
tcagtgtgagtagtcacgaccggtgctcgatttagtacgtcatcagggaaagggggagtcagacccactcaggacacagcatggacatgacgggtccccgctcagctccgtggggcctcctgctgctcgtggcctccgaggtgccagatggtcgcctactccagtactcgaaccctggtcctccgtccctcctgtctgtatcgtagtaggaacgataacgtccactactcgtacgttcggaccggtactaacgtcgaacggtactaagttaaggaactcgtaacttcggtcgttcgttacgacgtaacgtaaacggaaaccggtaacgggtaaccctaccgtaacgtcccgtacgtacgtacgtcgttacgtacgccgtacggtacctaccgtttaaccgtaaccttttaaacggaaacgttccggtaaccgtaccctaagtaaccgttacgtaacgtcggaacgggtaccgttacgtaaggtcgtccgtacggtacgggacctaaccgttcgtaccgttactaccgttacctaccggtacgtaccgtacgaccgtacgtaccgtgtaaccgtacggttacgttaaccgttaggttaaccttacgtaacgtttaacctttaacgttacggtaaccttaaccgggttaactttaacgtttacccgttacccgttttaccgtaaccggttccgggttaaccggtaccggtacccggggtaacggtaaccggttcccggtaggttaaccgaccggttaaccgaagggttccccttaaagggttccgggttaacctaccgacggttaacccttacggttccggttcgttaccccg

SEQ ID NO: 252897 - DNA, 695 bp, Homo sapiens
  misc_feature: GYAE6OF01BRITA.43.60.F05.1.454.CMB.1.raw
  modified_base (228)..(228): a, c, t, g, unknown or other
  misc_feature (228)..(228): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggcctcccgaggtcgccagatgtcgccatccagatcgacccagtcctccgtcctccctgtctgtatcgtgtaggagacaagtcaccatcacttcggccgganaagtcaggactattaagaatgtaacttacgtccgttggtttacagaccgaacgaaaccgaacggggaaaccgtcccctaagccttaccgtagtactacgtatcgtcctagacctaactcctaacttaacgtaaaacgtcggtaacgtaccaagtacgaacgttacttacgaacggtccggtacgtacggtacggtactcgtacggactacgtacgttccttacctaccttcctaccgtaccgtacacgccgtacggtcccgtagaccgttagttaccgtaagtaacgtttacgtttacctacgttaacgtttacttacgttacgttaactaacgttaacttcgttttcccgttaccgtttacccggtacgtaccggttaccggaccggtaaccgggtaccggtaggtacggtacgtacgtacggtacggaccgtacggtgcgtacacgacttccctagtcccgttcg

SEQ ID NO: 252898 - DNA, 703 bp, Homo sapiens
  misc_feature: GYAE6OF01DD1DI.43.60.F05.1.454.CMB.1.raw
  modified_base (281)..(281): a, c, t, g, unknown or other
  misc_feature (281)..(281): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctcccgtcctccctgtctgtatctgtaggagacaagtcaccatcacttcgccgggcaagtcgaggacagttaagaaatgaattagccttggtttcagcaagaaaccagggaaacncccctaagcctcctagatctatgctgaccacttacctaacgttttaaacaaaacgtcgggtacttaccccaattaccaaagtactttacgacgggacggtacgtaggtaggaacttcgtacgggacctaacgtacgttaccttttaccgaacctttcccgtacccgtaaccccggttccgaacggtcctaccggtcccgtacggtaccgttacgttaccgttaggtaaagtttacgtttttacgacctttaaccttttacgtttaccttacgttacttaaacgttaacgttacctttttcccgtttacccgtttaccccggttaccgggtaccggtttccgggaccggtacgggtaccgtacgggtacggtagtacggtacgaacggtcgacgtgttcggtacacccactatccgtgttacc

SEQ ID NO: 252899 - DNA, 800 bp, Homo sapiens
  misc_feature: GYAE6OF01A8SOU.43.60.F05.1.454.CMB.1.raw
  modified_base (167)..(167): a, c, t, g, unknown or other
  misc_feature (167)..(167): n is a, c, g, or t
  modified_base (201)..(201): a, c, t, g, unknown or other
  misc_feature (201)..(201): n is a, c, g, or t
tcagtgtgagtagtcacgaccggtgctcgatttagtacgtcatcagggaaagggggagtcagacccactcaggacacagcatggacatgacgggtccccgctcagctccgtggggctcctgctgctctggcctcccaggtgccagatgtgccatccagatcgacccngtcctcccgtcctcctgtactgtatctgtagganaacaagtcacctatcgtacgttcggccggacaagtccgaaggactaagttaaagaaacttaggtaaattacggtccgttaggtttaccaaggtaaccgaaacggtaaaacccggtaaacggggaaacccgtacccccgtaaacggtcctacccgttagaactttaccgttaagtccgtccgtcgtaacctaaccgttaacccttaaacgtttaaaacgaaaacgtttcggtaaccgtaaccctaataaccgtaagttacgtacgacggtaccggagtaaggtcggtactacgtacggactacggtacttacttaccgacttcctacgtacccgtacaacgtccaaccggttcagtaccgtagtacgttagtaaccgtttatttacgaacctttacgttacgttaactacgttaactaacgttaacgtttccctttaaccgttttacccgaacccggttcgggtttaacccgtcccgggtaacggtaccgggtaaaccgggtccggttaaagggtaccgttacgtaaacccggtaacggtaccgttaacgggtacggttaccgtacggacccctagttaccggttcgtccgtttaacccg

SEQ ID NO: 252900 - DNA, 723 bp, Homo sapiens
  misc_feature: GYAE6OF01ACS9O.43.60.F05.1.454.CMB.1.raw
  modified_base (237)..(237): a, c, t, g, unknown or other
  misc_feature (237)..(237): n is a, c, g, or t
  modified_base (648)..(648): a, c, t, g, unknown or other
  misc_feature (648)..(648): n is a, c, g, or t
tcagtgtgagtagtcacgaccggtgctcgatttagtacgtcatcagggaaaggggagtcagacccactcaggacacagcatggactagtgacggtccccgctcagctccgtggggctccgtgctgctcgtggctcccaggtgcctagtctgtcgccactcgagactcgacctagtcctccgtcctcctgtctgtagtcgtggtaggacgtacgaacgtcgacatcacgttcgccganagtcaggtactagtaagaatagtaattcgtccgtggttccacgactaacggaaccgacgggaaccctccccgtaagtccttcgagacgttctacgtcgtctcgtactacttaaccttaactttaaccgaaagttccggtaaccgttcctaaagtacgtaacggttacgttaccgacggacggtacgtacgggttcgtacgttccggaccggaccttaaacgccgttttcctacgtacccttacgtacccgaacgcgaaaccgtccgaaccgtaccgtcgtaacgtaccgtagttaacgtactttacgttacactttaaacgttcctaacggtcttaacgaccgttaacgttccgtttaccgttacccgtaccgggttacgttaaccggtccgggtaacgtaacccggggtntaacgggacttacgtaacgtacggaaccgttggtacctcgggtacggtcttaccgaccgtcctacttgggttccc

SEQ ID NO: 252901 - DNA, 823 bp, Homo sapiens
  misc_feature: GYAE6OF01EIBJ2.43.60.F05.1.454.CMB.1.raw
  modified_base (203)..(203): a, c, t, g, unknown or other
  misc_feature (203)..(203): n is a, c, g, or t
tcagtgtgagtagtcacgaccggtgctcgatttagtacgtcatcagggaaagggggagtcagacccactcaggacacagcatggacatgagggtcccccgctcagctccgtgggctcctgctgctctggcctcccgaggtgccagatgtcgccatccagatcgaccctagtcctccgtcctccctgtctgtatcgtgtagganaacaaagtcacctatctaccgttggccggacaagtccgaaggtactaagttaaagaaatagaaactttacgccgttaggtttaccgacgaccgtaaacggaaaacccggaacggggtaaaacccgacccccgtaaacgccctaccgtagtacttactagtcgtaccgtcgacctaccgttaccctaaaacgtttaaactaaaacgttcggtaaccgtaccctaagtaaccgtaacgtacttaccggacggtacggtaacgtaggtacggtacgtacggtacgaacctaaccgtaccggttacctttacctaccttcccgtacccgtaaccgtccgaaacgccgtaaccgtccgtacgaccgtaagttaccgttaaggtaaacgtttcgtttaccgtaaactttaaccttttaacgttaccgttacgttaaccgttaaacgttaacgtttaacccgtttacccgtttacccgtttaacccccggttacgggtaccccggtttacccgggaccgggtaaaccgggaaccggttacgggtacggttaccgtaacggtaccgaacggtacgtaaccgggttggtaccggttaccaccgttacccgtacgttgttccgttaaccc

SEQ ID NO: 252902 - DNA, 893 bp, Homo sapiens
  misc_feature: GYAE6OF01BPX4W.43.60.F05.1.454.CMB.1.raw
tcagtgtgagtagtcacgaccggtgctcgatttagtacgtcatcagggaaagggggagtcagacccactcaggacacagcatggacatgagggtccccgctcagctccgtggggctcctgctgctctggctcccaggtcgccagatgtcgccatccagatcgacccagtcctccgtcctccctgtctgtatctgtaggagacaagtcacatcacttcgccggacaagtcaggactagttagaatgtaattacgtccgttaggtttacaacgtacgaacggaaaaccggaacggggtaaaaccgacccccgttaaaggtcccttaccgtaggtaactttccgttaacgtcggtaccttcggtaacctaacctttacccgtaaacttttaaaaccgaaaaggttccgggtaaccgttacccctaataccgtaaaacgtacgttaccgaacgggtcccgggtacgtaacggggtcggtacgtaccggtaggtacccgaacgttacgttcccttttaccaacccgttcccttaccgacccggttaccaacgggcctaaccgggttccctagggtaccctaacggttaccgtaaggtaaacgttttacgtttaaccgtaacctttaaacgtttacgtttaaccgttacggttaacctaaacttaaacggtttaccccttttaccgtttaaccccgtttaccccgggtttacggggttaacccgggtttacccgggaacccggggttacccggggaacccggtttaccgggggtaacggttccggttaaccgggttaaccggaaaccgggttaacccggttaaacgggtttcggggtttaccgttacccggtaaacccgttaacccggtttaacctttccgggttaaccggttttcccc

SEQ ID NO: 252903 - DNA, 582 bp, Homo sapiens
  misc_feature: GYAE6OF01AW9PH.43.60.F05.1.454.CMB.1.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (268)..(268): a, c, t, g, unknown or other
  misc_feature (268)..(268): n is a, c, g, or t
  modified_base (336)..(336): a, c, t, g, unknown or other
  misc_feature (336)..(336): n is a, c, g, or t
tcagtgtgagtagtcacgaccggtgctcgatttagtacgtcatcagggaagggggtagtcagacccactcaggaccacagcatggacactgacgggtccccgctcagctcctggggctcctgctgctctggctcccaggtgccagatgtgccatccagatgacccagtctccgtcctccctgtctgtatctgtagganacaaagtcaccatcattgccggnaagtcagacattagaatgaattagcctgttcagcagaaccaggaacncccctaagctctgatctatgctagcactcctaactttaacaaaagttcggactcccaatacctaagtnttaccaggcggacaggtcggactcgtaggacacgtagtcctttacgaccttctaccgaccgtcacgcacgcctagctagtctagtaacgttattttacgacttaaccgtttacgttactcgttaactactaagttactttccttaccgttaccgtcggtaccgtcggaccgtacgggccgtacgggtgtacgtcgtacgacggtacctacggttgacgtcctacggacctaccgtagttcgttccg

SEQ ID NO: 252904 - DNA, 710 bp, Homo sapiens
  misc_feature: GYAE6OF01AZOTX.43.60.F05.1.454.CMB.1.raw
  modified_base (195)..(195): a, c, t, g, unknown or other
  misc_feature (195)..(195): n is a, c, g, or t
  modified_base (464)..(464): a, c, t, g, unknown or other
  misc_feature (464)..(464): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtagganacaagtcacatcacttggccggacaagtcaggactataagaatgtaattacgccgttggtttacagactaagaaaccgaagggaaacctacccctaacgtcctacctagacttcctagtcgcgtgcctacttaccctaaactttaacgaaagtcgggtaacctaccccgaattaccgtaaagtacttccgacggtcggacgtaggtggtaactcggtacggaccgtaacgttcgttacctttaccctaccttccgtacccgtaccgtanaccgacgtaaccggtcctcggtacgtacggtactacgtaagtttcgtttacgaacctttaacttttagttaccgttacgttaactaactaacgtttccttttacccgttacccgtttacccggttcgggtaccggttaccggacccgggtaacgggtaccgttaacgggtacggtacgtaccggtaagacgggtaccttacgggttgttaccggtacgaccctaacgttcttcgttccgtttaccc

SEQ ID NO: 252905 - DNA, 743 bp, Homo sapiens
  misc_feature: GYAE6OF01CFIFM.43.60.F05.1.454.CMB.1.raw
tcagtgtgagtagtcacgaccggtgctcgatttagtacgtcatcagggaaagggggagtcagacccactcaggacacagcatggacatgagagtccccgctcagctcctggggctcctgctgctctggctcccaggtgccagatgtgccatccagatcgacccagtcctccgtcctcctgtctgtatcgtgtagagacaagcacatcacttgccggacaagtcgaggactaattagaaatgtaacttacgtccgttggtttacaacgaccgaaacggaaaacccggaaggggaaaaccgcccccgttaaacggccgttacccgtaggtacttcttaagtcgacgtgacctacctaccttaaacgttttaaacaaaagttcggaccgttacccaattacaagtattacgaggccggactaggtcggtatcgtcggaccacgtagtcctttcgtacctcctaccgtacccgtacgaacgtcccgagtcccgtagtacgtacggtttcgtaagttaacgttagttttaccgtaacctttaaacgttttaacttaccggttatttaacccgttaacgtaaacgtttccgtttttacctttaccccggtttacccgggttaccgggttaccccggtttaccgggtacccgggaacggggtacccgtaacgggttacggaacggttaccggtacggtaaacgtaccgtaaggttcgggttacggttcgaccgtctacgttcgtttaccg

SEQ ID NO: 252906 - DNA, 596 bp, Homo sapiens
  misc_feature: GYAE6OF01BEMV7.43.60.F05.1.454.CMB.1.raw
  modified_base (196)..(196): a, c, t, g, unknown or other
  misc_feature (196)..(196): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
  modified_base (411)..(411): a, c, t, g, unknown or other
  misc_feature (411)..(411): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctgtagganacaagtcaccatcactgccggacaagtcaggacattagaaatgaattagcctggtttcagcaagaaaccgaggggaaacgacccctaagcctcctgatctatgctgcatcctaactttacaaatcggactccatacaagtattcagcggntagtgatcgtgacacngtcttcacttctcaccgtcacgcacgtctcgactacgtctagtaagttntttacgaccgttaactttactttacgtagttaactaacgtaacgttactttccctttaccgtttacccgtccggttaccgttccgggacccggacggggtaaccgtacgggtacggtagtaccggtacgaacggtccggttaacgtggttacggtacgacctaactcgttacgtcgtttaacccg

SEQ ID NO: 252907 - DNA, 624 bp, Homo sapiens
  misc_feature: GYAE6OF01ER4IH.43.60.F05.1.454.CMB.1.raw
tcagtgtgagtagtcacgaccggtgctcgatttagtacgtcatcaggggaaagggggagtcagacccactcaggacacagcatggacatgagggtccccgctcagctccgtggggctcctgctgctctggctcccaggtgccagatgtgccatccagatcgacccagtcctcccgtcctccctgtctgtatctgtagagaacaaagtcaccatcacgttcgccgggcaagtccaggacattagaaatgaattagcctggtttcagacaagaaaccgagggaaacgacccctaagctccgtgatctatcgctagcactacctaactttaacaaagtcggactaccatacaagtatcgaggcgacaggtcggatcgtagacactacgtcctttcacctcctaccaccgtcacgtcacgtcctcgcgtacgtctaagtaacgttactttacgacctttaactttactttacctacttacctaacttaagttccttttaccctttaccgttacccgttcgggtaccggttccggtaccgggacgggtaccggtacgggtggtacgttacgtacggaaacggtccgtaacggtcgacgggtctccgtaccgtacctacgttccgttccg

SEQ ID NO: 252908 - DNA, 712 bp, Homo sapiens
  misc_feature: GYAE6OF01B1KFR.43.60.F05.1.454.CMB.1.raw
  modified_base (219)..(219): a, c, t, g, unknown or other
  misc_feature (219)..(219): n is a, c, g, or t
  modified_base (290)..(290): a, c, t, g, unknown or other
  misc_feature (290)..(290): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctcccgtcctccctgtctgtatctgtaggagacaagtcaccatcacttgccggnaagtcaggacattaagaatagaattagcctggtttcagcaagaaaccgaagggaacgcccctaagcctccngatctatcgctgctatccctaatttaacaaaagtcggacgtacctatacaagtattcgacgacggcaggtggactcgtggacctacgtacgtcctttaccaccttcctcctacccgtacacgaccgtaccgtcccgtgtacctaggttcctaaggtaacgttattttcgaaccttaaccgttttacgtttacttacggtttacctaacgttaaacgttacctttacccgttttacccgtttaccccgttaccggggtttaccccggttaccgggtcccgggtaaacccgggggtaccggtaaccggggttacggttaaccggttaccgggttaaccgtaaacgggtacccgtaaccgggtttgggttaccgggtttaccgaccccgttaacccggttacttccccggtttcggtttaccccg

SEQ ID NO: 252909 - DNA, 593 bp, Homo sapiens
  misc_feature: GYAE6OF01B2ISG.43.60.F05.1.454.CMB.1.raw
  modified_base (194)..(194): a, c, t, g, unknown or other
  misc_feature (194)..(194): n is a, c, g, or t
  modified_base (336)..(336): a, c, t, g, unknown or other
  misc_feature (336)..(336): n is a, c, g, or t
  modified_base (412)..(412): a, c, t, g, unknown or other
  misc_feature (412)..(412): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctcctgtctgtatctgtagganacaagtcacatcactgccggcaagtcaggacatagaatgaatagcctggttcagcaagaaaccagggaaacgcccctaagctacctgactctatcgctgctactcctaactttaacaaaagtcggactacccatacaaagtntacaggcgcgagtggatcgtgcacagtcttcacttctccgaccgtcacgacacgtcctgactagtctagaaagttnttttacgacttacgtttaacttacgttacgttactaacgtaacgttacttttcctttacccgttaccgttcgggtaaccggttccgggccggtaacggggtccctaaggggtggtaacgttcggtaacgaaacggtggtaaccgttggtggttccggactaacctgtttcgtcgtttaccg

SEQ ID NO: 252910 - DNA, 670 bp, Homo sapiens
  misc_feature: GYAE6OF01DHQQ0.43.60.F05.1.454.CMB.1.raw
  modified_base (102)..(102): a, c, t, g, unknown or other
  misc_feature (102)..(102): n is a, c, g, or t
  modified_base (227)..(227): a, c, t, g, unknown or other
  misc_feature (227)..(227): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
tcagtgtgagtagtcacgaccggtgctcgatttagtacgtcatcaggggaaagggggagtcagacccactcaggacacagcatggacatggacgggtccccnctcagcctccgtgggcctcctgctgctcgtggcctcccgagtcgaccagtatgcgccactaccagactccgaccctgtcctcccgtccctcctgtctgtatcgtagaagacgaacaacgtcaccntccgtacgtcggcggatagcgaagtataataagaatagtaacttcggcgttacggtacaacgaaccgaaacgaaaccggaacggtaacccaccccttaagcccttagtatacgtactcgtcgtactcaccttacctaaccttaaactaaagaaacgtcgtaacccactaatacggtaactacgtgacggcgtatagngtacngtagactactcgtccttcacctccgacacgtgaaccnggaccnctacgtatcggttaagagtttacgtatttaacgtactttaaccgttagtactactaacgtaacgtccttttcgttacccgttactacccgggtatcccggtaccggaaccggtagggtaaccgtcggtataccggttaagtaccggacgttcccggtaaggtcgtaacggtcctcgaaaccgtttctaagttccgtcc

SEQ ID NO: 252911 - DNA, 806 bp, Homo sapiens
  misc_feature: GYAE6OF01AWQEO.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggacctcccgaggtgcccagatgtcgccatccagatcgacccagtcctcccgtccctcctgtctgtactctaggtaggagactaacgtccacctatcctacgttcggaccgggactaacggtcgaacggtaactaagttaaggtaaaacttaggtaaacgtttaccggtaccgtttacgggttttcaacggtaccgaaggttaaaacccggaacggggtaaaacccgaccccgtaaacggtccccttacgtacgtaacctaccgttaagtccgcgttccgtacctaaccttacccgttaaacgtttaaacgtaaaaacggttccggtaacgtacccctaacgttaccgtaaacgtacgtttaacggaccggtacggtacgaacggtcggtacgttacggtacggactaacgtcgttaccgttacctccgttaccctccgtaaccggtcgtaccgccgtaacgcccgtacgtacgtaccgtacgtagttaacgttgtttacaacgtttaaccttattacgtacgtaatacgtaacttccttccgttaacccgttaccgtacgggttacccgttacgggacccggtaccgggtaccgtacgggtaccgtacgtaccggtacgtaacggtccggttagtcgggttaacttccggtactaacccgtcttcccgtcgtttacccg

SEQ ID NO: 252912 - DNA, 558 bp, Homo sapiens
  misc_feature: GYAE6OF01A773B.43.60.F05.1.454.CMB.1.raw
  modified_base (277)..(277): a, c, t, g, unknown or other
  misc_feature (277)..(277): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (511)..(511): a, c, t, g, unknown or other
  misc_feature (511)..(511): n is a, c, g, or t
  modified_base (548)..(548): a, c, t, g, unknown or other
  misc_feature (548)..(548): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacataagaaatgaattagccttggtttcagcaagaaaccgagggaaacncccctaagctcctgatctatgctgcatccaatttaacaaatgacgtaccatcaanttcagtcganagtggatcgtggaccacagtcctttacgacctctcgaccgtcacgcacgcctgcgagtacgtagtaacttagttttgacgttaactttatttactacgtacttaacaagttctttacttcccttaccgttacggtcggttaccggccgagggaccctagggtacgggtntggtacgaagtccgtaagtcgtaggtcacgacctacngttcgtaccg

SEQ ID NO: 252913 - DNA, 668 bp, Homo sapiens
  misc_feature: GYAE6OF01CW8AK.43.60.F05.1.454.CMB.1.raw
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatcgacccagtcctcccgtcctccctgtctgtatctagtagacgacaaagtcaccatcacttcggccggacaagtcaggactagttaagaatgaattagccttggttcagacaagaaaccgaaggaacgccccaagtcctactgatctangactgctactacctaacttaacgaaaagtcgacgtaccatacaanattcgagcggcgtagtacggtatcgtacggactacgtacgtctttaccgacttcctacctacccggtccacgcctaccggtcctcggtactaacgttccgtaaggttaacgtttcgtttacgtaacctttaacgttttaacttaccttacgttaaccttaacgtaactttaccttttacccgtttcccgttaacccgttccgggtaccggtttccggaaccggtacgggtaaccgtcgggttacggtacgttacggtacgaacggttccgaagtttcggttcggttacgacccgttagtaacttccgttcgtttaccc

SEQ ID NO: 252914 - DNA, 571 bp, Homo sapiens
  misc_feature: GYAE6OF01AC662.43.60.F05.1.454.CMB.1.raw
  modified_base (218)..(218): a, c, t, g, unknown or other
  misc_feature (218)..(218): n is a, c, g, or t
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (378)..(378): a, c, t, g, unknown or other
  misc_feature (378)..(378): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
  modified_base (521)..(521): a, c, t, g, unknown or other
  misc_feature (521)..(521): n is a, c, g, or t
  modified_base (560)..(560): a, c, t, g, unknown or other
  misc_feature (560)..(560): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctggtagagacaagtcacatcacttgccggnagtcaggacatagaatgaattagcctgttacagcagaaccgaggaacncccaagcctactgactctangtctgctactcacttaanaagtggactaccatacaacgtatcgacggtcgacgagtgtatcgaggcaccgtagtcctttacgacctttaccncgaccgtcacgccgtagtccctgacctacggttctaagggtaacttnttacggacctttaacgtttnttacgttacaagttacaagtttccttaccttaccgttacccgtggaccgttacgaccgggacggtccgtaagggtntacgttcgaccgtagccgtagttccgagtccgacacctnttcgtcgttac

SEQ ID NO: 252915 - DNA, 840 bp, Homo sapiens
  misc_feature: GYAE6OF01AIVIB.43.60.F05.1.454.CMB.1.raw
  modified_base (834)..(834): a, c, t, g, unknown or other
  misc_feature (834)..(834): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctcgtgtcctaccgaggtcgccgagatgtcgaccactaccgagtactccgaaccctacgtccttcccgtcccttcccgttcgttcgttacgtattcgtaggtaaggaacgaactaacgtaccacctactactaccgttcgggccggacaacgtacgaacggtactaagttaacgtaaagtagttaacttcgtcggtttgttacaacgacgaaaacggaaaccgggaacgggtaaccctacccgtaacggtccttacgttaacgtactaccgttagcgtcgtactaccttaaccttaacccttttaaacgttaaaagtaaaccggttcggtaaccctacctaaataacgttaacgtacgttaccgacgggtccgtacggtagggttcacggttcgtacgacccgtaacttaccgtttaccttacccgttaccttaccgtaccctaacccgtacgaccggtaccgtaccgtcccgtacggtaccgttaggtttacctaagggttacgttttactttacgtaacgtttacctttaagtttccgttactaactttaacttaaccgttttcctttaacccgtttaccccggttaccgtacgggtttaccccggtcgggaaccggggtaaccggggtacgttaccgggtaacgtacggtaccgttacggaacggttactttgggtacgttacggtacacccgttactacgtttccgtnttaccg

SEQ ID NO: 252916 - DNA, 679 bp, Homo sapiens
  misc_feature: GYAE6OF01AT585.43.60.F05.1.454.CMB.1.raw
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagactgacccagtcctccgtcctccctgtctgtactctgtagganaccaagtcaccatcactgccggacaagtcagacatagaatgatgcctgttcagcaacgaacgaggaacncccgtaagcctactgactcgatcgctgacctattaccaactttacaaaacgtcggtactaaccgtagtacaagtacgttaccgaggtcgacgtaggtacggtactccggtaggaccctaagtaaccgttccttaccggacttaccctaccgtacccgtacacggacccgtaacggtcccctagggaccttaacggttaccgttagtaacgtttacgttttcggaaccctttaaacggttttcttaacccgttacgggtttaccttaaacgtaacgttacccgtttaccttacccggtttaaccgtccggttacggtccggaacccggtacgggtaccgtacgggttagtacgtacggacggaaccggtagacccgggttgccttaccgacgactttaccctgtttcgtaccg

SEQ ID NO: 252917 - DNA, 671 bp, Homo sapiens
  misc_feature: GYAE6OF01C9PEB.43.60.F05.1.454.CMB.1.raw
  modified_base (198)..(198): a, c, t, g, unknown or other
  misc_feature (198)..(198): n is a, c, g, or t
  modified_base (282)..(282): a, c, t, g, unknown or other
  misc_feature (282)..(282): n is a, c, g, or t
tcagtgtgagtagtcacgaccggtgctcgatttagtacgtcatcaagggaaagggggagtcagacccactcaggacacagcatggacatgagggtccccgctcagctccgtgggctcctgctgctctggctcccgaggtgccagatgttcgccatccagatcgacccagtctccgtcctcctgtctgtatctgagganacaagtcacatcacgttcgccggcagtcagacattaagaatgaattacgtccttaggttaccagacgaacgaaaccgaggaacncccctaagcctaccgtgtactctagtcgctggactactaccgtaactttaaacgaaagtcggactaccctaatactaagtacgttacgacggtaccgacgtaggttacgggtactacggtacggacctaacgtagttaccctttaccgaccttccgtacccgtaacccgtcgaacgtcgaactccgtagaccttaagtcctaagtaacgtttacgtttacgaactttaactttaacgttacgttactaacgttaactaattaccttttaccttaccgttaccgtacggttaccgttcggaccgtaacggggtccgtagggtagtacgtcggaacgtacggtacgtaccgttaggtcggtacctacgtaccttacgtcgttacccgttcg

SEQ ID NO: 252918 - DNA, 771 bp, Homo sapiens
  misc_feature: GYAE6OF01CA454.43.60.F05.1.454.CMB.1.raw
  modified_base (198)..(198): a, c, t, g, unknown or other
  misc_feature (198)..(198): n is a, c, g, or t
tcagtgtgagtagtcacgaccggtgctcgatttagtacgtcatcagggaaagggggagtcgagacccactcaggacacagcatggacatgagggtccccgctcagctcctggggctcctgctgctctggctcccaggtgccagatgtgccatccagatcgacccagtcctccgtcctcctgtctgtatcgtgtagganactaagtcacatcacgttcggaccggacaacgtcgaaggtactaattaagaaatagtaagttagccgttggtttcacgaccgaacggaaaaccgaacggggaaacccgtcccctaaacggtccttaccgtagtactttaccgtaagtcgtaccgtggaccctaacgttacccttaaacgttttaaacgaaaacggttcgggtaccgtacccctaagttacaaacggtatttaccgagggtccggacgtaggtacggacttcgtacgggacctaacgtacgttcctttaccaccttccgtaccgtacccgttacgaaccgggtacctacccggtacccgtgtaccgtacgttactaaggttaacgtttacgtttaccgtaactttaacgtttacctttacgttacgttaacctaacttaacggtttccctttacccgtttaccgttacccggttacgggtacccgttacgggacccgggtacgggtacccgtaaggggttacgtacgttccggtaagaccgtcggtacgtcgggtacgtaccgtacgaaccccgttactcccgtttgtttcccg

SEQ ID NO: 252919 - DNA, 777 bp, Homo sapiens
  misc_feature: GYAE6OF01DJKRQ.43.60.F05.1.454.CMB.1.raw
  modified_base (209)..(209): a, c, t, g, unknown or other
  misc_feature (209)..(209): n is a, c, g, or t
tcagtgtgagtagtcacgaccggtgctcgatttagtacgtcatcaggggaaagggggagtcagacccactcaggacacagcatggacatgacgggtccccgctcagctccgtggggctcctgctgctctggcctcccgaggtcgccagatgtcgccatccagatcgaccctagtcctcccgtcctcctgtctgtactcgtcggtagganaacgtaagtccaccatcgtacgtcggccggtacaagtcgaacgtataagttaagaaatagtaaacgttcgtaccgttggttacgacgaacgaaaaccggaaaccggaacggggaaacccgtaccccgtaaggccttaccgtagacttcgtacgttcgctacgactaccgttacctaactttaacgaaaacgtcggactacccaagtacaagtactcgagcggtatacggtcgtacgtcaggtaccacgtacgttcctttacacccgtccgtccgtaaccgtccgtacgaccgtacgtcctacgtaccgtacgttacgtaggttaacgtttacgttacgtacctttaactttacgttacgtttaacgtaacgttaaccgtaacgtttaccctttacccgttacccgtttacccgggtacgggtttaccggtacccggtaccgggaacccggggtaccggttaacccgggtaacggttacgtaccggtaaacggttaaccgggtaaacccgtcgggttaacgggtacggttacccgacggttaacccaccggttacttccggtttacccg

SEQ ID NO: 252920 - DNA, 712 bp, Homo sapiens
  misc_feature: GYAE6OF01DN0G6.43.60.F05.1.454.CMB.1.raw
  modified_base (224)..(224): a, c, t, g, unknown or other
  misc_feature (224)..(224): n is a, c, g, or t
tcagtgtgagtagtcacgaccggtgctcgatttagtacgtcatcagggaaagggggagtcagacccactcaggacacagcatggacatgagggtccccgctcagctccgtggggctcctgctgctctggcctcccaggtgccagatgtcgccatccagatcgacccagtcctccgtcctccctgtctgtatctgtaggagacaagtcacatcacgtcgccgganagcagacataagaatgaattacgtccttaggttcagacgaagaaaccgaggaacgcccctaagcctccgtagactctagtcgacgtcgactactacctaactttaacaaacgtcggtacctacctataacgaagtacgttacgacggacggtacgtaggtacgtacgtcgtaggacctacgtagttcccttactacccttctacccgtaccgtcacgccgtacgtctacgtacgtaacgttacgttaggtaagtttacgtttacgtaacctttaacttttacgtttaaccgttacgttaacctaacgtttaacgtttaccttttaacccgtttaccctttacccgggttacccggttaccgggttaccccgggtaccgggaacccgggttaaccggtacccggggttaggtaccggtacggtaaccgtaacggtaccggttaacgttggtacggtttaccaccggtacttaccgttgttccggttccc

SEQ ID NO: 252921 - DNA, 782 bp, Homo sapiens
  misc_feature: GYAE6OF01AV53W.43.60.F05.1.454.CMB.1.raw
  modified_base (768)..(768): a, c, t, g, unknown or other
  misc_feature (768)..(768): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggcctcccgaggtgccagatgtgccatccagatcgacccagtcctccgtcctcctgtctagtatcgtgtaggacgactaacgtcaaccatcacgttcggccggtacaacggtcgaaggtactaattaagaaatagtaattacgtaccgttggtttacaacggaccaaagggaaaacccgaacggggaaaccgtacccccgtaacgtccgttaccgtagtaacttcgtacgtcggtcctggtacctaacgttacccttaacgtttaaacgaaaacgttccggtaaccgtaccctaatacaacggtactacggaacgtcgggacgtaggtcggtactcgggacggtacctacgtacgttaccgtttacctacccttaccgtacccgttaacccgtacgaacggtcccgtaacccggttcgtccggtaacgtacgttacgttaacggttaagtttaccgttttacgtaaaccttttaaccgttttacgttacgttaaccgtaaacgtttaaccgtaacgtttccctttacccgtttaccgttaacccggttcgggttaccgtaccgggtaccggaaccgggtccggtagggtacgtcggttacgaccggtagtaccgtaggttggttacggtaccacgtaccttnttaccgtcgttacc

SEQ ID NO: 252922 - DNA, 749 bp, Homo sapiens
  misc_feature: GYAE6OF01CRSZH.43.60.F05.1.454.CMB.1.raw
  modified_base (742)..(742): a, c, t, g, unknown or other
  misc_feature (742)..(742): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggcctcccgaggtcgccagatgtcgccactccagtactcgaccctagtcctccgtcctccctgtctgtactctaggtaggagacaacgtccaaccactacgtacgttcggccgggtactaacgtcgacggtactaagttaagtaatagtaattacgtccgttaggttacagtacgaaacgaaacccggaacgggtaaccgtacccctaaaggccttaccgtagtaactcgtactcgaccgtcacctaaccgttacctaacgtttaaacgaaacgttcgggtaacctccctaagtaaccgtaacgtacgttacgacgggtcggtacgtaagggtcggtaactccggtacggtacctaacggtcgttaccctttaccggaccttaccgtaccggtacccgtacgtacggtaccgtaccgtaccgtcgtacgtacgtacgttaggtaacctttagttacccgtacttaactttaccgttacgtcgttaactaacgttacgttacctttccgtaccgtttacccgcggttaccgttaccggaaccggtacgggtaccgtaggtacgtacgtacgtaggaacgtcgtaacgggtgttacggtctaccgagttactcggttnttacccg

SEQ ID NO: 252923 - DNA, 821 bp, Homo sapiens
  misc_feature: GYAE6OF01CYR80.43.60.F05.1.454.CMB.1.raw
  modified_base (172)..(172): a, c, t, g, unknown or other
  misc_feature (172)..(172): n is a, c, g, or t
  modified_base (422)..(422): a, c, t, g, unknown or other
  misc_feature (422)..(422): n is a, c, g, or t
tcagtgtgagtagtcacgaccggtgctcgatttagtacgtcatcaggggaaagggggagtcagacccactcaggacacagcatggacatggacgggtccccgctcagctccgtggggctcctgctgctctggcctcccgaggtcgccagatgtcgccatccagatcgacccngtcctcccgtccctcctgtctagtatcgtaggtaggacgtaacaaacgtccactactcctacgttcggaccggtacaacggtacgaaggtaactaagttaaacgaaagttacgtaaagtttcggcccgtttagggttaccaacggaccgaaaacggaaaccggtaacgggaaaacccgtcccccgtaaagtccgttaccgtagtaacgttcttagtcgtctacgtacctaaccttactaaacctttaaanaaacggtcgtaccgaccagtacaagtcgtacgacggcgtaggtagtcgtcgttcggagtaccaaccgttcttacccttacacctcccgtaccgtaccgacgtaccggtacctccgggtcccttacggaccgttacgtaacggttacgtaaacgtttttcgtaaacccgtaacgttttaactttacgtactttaacccgtaacttaaggtttaacctttcccgttttaacccgttcccgggttaaccggtcccgggtttaacccgggtaccgggtaacccgggtaccggggttaacccggttagggtacgtaacggttccggtaacggtaccgtaacgggttccgggttgtaaccccggttacgttacccacgggttttcaccgggtttccttaacccgg

SEQ ID NO: 252924 - DNA, 788 bp, Homo sapiens
  misc_feature: GYAE6OF01DGWO2.43.60.F05.1.454.CMB.1.raw
  modified_base (597)..(597): a, c, t, g, unknown or other
  misc_feature (597)..(597): n is a, c, g, or t
tcagtgtgagtagtcacgaccggtgctcgatttagtacgtcatcagggaaagggggagtcagacccactcaggacacagcatggacatgacggtccccgctcagctccgtggggctcctgctgctctggcctcccgaggtcgaccagtatcgtcgccactaccagactcgaccctagtccctcccgtccctcctgtctgtatctagtaggacgtaacaaacgtcaacctactacctacgttcggaccgggtacaacggtaccgaacggtaactaatttaaaagaaagttacgtaaagtttacgtcccgttacgggttttaccgaacggaaccgaaaacggtaaaaacccgggaacggggtaaaaaccccgtacccccgttaaacgcccttaccccgtagtaaccgtttacctagttcggtaccgtacgacctaaccgtttacccttaaacgtttaaaaccgtaaacgtccgggtaacttacccccgtaataaccgtaaagtcgttacggaccggtacgggtaacgtacggtcggtactcgtacgggctaaccgtacgtttccttacccgacttcccgccgtaaccctcgacgtaccncgtacgtctaacgttacgtacttagtagttacgtttactaaccttatttactacttagtactaacgtacttacctttcttacccgttacggtcccggtacggtaccgtacgggtaccggtaccgcgggttacgacgttcgacgttaacgcggttacgtcggtcgttaccgacctacgtctgttccttaccg

SEQ ID NO: 252925 - DNA, 619 bp, Homo sapiens
  misc_feature: GYAE6OF01BFM3I.43.60.F05.1.454.CMB.1.raw
  modified_base (192)..(192): a, c, t, g, unknown or other
  misc_feature (192)..(192): n is a, c, g, or t
  modified_base (303)..(303): a, c, t, g, unknown or other
  misc_feature (303)..(303): n is a, c, g, or t
  modified_base (430)..(430): a, c, t, g, unknown or other
  misc_feature (430)..(430): n is a, c, g, or t
  modified_base (570)..(570): a, c, t, g, unknown or other
  misc_feature (570)..(570): n is a, c, g, or t
  modified_base (577)..(577): a, c, t, g, unknown or other
  misc_feature (577)..(577): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctccaggtgccagatgtgccatccagatgacccagtctccgtcctcctgtctgtatctgtaganacaaagtcaccatcacttggcggacaagtcaggacattagaaatgaattagccttaggtttcagactaagaaaaccgagggaaaacgtcccctaaagcctacctgtaactntaacgtgcctagctatacctactttaacaaaagtggtaacgtccaactacgaaatacttcgaagccggacgaggttacggaacttcgcggtacactaggtactttccgaacttcctacacccgttanaccgtacgagtccctagctaagtcctaagtaacgttattttacgaccttaagtttaacttactagtaactaactagtaacctttcttacccttaaccgtcggttacgttacgaccgtaacgggcctaaagggtcggttancggttanaaaccggtcgaacgttgacggttcgaacaccgtattcgtctc

SEQ ID NO: 252926 - DNA, 802 bp, Homo sapiens
  misc_feature: GYAE6OF01DQZUP.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatcgacccagtcctccgtcctccctgtctgtatctgtaggagacaagtcaccatcactgccggcaagtcgagacataagaatagtaattacgccgttggtttacagacaacggaaaaccgtaaggggaaaccgacccccgtaaaggtccttaccgtacgactttcgtaacttcgctcgactaccttacccttaaactttaacgtaaaaactcgggtacctaccctaagtaactaacgtacttaccggacggtcgggtaccgtagggtacggtaacgttccggtacgggaacccgtacgtaacggtttacctttacccttaccgttacccgttccccgtaacccggtacttaaccggaccgtaaccgttaaccccgtcgtaacggttacggtacccgtttaacgggtaaagttttccgttttaacggtaacctttaaaccggtttttaactttaaccgttacgttaacctaacgttaaaacgttttccgttttacccgttttacccgttaaccccgtttcccgggttaaccgggttcccgggaaccggttaccgggtaacccggtcgggtaacgtacggttacggttaacgaacggttacgtaacggttggtcgggttaccgacgtaaccttcgttcgttcgttaccc

SEQ ID NO: 252927 - DNA, 608 bp, Homo sapiens
  misc_feature: GYAE6OF01BUC5E.43.60.F05.1.454.CMB.1.raw
tcagtgtgagtagtcacgaccggtgctcgatttagtacgtcatcagggaaagggggagtcagacccactcaggacacagcatggacatgagggtccccgctcagctccgtggggctcctgctgctctggctccaggtgcagatgtgccatccgagatcgacccagtcctccgtcctccctgtctgtatctgtaggagacaagtcacatcacgtgccggcaagtcaggacagttagaatgaattagccttggtttcagacaagaaaccgagggaacaccccgtaagcctcctgactctatgctgctatcctactttaacaaatgacgtaccatacaagtacttcgagcgcgtagtgtactcgtgcaacgtcgtcttcacttcaccgtaccgtcacgtcgacgtcctacgctacgtgtacgtaattcgtttacgacttaactttagtttaacctattactaacgttaagttactttacccgtttaccgttaccccgttacggtacccggttccggaccggaacggggtacccgtacgggtacggtacgtcgtacggaacgtcggtaaccggttggttcggtaccaccgtaactcttccggttctttaccg

SEQ ID NO: 252928 - DNA, 723 bp, Homo sapiens
  misc_feature: GYAE6OF01DPXP3.43.60.F05.1.454.CMB.1.raw
  modified_base (224)..(224): a, c, t, g, unknown or other
  misc_feature (224)..(224): n is a, c, g, or t
  modified_base (276)..(276): a, c, t, g, unknown or other
  misc_feature (276)..(276): n is a, c, g, or t
  modified_base (322)..(322): a, c, t, g, unknown or other
  misc_feature (322)..(322): n is a, c, g, or t
  modified_base (418)..(418): a, c, t, g, unknown or other
  misc_feature (418)..(418): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccaatccagatgacccagtctcccgtcctccctgtctgtactctaggtaggagacaaagtcaccatcacttgccggnaagtcagacattagaatgtaatagccttggttcagcaagaaaccaggaaacncccgtaagctactgactctagtgctgactactccctaactttaaanaaaagtcggacgtaccctatacaagtacttcgaacgtcggcgtaaggtaggatcgtagggactacgtattcctttacgaccttctaccacccggtnaacgccagtccctagaccgtacgtcgtaaggtagtttacgttttacggacctttaaatttaacgtttaccgttattaaccgttaaaccgttaacttaccgttttacccgtttcccgttaaacccccgggttacggggttaccccgttaccggggaaacccccggtaacggggggtaaacccccggtacggggttacggttaaacccggttacggtaacccggtaaaaccggtcccggtaaaccggtttacgggtaccggttaccctacgggaccccttaaaccgttcgtttaccggtttacccgg

SEQ ID NO: 252929 - DNA, 672 bp, Homo sapiens
  misc_feature: GYAE6OF01B4KJX.43.60.F05.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (303)..(303): a, c, t, g, unknown or other
  misc_feature (303)..(303): n is a, c, g, or t
  modified_base (657)..(657): a, c, t, g, unknown or other
  misc_feature (657)..(657): n is a, c, g, or t
tcagtgtgagtagtcacgaccggtgctcgatttagtacgtcatcagggaaagggggagtcagacccactcaggacacagcatggacatgagggtccccgctcagctccgtggggctcctgctgctctggcctcccaggtcgccagatgtgccatccagatcgacccagtcctccgtccctcctgtctgtactcgtaggagganaacaaagtccaactatcgtacgttggccgganaacgtcaagggactaagttaagaaatgaaattcgaccgttgttaccagacaacgaaaccgacggaacncccctaagcctcgtagatctatgctgacacttaccctaacgttaagaaagtcggtacctaccgaatacgaaagtacttcgaaggcggactaggtcggaactcgacgtacacctagttcccttaccacttacccgacgttaacccgcgaaccgccgtaacgtcccgtacggtaccctaagggttaccaagggttaactttacggttacactttaaacgttacgttacttacgtaacgttaacttaaacggttcctttaccgttaacccgtacccggtagttaccggtaccgaccggtacggaccgtaggtcgtagtcgaacgtacgtcgaacgttgggtacttaccgacttaccncgttcggtccttacc

SEQ ID NO: 252930 - DNA, 715 bp, Homo sapiens
  misc_feature: GYAE6OF01BTDJH.43.60.F05.1.454.CMB.1.raw
  modified_base (104)..(104): a, c, t, g, unknown or other
  misc_feature (104)..(104): n is a, c, g, or t
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
tcagtgtgagtagtcacgaccggtgctcgatttagtacgtcatcagggaaagggggagtcagacccactcaggacacagcatggacagtggacgggtcccccgntcagctccgtgggctcctgctgctctggcctccaggtgccagatgtcgcctatccagatcgaccctgtcctccgtcctccctgtctgtctcgtgagganacaagtcacatcacgtgccgganagtcaggatatagaatgaatcgtctgttacagacaacgaaccgaaggaacctacccgtagcctacgtgtactcgtatcggtctgactacgtacctaacttaacaaagtcggtaaccgtccaagtaacgtaacgtacttacgacggacgggtactagggtacggactcggtacgacctagtaccgttcccttactccgttaccgtaccgaccgtacgtacgcgtacgtacctcggtaacgtaccgtaagtacggttaaacctttacgtttccctaaacgttttaccgttttaacgtacctttaacgttactaaacgtttaccgtttaccctttacccggttttaccggaccccgtttaccggggtacccggttacccggtaacccgggtaacggggttaccccgaacgggttagggtactaccgggtaacgaaccggtggttacgttcggttaacggtcccgtaccctacgttcgttctcgttaaccccg

SEQ ID NO: 252931 - DNA, 593 bp, Homo sapiens
  misc_feature: GYAE6OF01AVITO.43.60.F05.1.454.CMB.1.raw
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctagtaggagacaaagtcaccatcactgccgganagtcagacagttagaaatgaattagcctggtttcagcagaaaccagggaacnccctagctcctgatctatgctgccatcctaacctttaacaaaacgtcggtacgtacccatacgaacgagttacaggccggtacagtcggactcgtcggacatacgtcctttcaccgttacctccgaacctcagacctacgcctagctagtcgtagtagtatttcgacttaactattactcgtactacaagttcttacttcccgttaaccttcggttaccggtacgacccggtacggggaccctacgggtaggtcgtaacgtaccgtaacggtccgacgttacgggtcgtaccgttcgaacctacccgtagttcccgttcgg

SEQ ID NO: 252932 - DNA, 744 bp, Homo sapiens
  misc_feature: GYAE6OF01DGKPP.43.60.F05.1.454.CMB.1.raw
  modified_base (733)..(733): a, c, t, g, unknown or other
  misc_feature (733)..(733): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatcgacccagtcctcccgtcctcctgtctgtatctgtaggacgaacaaacgtcaccatcctacgttcggaccgggacaggtacgaggaactattaaagtaaatgaattacgtccttaggttcgagtaccaaacggtaaaccgaacgggaacctacccctaagccgtcctagtacttctagtcgactcgactactaccttaactttaaacgaaacgttacgggaccttaccgactaacgtaaacgttacgttacgacggaccgggacgttaagggtacggtacgtccggtacggacctaaccgtacgtttaccctttaccgtaaccttcccgtacccgtaccctaccgacgtccgacggtccctgtaccgttaacgtcgttaacgtagttttacgtttacgtaccgtttaactttactttacgttacttaaccttaacgttaacgttaccttttaccgttaccgttacccggtcgggttaccgttaccgggaccggttaaccggggtacgtacgggttacgtacgtcggtaacgtaacggtaccggtacgttcggtacgtaccgtaccgtactaccgtnttccgttaccg

SEQ ID NO: 252933 - DNA, 934 bp, Homo sapiens
  misc_feature: GYAE6OF01DOCNQ.43.60.F05.1.454.CMB.1.raw
  modified_base (138)..(138): a, c, t, g, unknown or other
  misc_feature (138)..(138): n is a, c, g, or t
tcagtgtgagtagtcacgaccggtgctcgatttagtacgtcatcagggaaagggggagtcagacccactcaggacacagcatggacatgagggtccccgctcagctccgtggggctcctgctgctctggctccaggtnccagatgtcgccatccgagactcgaccagtcctccgtcctcctgtctgtactctgtagagacaagtccacgatcgacgttcggaccggtactaacggtacgacggtaactaagttaagtaaagttacgtaaacgtttacggtcccgtttaggtttaccgaacggtaaccgaaaaccggaaaaccggaacggggaaacccggtaccccctaaggtcctaccgttacgaccttacgttacgtcgtcgtacggcctaactacccttaaacgtttaaacgaaacgtccggtaacctaccgtaactacgtaaacgtacgttacggaacgaccgggtacgtacggtaacggtacctacggtcgggtaacctacggttacccgttacctttacgacccccgtttcgtaccccgttaccggacgaaccgtacgtacccgggtaccttaacggccctttaacggtaccggtttaagtaaacccttttaggtttaaccctaaaccgtttttaaccgtttaacgttcccgtttaacgttaacccgttaacccgtttaaacgttttcccggttttaaccccttttaaccccgggttaaaccccgggttacccgggtttaaccccggtaccccggggttaaacggggttaccccgggtaaacccgggttaacgggttacccggttaaacggttaacccgggtaaacgttacccgggtaaaccggtttaccgggttaacgggtttacccggtacccgttaacccggtaccccggtaaacctttccggggtttaacccgtttaaccccggg

SEQ ID NO: 252934 - DNA, 754 bp, Homo sapiens
  misc_feature: GYAE6OF01EKHQJ.43.60.F05.1.454.CMB.1.raw
  modified_base (728)..(728): a, c, t, g, unknown or other
  misc_feature (728)..(728): n is a, c, g, or t
  modified_base (744)..(744): a, c, t, g, unknown or other
  misc_feature (744)..(744): n is a, c, g, or t
tcagtgtgagtagtcacgaccggtgctcgatttagtacgtcatcagggaaagggggagtcagacccactcaggacacagcatggacatgagggtccccgctcagctccgtggggctcctgctgctctggctcccgaggtcgccagatggtcgaccataccagactacgaccctagtcctccgtaccctcctggtcctagtactcgtaggagagaacaaagtccaacctgtactacgtggtacccggatacggtcgaggtaactagttaacgaaatacgttaagtacgtccgttaggtttacaacggtaccgtaaaacggaaaccgaacgggtaaaccctaccccgtaagtaccctaccgttaggtaacttacgttacgtcggctacgcctaacttacccttaaacgttaaacctaaacggttcggtaccttaaccagttaacaacggttacctacggcggtaacgacgttaggtacgactttcggacgtaccgtaacgttctaccgtttacccacgggttacctaccggtaaaccgtcgtaacgtccgtacgtccgtaccgagttacgtaactaccgttagttacgttactaactacgttacttcggtatacgtaacttacgttcctaccgtttcccgtaacgaccggttacgttaccgggaccggaccggggttatacgggtacggtactaccggtaatccggtaaacgtaccgtaggccccggtanacccgactaaccgttntcccgttacg

SEQ ID NO: 252935 - DNA, 761 bp, Homo sapiens
  misc_feature: GYAE6OF01AEWQT.43.60.F05.1.454.CMB.1.raw
  modified_base (221)..(221): a, c, t, g, unknown or other
  misc_feature (221)..(221): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctcccgtcctccctgtctgtatctgtaggagacaagtcaccatcacttggccggnaagtcaggacattagaatgaattagcctggttcagcaagaaaccagggaaacgcccctaagcctcctgactctatcgctgcactcctaactttaacaaagtcggaactcccaataccaagtacttacgacggcggacgtaggtggaacgttcgtacggacaccgtacgttccttttaccaccttacccgtaccctaacccggtactacggtaccgtacgtccccgtaggaccgtaacggttaccggtaagtaaacggtttacgtttttacggaacctttaaacgttttaagtttaaccttacgttaacccttaaacgtaacgttttaacccgtttttcccccggttaacccccggtttaacccccgggttaccgggtttaaccccgggacccgggtaaacccggggggttaaccctaccgggggttaacggtaacggtttcccgggtaaacccggtaaacgtaccccgggttaaggttcccgggtcggttacccggttacgaaccccgtaccttaccgttccggtttaccgtttaccccg

SEQ ID NO: 252936 - DNA, 930 bp, Homo sapiens
  misc_feature: GYAE6OF01CLTUL.43.60.F05.1.454.CMB.1.raw
  modified_base (100)..(100): a, c, t, g, unknown or other
  misc_feature (100)..(100): n is a, c, g, or t
  modified_base (242)..(242): a, c, t, g, unknown or other
  misc_feature (242)..(242): n is a, c, g, or t
tcagtgtgagtagtcacgaccggtgctcgatttagtacgtcatcaggggaaagggggagtcagacccactcaggacacagcatggacatgagggtccccnctcagctcctggggcctcctgctgctctggctcccaggtcacagatgtcgccatccagatcgacccgtacgtctcccgtcctccctgtacttgtactcgtagaggacaacaaacgtcaccactacgtacgttcggccggtanaacgtcgaacggtactaagttaacgtaagttagtaaacttacgttccggttaggtttaccgaacgtacggtaaaaccgaaaaaaccggtaaacggggtaaaacccgtacccccgtaaaggtccccgtaccttaggtaactttaaccgttacgttcgcgttaccgtaactaaccgttaaccctttaaacgtttaaaaacgaaaacggttccggtaaccgtaaccctaaataaccgtaaacggtacgttacggaaaccggcgggtaacgtaagggttacggtaacgtcgtacgggtaccaacgttaccgtttaccttttacccgactttacccgtaccgtaacccggttaccgaacggtccccgtaaacgggtcccgttaacggtacgtaaacggttacgttaacggtaacgttttaacgtttaacccgtaactttaaaccgtttacgtttaaccccgttaacgtttaaccgttaaccgggttaaactttttaacccgtttccccgttttaacccggtttaaccccgggttaccgggtttaccgggttaccccgggtaccgggggttaaacccgggaaccggggttcgggtaaaccgttcggggaaacttaaccgggaaaccgttacggttaaccggttgggttacgtacccggtaacttaccggttaccctttacgtccgtttaaccgg

SEQ ID NO: 252937 - DNA, 623 bp, Homo sapiens
  misc_feature: GYAE6OF01CZ8QK.43.60.F05.1.454.CMB.1.raw
  modified_base (273)..(273): a, c, t, g, unknown or other
  misc_feature (273)..(273): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattaagaatgaattagcctggtttcagcagaaaaccagggaaancccctaaagctacctgatctatgctgcatccaactttaacaaagtggagtcccatacgaaatattacgagcggctaggtcggtatcgtacggctacgtacgtcgtttacaccttctaccaacccggttccacggtaccaacggtccctacggctaagtactcggaagttagttttcgacttaacttttaacttaacttgtacgttaacaagttaacttttcctttaccgttaacccgttccgggtacgtttccgggacccgtacgggggtaccgtacgggtcggtagtacggtactaaggtacggtaacggttaggtggttacgacgtacctaacttcgttcgttaccgg

SEQ ID NO: 252938 - DNA, 493 bp, Homo sapiens
  misc_feature: GYAE6OF02F5466.43.60.F05.1.454.CMB.1.raw
tcagtgtgagtagtcacgaccggtgctcgatttagtacgtcatcagggaaaggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagtattttgactaacttattactgtctacaagtattcttcttaccctcggacgttcggccagggaccacggtggagtgtcaagcgaactgtggctgcaccatctcg

SEQ ID NO: 252939 - DNA, 469 bp, Homo sapiens
  misc_feature: GYAE6OF02GIO71.43.60.F05.1.454.CMB.1.raw
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (436)..(436): a, c, t, g, unknown or other
  misc_feature (436)..(436): n is a, c, g, or t
  modified_base (442)..(469): a, c, t, g, unknown or other
  misc_feature (442)..(469): n is a, c, g, or t
tcagtgtgagtagtcacgaccggtgctcgatttagtacgtcatcagggaaaggggcctaggagtcgggtggccgaatataacggaaagatggagaaaagatacactacatggactctgtggagggccgattctaccatctccagagacaaacgccaagacgttcgcctgtttctccaaatgagtagtctgagagtcgaggacacggctgtgtagttattgtgcgagagactcgagcccctccaaagtgggatctactatgatgcatttgatatttggggccaggggacagtgggtcacagtctcttcgagcctccaccaaggggcccatcggtcttccccctggcgccctgctccaggancacctcgagngcacagcgccctgggctgctggtcaaggctactccactactcacactgacgcgggctggcaaggcncatagnnnnnnnnnnnnnnnnnnnnnnnnnnnn

SEQ ID NO: 252940 - DNA, 526 bp, Homo sapiens
  misc_feature: GYAE6OF02JQHDJ.43.60.F05.1.454.CMB.1.raw
  modified_base (524)..(524): a, c, t, g, unknown or other
  misc_feature (524)..(524): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggttcagcagaaaccagggaaacgcccctaagctcctgactctatgctgcatccactttacaaatgactccatacaagatcagcgcagtgatcgtgcacacgtctttcactctcaccgtcagcacgcctgcagtctagtaagtattttagacttaacttattactgttactaactagtacttcttaccttacccttcggtacgttcggaccgtacggggacctacgggtgtacgtcgtacgacgtacgtacgtgtacggttcgcgtacactcgtntc

SEQ ID NO: 252941 - DNA, 529 bp, Homo sapiens
  misc_feature: GYAE6OF02I5VYY.43.60.F05.1.454.CMB.1.raw
  modified_base (423)..(423): a, c, t, g, unknown or other
  misc_feature (423)..(423): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatcgtggcacagctttcactctcaccgtcagcagcctgcagtctagaagtattttgctaacttattactgtctacaagtntttcttccttacctcgtacgttccggccgagggaccacggtcggtagtcggtacaaggccgtaacgttggttggttcgtaccgtacctacgttcgttgtttacccg

SEQ ID NO: 252942 - DNA, 702 bp, Homo sapiens
  misc_feature: GYAE6OF02GL26Z.43.60.F05.1.454.CMB.1.raw
tcagtgtgagtagtcacgaccggtgctcgatttagtacgtcatcagggtaagggggtagggtcagacccacctcaggacacagcatggacatgagggtccccggcctcagctccctcggggcgtcctgctgctctggctcccacggtgccagatgtgccatccagtatcgacccagtcctccgtccctccctgtctgtatctgtaggagacaaagtcaccatcacttgccggtcaacggtcaggacattacgaaatgaattagccttggtttcagtcgtagaaaccagggaaacgaccccgtaaaggccgtccctacgacctctaagtcgtccgtgtctaagttccgaactttaacaaaaatcggaagttacccctatacgaaaggtcgttaccaagtccgggtactaggtggatcgtggaccacagtcgtttacgactctacctaccgtcacgtccaacgtcctagaccacgtccgtagtaagtacttttcggacttaaacttaatttaccttgtaccttaaacttaagttacttttaccttaccttaacccgttacgggttaaccgtttaccggtaacccggtaaccggggtaacccggtaccgggttacgggtaccggtacgggttaaccggaaacggtaacggtaaccggttaggttaccgggttacgtaccgtaccgtacgttccgtacgttacccg

SEQ ID NO: 252943 - DNA, 517 bp, Homo sapiens
  misc_feature: GYAE6OF02G6AX6.43.60.F05.1.454.CMB.1.raw
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctccaggtgccagatgtgccatccagatgacccagtctccgtcctccctgtctgtatctgtaggagacaaagtcaccatcacttgccgggcaagtcaggacattagaatgaatagctggttcagcagaaaccagggaaagcccctaagctcctgatctatgctgcatccactttacaaaatggacgtcccatcaagattcagcggcagtggatctggcacagtctttacacttcncacgtcagcagcctgcagtctagaagtnttttgctaacttattactgtactaacaagtatttccttacttaccctcgtacgttcgccgtacgggacctacgggtgacgtgtcgaagcgtaactggtggttcgacgtacccgattaccgtgttcc

SEQ ID NO: 252944 - DNA, 534 bp, Homo sapiens
  misc_feature: GYAE6OF02I5TD4.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttaacaaaatggagtcccatcaagattcagcggcaggtggatctggcacagtctttcacttctcaccgtcagcagcctgcagtctgtaagtattttgactaatttacttactgttactaactaagttactttccttacttacccgttcggtaccgttccggccgacggggacccagggtcggagttggtacaaggcgtaacgttggtggttgaccacctattctgttcc

SEQ ID NO: 252945 - DNA, 562 bp, Homo sapiens
  misc_feature: GYAE6OF02JA8KC.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctgtctcccaggtgccagatgtgccatccagatgacccagtctccgtcctccctgtctgtatctgtaggagacaaagtcaccatcacttgccggcaagtcaggacattagaaatgaattagcctgttcagcagaacaggaagccctaagctcctgatctatgctgcatcctattaacaaatggacgtcccatacaagtattcagcgcagtggatcgtggcacagctttcactctcaccgtcagcagcctgcagtcagagttatttgacttaacttattactgttactaacgtaattactttcctttaccgtttacccgttccgggttaccgttccgggtacccgtacggggtacccgtagggtacgtacgttcggacctaaacggccggtaaaccgttggtaccggtcgtaccgaccgtaaccctattccgtttaccg

SEQ ID NO: 252946 - DNA, 519 bp, Homo sapiens
  misc_feature: GYAE6OF02G0EAJ.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagtctttcactctcaccgtcagcagcctgcagtctgaagtatttgactaattatactgtactacaagtactttcttcttacccgtcggtacgttcggccgtacggggaccacgggtgacgtggtacaaggccgtaactggtacggttcgctaccgtattcgtgttcc

SEQ ID NO: 252947 - DNA, 513 bp, Homo sapiens
  misc_feature: GYAE6OF02HL7JA.43.60.F05.1.454.CMB.1.raw
  modified_base (417)..(417): a, c, t, g, unknown or other
  misc_feature (417)..(417): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatgagtccatcaagattcagcggcagtgatctggcacagctttcacttctccaccgtcagcagcctgcagtctgaagtattttgctaactttattactgtactanaagtatttcttccttaccctcggtaccgttcgccgtagggccgacggtggacgtgtcgaagacgtaacgtcgtggttcgcgtacctagtctgttcc

SEQ ID NO: 252948 - DNA, 730 bp, Homo sapiens
  misc_feature: GYAE6OF02FJDMK.43.60.F05.1.454.CMB.1.raw
  modified_base (202)..(202): a, c, t, g, unknown or other
  misc_feature (202)..(202): n is a, c, g, or t
tcagtgtgagtagtcacgaccggtgctcgatttagtacgtcatcagggaaggggagtcagacccactcaggacacagcatggacatggacgggtccccgctcagctccgtgggctcctgctgctctggcctcccaggtgccagatgtgccatccagatcgaccccagtcctcccgtcctccctgtctgtactctgtaggganacaaagtccaccatccacttcggcccgggtcaagtcaggacattagaatgaattacgcctggttcagcacgaaccgagggaacgcccctaagcctcctgatctatgctgacactcctaacttaacaaaacgttcggaaccgtccccataccgaaagtacttaccgaggccgggctaaggtggtaactccgtagggacctacgacgttccctttaccacctcctacccgaccgtcacgccacgtccctgacctacgtctagtaacgtttacttttacgaaccttaaacctttctttaccgtcgttaaccttaaaccgtaaacgtttacctttttacccgtttaccccgtttaaccccggttaccgggggtaacccttacccgggggtacccggtaacccggggggtaacccgttaccggggtacggtaacggttaaccgggttaaccaaaccgggtacccggtaaaccggttcgggttacgggtcccgttaccggaccctaaccccggttatttcccggtttaacccgg

SEQ ID NO: 252949 - DNA, 577 bp, Homo sapiens
  misc_feature: GYAE6OF02I0VA2.43.60.F05.1.454.CMB.1.raw
  modified_base (273)..(273): a, c, t, g, unknown or other
  misc_feature (273)..(273): n is a, c, g, or t
  modified_base (380)..(380): a, c, t, g, unknown or other
  misc_feature (380)..(380): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggtttcagcagaaaccagggaaacncccctaagctcctgatctatgctgcatccactttaacaaaatggactcccatcaagacttcagcggacagtggatcgtggcacacgtctttcacttcctcacccgtnagcacgcctgctagtctagaagttattttgacttaacttattactgttactaactaagtactttccttaccttacccgttcgggtaccgtttcggaccgtacgggggaccctacgggtgggtaacgttcggtacgaaaggtcccggtaaacgtttggttacgggtttacgaccgtaacctacgttcgttgttacccg

SEQ ID NO: 252950 - DNA, 573 bp, Homo sapiens
  misc_feature: GYAE6OF02HRPJA.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagccttggtttcagcaagaaaccagggaaacgcccctaagctcctgatctatgctgcatccaactttaacaaaatggactccatcaaagtattcagcggacagtggatcgtggacacgtagtcctttacaccttcctacacccgtcagcagctagctagtcgtagtaagttattttagacttaaactttattacttagttacttaactaagttactttcctttacccttacccgttaccgggtaccgttcgggaccgtaacggggaccgtacgggtacggtagtgtacgaagtacgtaacgtggtacggtcgtcgacctactatcgttcg

SEQ ID NO: 252951 - DNA, 493 bp, Homo sapiens
  misc_feature: GYAE6OF02HVVXC.43.60.F05.1.454.CMB.1.raw
  modified_base (422)..(422): a, c, t, g, unknown or other
  misc_feature (422)..(422): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtccatcaagattcagcggcaggtgatctggcacagtcttcactctcaccgtcagcagcctgcagtctagaagtattttgactaacttattactgtctacaagtnttcttcttaccctgtacgttcggccgagggaccgacggtggtatgtacagcgaactgtgctgcacatctcg

SEQ ID NO: 252952 - DNA, 536 bp, Homo sapiens
  misc_feature: GYAE6OF02GZ40K.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagccccctaagctcctgatctatgctgcatccactttacaaaatggatcccatcaagattcagcggcagtggatctggcacagctttcactctcaccgtcagcagcctgcagtctagaagtattttgactaacttattactgtactaacaagtactttcttccttaccctcggtacgttcggccgacggggtaccacgggtcggagtggtaccaacggtccgaacgttggttacgggtttcgccgtaacctacttcgttgttacc

SEQ ID NO: 252953 - DNA, 511 bp, Homo sapiens
  misc_feature: GYAE6OF02FT7Q3.43.60.F05.1.454.CMB.1.raw
  modified_base (422)..(422): a, c, t, g, unknown or other
  misc_feature (422)..(422): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagtattttgctaacttattactgtactacaagtntttcttcttacccttcggacttcggtccgacgggacgtaccggtggagtgtacgagacgtaacgtgtcggttgtcgaccactctgttcc

SEQ ID NO: 252954 - DNA, 580 bp, Homo sapiens
  misc_feature: GYAE6OF02H7JBP.43.60.F05.1.454.CMB.1.raw
  modified_base (265)..(265): a, c, t, g, unknown or other
  misc_feature (265)..(265): n is a, c, g, or t
  modified_base (384)..(384): a, c, t, g, unknown or other
  misc_feature (384)..(384): n is a, c, g, or t
tcagtgtgagtagtcacgaccggtgctcgatttagtacgtcatcagggaaagggggagtcagacccactcaggacacagcatggacatgagggtcccgctcagctcctggggctcctgctgctctggctcccaggtgccagatgtgccatccagatgacccagtctccgtcctcctgtctgtatctgtaggagacaaagtcaccatcacttgcggcaagtcaggacattagaatgaattagcctggttcagcagaaccaggaaanccctaagctcctgatctatgctgcatccaactttaacaaaatggactcccatacaagattcagcggcagtggtatcgtggacacagtctttcactctcaccgtcagcacgctgctagtntagtaagtattttgactaactttatactgttactaactaagttctttaccttacctttaccccgttacggtaccggtttcggacccggtaacggggacccggtacgggttacggtacgtcggtaaccgtaacgggaccggtaaaccgttggttacgggtttacgaccgtaacccgtacgttccgttacgtttaccg

SEQ ID NO: 252955 - DNA, 526 bp, Homo sapiens
  misc_feature: GYAE6OF02JE4PM.43.60.F05.1.454.CMB.1.raw
  modified_base (413)..(413): a, c, t, g, unknown or other
  misc_feature (413)..(413): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggtttcagcagaaaccagggaaacgcccctaagctcctgatctatgctgcatccactttacaaaatgacgtccatcaagattcagcgcagtggatcgtggcacagtctttcactctcactgtcagcagcctgcagtctagaagtatttgactaactttattactntactacaagtctttcttccttacccgtcggtaccgttcggaccgtacgggtaccgtacggtcggtgttacgtacgaagtccgtaacgtcgtcggccgtgacctacgtacttcg

SEQ ID NO: 252956 - DNA, 758 bp, Homo sapiens
  misc_feature: GYAE6OF02JCLV9.43.60.F05.1.454.CMB.1.raw
  modified_base (209)..(209): a, c, t, g, unknown or other
  misc_feature (209)..(209): n is a, c, g, or t
tcagtgtgagtagtcacgaccggtgctcgatttagtacgtcatcagggaaaggggagtcagacccactcaggacacagcatggacatgaggtccccgctcagctcctgggctcctgctgctctggctcccaggtgccagatgtgccatccagatgacccagtctccgtcctccctgtctgtatctgtaggagacaaagtcaccataccntacgtacgccggacgaacgtacgacggacgtaacgttaagtaaagtaagtaaacgttaacgtaccgttacggtttacgtaacgtaacgtcaaacggtaaaacccgaaacgggtaaaaccgtaaccccgtaaacgtacccgttacccgtacgtaacgttacgttaacgtacgtaccgtacgtaccgtaacgttaacccttaaaccgtttaaaccgtaaaacgttacggtaaccgtacccgtaacgtaacgtaaacgtaacgttacgtacggtacggtacgtacggtacggtacgtacgtacggtacgtacgtacgtaccttacgtactaccgtaccgtaccgtacgacgtacgtacgtacgtacgtacgtacgtacgtacgtaacgttacgttacgtacttaacttaacgttacgttacgttacgtaacgtaacgtacttaccttaccgttaccgtaccgtaccgttaccgtaccgtacggtaccggtacggtacggtacgtacgtacgtaacgtacgtacgtacgtacgtacgtacgtacgtacgtacg

SEQ ID NO: 252957 - DNA, 633 bp, Homo sapiens
  misc_feature: GYAE6OF02JMBT4.43.60.F05.1.454.CMB.1.raw
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
tcagtgtgagtagtcacgaccggtgctcgatttagtacgtcatcaggaaaggggaggtcgagaccactcaggacacagcatggacatgagggtcccgctcagctcctgggctcctgctgctctggctccaggtgccagatgtgccatccagatgacccagtctccgtcctccctgtctgtatctgtaggagacaaagtcaccatcacttgccggnaagtcaggacattagaaatgaattagcctggttcancaagaaacagggaaagcccctaaagctacctgacttctatggcttgcatcctatttaacaaaatggactcccattcaaagtattacgacgcggactaggtggaacttcgtgggaccacagtccttttacacttctccaaccgttcaagtccacgtcccttggacctaggttaccgtagtaaacgttatttttacgaccctttaaacgtttattttaaacctcggttactaaaccgtaaagttctttaccgttttacctaacccgtcggttacggttcgaccgttacggggaacccttagggtacggtacgtttacggtacctaaggccgtaaacgttaggttcgggtttacgccgtaccctaacgtttcggttaccttacgg

SEQ ID NO: 252958 - DNA, 550 bp, Homo sapiens
  misc_feature: GYAE6OF02JHKNM.43.60.F05.1.454.CMB.1.raw
  modified_base (396)..(396): a, c, t, g, unknown or other
  misc_feature (396)..(396): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaagcccctaagctcctgatctatgctgcatccactttacaaaatggagtcccatcaagattcagcgcagtggatcgtgcacagctttcactctcaccgtcagtcagcctgcaggtcctagtaacgtnttttgactaactttattactgtactaacaagttactttctttaccttacccgttcgggtaccgttccggccgtacggggtaccgtacgggtaggtacgttcggtactaaggtaccgtaacgttggtacggcgtcgacctactacgttcgttacg

SEQ ID NO: 252959 - DNA, 526 bp, Homo sapiens
  misc_feature: GYAE6OF02GKMNX.43.60.F05.1.454.CMB.1.raw
  modified_base (365)..(365): a, c, t, g, unknown or other
  misc_feature (365)..(365): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctctgatctatgctgcatcactttacaaaatggatccatcaagatcagcgcagtggatctggcacagctttcactctcaccgtnagcagcctgcagtctgaagtattttgactaacttattactgtctanaagtnttacttcttaccctcggacgtttcggaccgtaggggacctacggtcggtaagtcgtacgaagtccgaaacgttcggttaggttcgacgtacccgtattaccgtgttaccc

SEQ ID NO: 252960 - DNA, 703 bp, Homo sapiens
  misc_feature: GYAE6OF02HCJNN.43.60.F05.1.454.CMB.1.raw
tcagtgtgagtagtcacgaccggtgctcgatttagtacgtcatcagggaaagggggagtcagacccactcaggacacagcatggacatgagggtcccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggtttcagcagaaaccagggaaagcccctaagctccgtgatctatgctgcatccgactttaacaaaatgagtcccatcaagattcgagcggcagtggatcgtggacacgacgtcttttcgaacgttcctacctacccgttaccaacggtccctaacggacccttaggaccgtaacggttacctaagggtaaacgttaagtttttacggaacctttaaacttttacgtttaacctcgtttaactaaacgtaaacggttaccttttaccgtttaccctttaaccccggtaccgggttaacccggttacccgggtaacccggtaacgggggtaacccgtaacggggttagggtaaccggttaacgggttaaccgggaaaaccggttccggtaaaacccggttgggttaacgggtaccgttacggtacccgtaaccgttaccggttaccgtttacccggg

SEQ ID NO: 252961 - DNA, 528 bp, Homo sapiens
  misc_feature: GYAE6OF02HA8MQ.43.60.F05.1.454.CMB.1.raw
  modified_base (330)..(330): a, c, t, g, unknown or other
  misc_feature (330)..(330): n is a, c, g, or t
  modified_base (428)..(428): a, c, t, g, unknown or other
  misc_feature (428)..(428): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttaacaaaatggacgtcccatcaanattcagcggcagttggatcgtggcacagtctttcactctacaccgtcacgcacgcctgcagtctagtaagtatttagactaacttattactgtctaanaagtattcttacttaccctcggtacgttcggaccgtacgggaccgtacggtcggacgtgtacgtaaggcgaacgttgtacggcctgaccacctatcttcg

SEQ ID NO: 252962 - DNA, 604 bp, Homo sapiens
  misc_feature: GYAE6OF02I0OTI.43.60.F05.1.454.CMB.1.raw
  modified_base (408)..(408): a, c, t, g, unknown or other
  misc_feature (408)..(408): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagacagaaaccagggaaacgcccctaagctcctgatctatgctgcatccactttaacaaaatggactcccatacaagattcagcggacagtggatcgtggacacacgtctttacactctaccaccgtcagccagcctgctagtctagaagttnttttacgacttaaactttattactagttacctaacgtaagttacttttaccttacctttacccgtacgggttaccggtttccggaccgggtaccgggggtaaccgtacgggttagggtacgttaggtaccgtaacggtaccgttaacgttcgggttacggtaccgttacggtacccaacccgtattcccgtttacg

SEQ ID NO: 252963 - DNA, 547 bp, Homo sapiens
  misc_feature: GYAE6OF02JA8AL.43.60.F05.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (328)..(328): a, c, t, g, unknown or other
  misc_feature (328)..(328): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtagganacaaagtcaccatcacttgccgggnaagtcaggacattagaaatgaattagcctggtttcagcagaaaccagggaaacgcccctaagctcctgatctatgctgcatccactttacaaatggagtcccatcaanattcagcggcagtgatctgcacacgtctttcactctcaccgtcagcagcctgcagtctagaagttattttgacttaactttacttactagttactaactaagtactttccttacctttacccgtcggttaccggttcggaccgtacggggtaccgtacggtaggacgtcgtacgaggtaccgtacgttgtacggttacgccgtactacgttctagttcc

SEQ ID NO: 252964 - DNA, 445 bp, Homo sapiens
  misc_feature: GYAE6OF02GRLS2.43.60.F05.1.454.CMB.1.raw
  modified_base (435)..(445): a, c, t, g, unknown or other
  misc_feature (435)..(445): n is a, c, g, or t
tcagtgtgagtagtcacgaccggtgctcgatttagtacgtcatcagggaaaggggctggagtgggtggccaatataaggaaagatggagaaaagatacactacatggactctgtggagggccgattcaccatctccagagacaacgccaagagttcgctgtttctccaaatgagtagtctgagagtcgaggacacggctgtgtattattgtgcgagagactcgagccccctcccaaagtgggatctactatgatgcatttgatatttggggccaggggacagtggtcacagtctcttcagcctccaccagggcccatcggtcttccccctggcgccctgctccaggagcacctccgagagcacagcggccctgggctgcctggtcaaggctacttccactactcacactgacgcgggctggcaaggcgcagtagnnnnnnnnnnn

SEQ ID NO: 252965 - DNA, 502 bp, Homo sapiens
  misc_feature: GYAE6OF02FVJ0D.43.60.F05.1.454.CMB.1.raw
  modified_base (349)..(349): a, c, t, g, unknown or other
  misc_feature (349)..(349): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggatccatcaagattcagcgcagtggatctggcanagtctttcactctcacgtcagcagcctgctagtctgaagtattttcgactaacttattactgtctacaagtcttcttacttacctcggtacgttcggccgagggaccaggtcgatcgcaagcgtaacgtgtggttcgactacctatctgttcc

SEQ ID NO: 252966 - DNA, 583 bp, Homo sapiens
  misc_feature: GYAE6OF02I7BLP.43.60.F05.1.454.CMB.1.raw
  modified_base (349)..(349): a, c, t, g, unknown or other
  misc_feature (349)..(349): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaacgcccctaagctcctgatctatgctgcatccactttaacaaaatggacgtcccatcaagtattcagcgcagtgatcnggcacagtcttcactctcaccgtcagcagcctgctagtctagaagttattttcgacttaactttactttactgttacctaactaagttacttttaccttacctttaccccgttcggtaaccggtttccggaccgtacggggtacccgtacgggttcggtaacgttcggtacctaacggtaccggtaacgtttgggttacggttcgaccgtaacccgtagttccgtgtttacccg

SEQ ID NO: 252967 - DNA, 551 bp, Homo sapiens
  misc_feature: GYAE6OF02HRCH8.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggttcagcagaaaccagggaaacgcccctaagctcctgatctatgctgcatccactttaacaaaatggactccatacaagtatcagcgcagtggatcgtgcacagtctttcactctacaccgtcaacgcacgcctgctagtctagaattattttcgacttaacttattactgttactaactaagtactttccttaccttacccgtcggtaccgttcggaccgtaacggggaccgtacgggtggtacgtcggtacgaacgtccgtaacgttggtacggtcgtgacctaacctacgtcgttacg

SEQ ID NO: 252968 - DNA, 530 bp, Homo sapiens
  misc_feature: GYAE6OF02G4JDT.43.60.F05.1.454.CMB.1.raw
  modified_base (339)..(339): a, c, t, g, unknown or other
  misc_feature (339)..(339): n is a, c, g, or t
  modified_base (414)..(414): a, c, t, g, unknown or other
  misc_feature (414)..(414): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaacgcccctaagctcctgatctatgctgcatccactttacaaaatggagtcccatcaagattcagcggnagtggatctggcacagtctttcactctccaccgtcagcagcctgcagtctgaagtatttgactaacttattactntctacaagtactttcttccttacccttcgtacgttcggaccgtacggggacctacgggtggacgtggtacgaacggccgtaacgtggttacggttcgaccacctatccgtgttccg

SEQ ID NO: 252969 - DNA, 623 bp, Homo sapiens
  misc_feature: GYAE6OF02IJCVV.43.60.F05.1.454.CMB.1.raw
  modified_base (220)..(220): a, c, t, g, unknown or other
  misc_feature (220)..(220): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggnaagtcaggacattagaaatgaattagcctggtttcagcagaaaccagggaaagccctaagctcctgatctatgctgcatccactttaacaaaatggactccatcaagattcagcgcagtggatcgtggcacagtctttacactctcaccgtcagcagccctgactacgtcgtagtaagttacttttacgaaccttaactttaacttaccgtacgttacctaacttaagttaccttttacctttacccgtttaacccgtaccgggttaccggtttaccggtacccggtaaccgggggtacccgtacggggttacggtacgttacggtaaccgtaaacggtaccgttaaccggttgggttacgggttacgacccgtaacccgttactttccgttcggtttacccg

SEQ ID NO: 252970 - DNA, 548 bp, Homo sapiens
  misc_feature: GYAE6OF02H8QLZ.43.60.F05.1.454.CMB.1.raw
  modified_base (353)..(353): a, c, t, g, unknown or other
  misc_feature (353)..(353): n is a, c, g, or t
  modified_base (397)..(397): a, c, t, g, unknown or other
  misc_feature (397)..(397): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggttcagcagaaaccagggaacgccctaagctcctgatctatgctgcatccactttaacaaatggagtcccatacaagattcagcggcagtggatcgtggcacngtctttcactctcaccgtcacgcagcctgcagtctagtaagttnttttcgactaactttattactcgtactaactaagtactttcttaccgttacccgtcggtaccgttcggaccgtacggggtacctacgggtgtacgtcggtacaacggtcgtaacgttggttaggttcgaccgtactacttcgttgttaccg

SEQ ID NO: 252971 - DNA, 522 bp, Homo sapiens
  misc_feature: GYAE6OF02FWZ25.43.60.F05.1.454.CMB.1.raw
  modified_base (386)..(386): a, c, t, g, unknown or other
  misc_feature (386)..(386): n is a, c, g, or t
  modified_base (429)..(429): a, c, t, g, unknown or other
  misc_feature (429)..(429): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggtttcagcaagaaaccagggaaagcccctaagcctcctgatctatgctgacatccaactttacaaaatgagtcccatcaagattcagcgacagtggatcgtaggcactagtctttcactctcaccgtcagcagcctnctagctagaacgttatttgacttaatttattactgtacctaanaacgtatttcttaccttcccgtcgtacgtcgccgacgggaccaggtgagtcgtacaacgtacgaacgtggagttcgacacctatcgtgttccg

SEQ ID NO: 252972 - DNA, 665 bp, Homo sapiens
  misc_feature: GYAE6OF02JIV3H.43.60.F05.1.454.CMB.1.raw
  modified_base (272)..(272): a, c, t, g, unknown or other
  misc_feature (272)..(272): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtcctgtatctgtaggagacaaagtcaccatcacttgccgggcaagtcaggacattagaaatgaattagcctggttcagcaagaacagggaacncccctaagctcctgatctatgctgacatcctactttaacaaaatcggacgtcccaagtcaagtattcaggtcggactaggtaggaatcgtaggaccaacgacgtaccgtttaccaccttactaccacccgtacacgtaccacggtccctaggacctaaggtaccgtaggtaaacgtactttttaggaacctaacttttaacgttaactcggtttacctaaacgtaacgttacttttacccgttactttaacccccggtggtaaccggtttccggtaccggaccggggtaacccgtacgggttacggtaacgttacggtacggaaacggtaccggtaaacgtttccggttacgggtttcgacccgtacccgtagtttacccgttcgtttacccg

SEQ ID NO: 252973 - DNA, 545 bp, Homo sapiens
  misc_feature: GYAE6OF02F0T17.43.60.F05.1.454.CMB.1.raw
  modified_base (394)..(394): a, c, t, g, unknown or other
  misc_feature (394)..(394): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggtttcagcagaaaccagggaaagcccctaagctcctgatctatgctgcatccactttacaaaatggagtcccatcaagattcagcggcagtggatcgtggcacagtctttcactctcaccgtcagtcagcctgcagtcagaagtnttttgacttaacttattactgtactaacgaagttactttctttaccttacccgttcggtaccgtttcggacccgtacggggacccacgggttggacgttggtaccaaggtcgtaacgttggtacggttcgcctaactacgttcgtgttacc

SEQ ID NO: 252974 - DNA, 627 bp, Homo sapiens
  misc_feature: GYAE6OF02IC7FV.43.60.F05.1.454.CMB.1.raw
  modified_base (358)..(358): a, c, t, g, unknown or other
  misc_feature (358)..(358): n is a, c, g, or t
tcagtgtgagtagtcacgaccggtgctcgatttagtacgtcatcagggaaagggggaggtcagacccactcaggacacagcatggacatgagggtccccgctcagctcctggggctcctgctgctctggctcccaggtgccagatgtgccatccagatgacccagtctccgtccctccctgtctgtactctgtaggagacaagtcaccatcacttgccggcaagtcaggactattaaggaaatagaatttagccttggtttacagtcaagtaaaccagggaaacgcccctaagctacctagactctaatcgactgactatcctaatttaacaaaagttcgtacgtacccatcaaagtnttcgagtcgacagtggtactcgtcggcaacgtacggtcttttaccacgttcctcgtaacccgtcacgcacgtccctagctaacgttcgtaaggtaacttacgttttacgaacttaacctttaattacgttagttaacctaagtaacgttatttacccgttaccttacccgttacggtaccggttaccggtaccggacggtacccgtagggtcggtacgtgtacgaacgtacgtacgtagtcggtacgtacgacgtacgtacttcgtacg

SEQ ID NO: 252975 - DNA, 602 bp, Homo sapiens
  misc_feature: GYAE6OF02GJEV5.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaatgaattagcctggtttcagcagaaaccagggaaacgcccctaagctcctgatctatgctgcatcctaactttaacaaaatggacgtacccatcaagattacgagtcggcaggtggatctggcacagtctttcactctccgtaccgtcacgccaagccctgcagtctagtaagttattttgaccttaacttatttacctgttaccttaacaagttacttttccttacctttacccgttacgggtacccggtttcggacccgtacgggggtacccgtacgggttacggtacgttaggtaccgaaggtaccggtaaccgttcggtacgggtccgttaccggacccgtaaccgtacgttcgttacccgg

SEQ ID NO: 252976 - DNA, 614 bp, Homo sapiens
  misc_feature: GYAE6OF02FQ71X.43.60.F05.1.454.CMB.1.raw
  modified_base (305)..(305): a, c, t, g, unknown or other
  misc_feature (305)..(305): n is a, c, g, or t
  modified_base (403)..(403): a, c, t, g, unknown or other
  misc_feature (403)..(403): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctgttcagcagaaccaggaaagcccctaagctcctgatctatgctgcatccactttanaaatggactccatcaagtatcgagcggcaggtggatcgtgcacgagtctttacactctacaccgtcagtcacgtcctgctagtcctaggtaaacgttnttttagaccttaaacgtttacttactagttacttaacaagtttacctttacctttaccgtttaccccgtcggttaaccggtttccgggaccgtaacgggggtaccctacgggttacgggtaacgtttcggtaccgtaacgggtacccggtaaacgtttcgggttcgggtttaccgtacccggtaccccttagtttcccgttaggtttaccc

SEQ ID NO: 252977 - DNA, 560 bp, Homo sapiens
  misc_feature: GYAE6OF02G1HYC.43.60.F05.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtagganacaaagtcaccatcacttggccgggnaagtcaggacattagaaatgaattagcctggtttcagcagaaaccagggaacgcccctaagctcctgatctatgctgcatccactttaacaaaatgacgtcccatacaagtatcagcggcaggtgactctggcacagtctttcactctcaccgtcagcagcctgcagtctagaattattttcgacttaactttattactacgtctaataacgttctttcttaccttacccgtcggttaccgttcggaccgtacggggtaccgacgggttaggacgttacggtacgaacggtccgtaacgttggtacggtccgttacggccgtaacctagttccttacgg

SEQ ID NO: 252978 - DNA, 610 bp, Homo sapiens
  misc_feature: GYAE6OF02HRFOG.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggtttcagcagaaaccagggaaagcccctaagctcctgatctatgctgcatccatttacaaaatggagtccatacaagtattcagcggacagtggactcgtggcacagtcctttcacttctacacccgtcacgccacgcctacgctagtctaggtaagttatttttacgaccttaaactttagttaccttacgttacttaaccgtaaaggttactttaccgtttaccgtttaacccgttccgggttaaccggtttccgggacccgttaacgggggtaccctacgggttacggtaacgttcggtaccgtaaggtaccgtaacgttaggtacgggacttacggacctaaccgttactcgttacg

SEQ ID NO: 252979 - DNA, 707 bp, Homo sapiens
  misc_feature: GYAE6OF02J0MU5.43.60.F05.1.454.CMB.1.raw
  modified_base (168)..(168): a, c, t, g, unknown or other
  misc_feature (168)..(168): n is a, c, g, or t
  modified_base (489)..(489): a, c, t, g, unknown or other
  misc_feature (489)..(489): n is a, c, g, or t
  modified_base (688)..(688): a, c, t, g, unknown or other
  misc_feature (688)..(688): n is a, c, g, or t
tcagtgtgagtagtcacgaccggtgctcgatttagtacgtcatcagggaagggggagtcgagacccactcaggacacagcatggacatgagggtcccgctcagctcctgggctcctgctgctctggctcccaggtgccagatgtcgccatccagatgaccccagtccnccgtccctccctgtctgtactcctgtaggacacaaacgtccaccatctacttgccggcaagtcaggacattaagaaatgaatttacgacgttgttacagacaaggaaaccaagggaaacgtcccccctaaggacctaccgtacggacttactaacgttcggaccttagtaccctacttaccctaaaccggtttttaacaaaaaacgttcgggtacccgttaccccaatacccgtaaaagtaacgttcgaacggtccggacctaaggtggactcgtaggtacacggttacgcttttaaccgactttccgactcccgtaacgntacccacgtacccgtacgccgtaacgtcgtagttaacggttactttggaaccttaagtttaactttacgacgtttaacaacgttacgtacttttcccggttacccttaccgtaccggtttaacgtccggttaaccgccgggttaaccggagttaccggtacgtcggtaacgtcgacgttaaccgtgtacgtgtaaccgntacccgtagtcttacccgg

SEQ ID NO: 252980 - DNA, 696 bp, Homo sapiens
  misc_feature: GYAE6OF02H2735.43.60.F05.1.454.CMB.1.raw
  modified_base (195)..(195): a, c, t, g, unknown or other
  misc_feature (195)..(195): n is a, c, g, or t
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (279)..(279): a, c, t, g, unknown or other
  misc_feature (279)..(279): n is a, c, g, or t
  modified_base (316)..(316): a, c, t, g, unknown or other
  misc_feature (316)..(316): n is a, c, g, or t
  modified_base (370)..(370): a, c, t, g, unknown or other
  misc_feature (370)..(370): n is a, c, g, or t
tcagtgtgagtagtcacgaccggtgctcgatttagtacgtcatcagggaaaggggagtcagacccactcaggacacagcatggacatgagggtccccgctcagctcctgggctcctgctgctctggctcccaggtcgccagatgtgccatccagatcgacccagtctccgtcctccctgtctgtatcctgtaganacaagtcaccatcactgccggnaagtcagacattagaatnaattgcctggttacaganagaaccgaggaacaccctaagctacngactctatcgactcgctactacctaaacgttttaaanaaaacgttacggacgttccccaaatacgtaaacgtaacttcgaacgccgggtanaacggttaggtactacggtcggaactacgtagtcctttacaccgttctaccgacccgtacaacggttccaacgtcccgttagaccgttaacgtcgttaacggtaaagtttacgttttacaaccgttaaacctttttaacttccgtaacgtttactaaaccgttaaacgttactttttacccgttacccgtttacccgttaaccgggttaccgggttttagacccgggtaaccgggttaccgtacgggtttacggtacttcgggtaactacggtaccgaactttgggtacgttacggtacctaaccgtattaccgttgtttaacccg

SEQ ID NO: 252981 - DNA, 566 bp, Homo sapiens
  misc_feature: GYAE6OF02HIZFH.43.60.F05.1.454.CMB.1.raw
  modified_base (352)..(352): a, c, t, g, unknown or other
  misc_feature (352)..(352): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaatgaattagcctggtttcagcagaaaccagggaaagcccctaagctcctgatctatgctgcatccactttacaaaatggactccatacaagtacttcagcgcagtgatcgtgcacngtcttcactctccaccgtcacgcacgcctgacgtacgtcgtaggtaagttacttttcgactttaacgttattaccttgttactaactaacgttctttacctttaccgttacccgttacggttaccgttccggaccgtaacggggtacccgagggttcggtacgttcggtacgaacgtaccgtacgtcgtaggcgtcgaccactactcgttaccg

SEQ ID NO: 252982 - DNA, 597 bp, Homo sapiens
  misc_feature: GYAE6OF02HALHE.43.60.F05.1.454.CMB.1.raw
  modified_base (219)..(219): a, c, t, g, unknown or other
  misc_feature (219)..(219): n is a, c, g, or t
  modified_base (333)..(333): a, c, t, g, unknown or other
  misc_feature (333)..(333): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggnaagtcaggacattagaatgaattagcctggtttcagcagaaaccagggaaagcccctaagctcctgatctatgctgcatccaactttacaaaatggactcccatacaagattcngcggcagtggatcgtggcacagtctttcacttcctcaccgtcacgcacgcctgctagtcctaggtaacgttattttcgactttaacttactttacgttacgttaccttaaacaagttacttttccgttacccttttaccccgtacgggttaccgtttaccgggaccggtaaccgggggtacccacggggttaggacgttcggtaacgtaacggaccggtaacgttcgggtcggtaccgtgtaccctaccgtacttccgttacgg

SEQ ID NO: 252983 - DNA, 737 bp, Homo sapiens
  misc_feature: GYAE6OF02F16GM.43.60.F05.1.454.CMB.1.raw
  modified_base (198)..(198): a, c, t, g, unknown or other
  misc_feature (198)..(198): n is a, c, g, or t
  modified_base (570)..(570): a, c, t, g, unknown or other
  misc_feature (570)..(570): n is a, c, g, or t
tcagtgtgagtagtcacgaccggtgctcgatttagtacgtcatcaggaagggagtacgagaccactcaggacacagcatggacatgaggtcccgctcagctcctgggctcctgctgctctggcctccgaggtcgccagacttcgtgcctatccagactcgacccagtcctccgtcctccctgtctgtatcgtgtaganaaccaagtcaccatcgtacttcgccggacaaacgtcaggacctaagttaacgaaatcgtaaagttaacgccttaggtttacagtacaacgtaaaccgtaagggaaacgtacccccgtaaagccgtacccgtagactaccgttaagcgtacctgtaccgaaccttacgtaaccgttttaaacaaaagttaccggtaactaccccctaagttaaccaaacggttaaactttccgaacgggtaccgtacggtaacgtacggtaacttccggtaacggaccgtaaccgtaggttccttttaaccaccttccgtaccctacgtaccgtaaggttaaccaccggttcctacggaccttacgtaccgtaggtaacgttnttacgtaaccgttattaacgttcgtagttacccaacgttaagtctttaacgtccgttaactacggttacgtccgttacgacgggttacccgtagtacgtacggtctaccgtaacgtgaaacccggtgttacggttacgtaccggacctacggtcgtaaccgtttccg

SEQ ID NO: 252984 - DNA, 546 bp, Homo sapiens
  misc_feature: GYAE6OF02GTYH5.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttaacaaaatggacgtcccatacaagactcagcggcaggtgatctggacacagtctttcactctcaccgtcagcagcctgcagtctagaagttatttgactaactttattactgttactaactaagttactttcctttaccttacccgtcggtaccggttcggaccgacgggtaccgacgggtgtacgtggtacgaacgtacgtaacgttggttggttcgacctaccgtattccgtgttcc

SEQ ID NO: 252985 - DNA, 601 bp, Homo sapiens
  misc_feature: GYAE6OF02JTVJK.43.60.F05.1.454.CMB.1.raw
  modified_base (221)..(221): a, c, t, g, unknown or other
  misc_feature (221)..(221): n is a, c, g, or t
  modified_base (339)..(339): a, c, t, g, unknown or other
  misc_feature (339)..(339): n is a, c, g, or t
tcagtgtgagtagtcacgaccggtgctcgatttagtacgtcatcagggaaaggggaggtcgagacccactcaggacacagcatggacatgaggtcccgctcagctcctgggctcctgctgctctggctccaggtcgccagatgtcgccatccagatcgacccagtcctccgtcctccctgtctgtactctgtagagacaaagtcacatctacttcgccggnaagtcaggcattagaaatgaatagccttgttcagacaagtaaaccgaagggaaacgaccccttaagcctcctagatctatcgctagcactcctaacttaacaaaagtgacgtacctanacaagtactcgagtcgctagtcggactcgtcggactacgtacgtctttaccgtctacctctaccgtcagtccaagtcccgtagtcctaagtcgtaacgtaagttacttttacgaccgttaacttagtttacctcgttaactaacgttaagtactttacctttaccgtaccgtcggttaccgtacgtccgacgggtaccgtacggtagtccgtacgtactagtaccgaacgttgtacgtcgacctaccgacgttcgatttccg

SEQ ID NO: 252986 - DNA, 821 bp, Homo sapiens
  misc_feature: GYAE6OF02HBEMG.43.60.F05.1.454.CMB.1.raw
  modified_base (272)..(272): a, c, t, g, unknown or other
  misc_feature (272)..(272): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggttcagcaagaacgaggaaacncccctaagctctgatctatgctgcactacctaactttaacaaaagtcggaacgttaccccaattacaaagtaacttcgaacggtcgggacctaggtagggtaacttccggacggtacctaaccgacgttaccttttaccaaccgtttacccgtaccgtaccccggttacaaccggtacctaaccggtccccgttaggtaccctaacggttttaccgtaaacgggttaaacgtttacgttttttaaccgggtaaccctttaaaccgtttttaaaccgtttaaccgttaaccgttttaaccttaaaaccgttaaacgtttaccctttttcccgttttaaccccgttttaaccccgttaccggggggttaacccggttttaccccggggacccgggttaaacccggggggttacccggttaaccgggggttaccggttaacgggtttacccgggttaaccggtaaacgggtaccccgggttaaaccggtcgggtttaaccgggggtaccttaccgggtaacccctaacggttaaccgtttccccgtttacgg

SEQ ID NO: 252987 - DNA, 637 bp, Homo sapiens
  misc_feature: GYAE6OF02IPSW1.43.60.F05.1.454.CMB.1.raw
  modified_base (320)..(320): a, c, t, g, unknown or other
  misc_feature (320)..(320): n is a, c, g, or t
  modified_base (414)..(414): a, c, t, g, unknown or other
  misc_feature (414)..(414): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctgtaggagacaaagtcaccatcacttgccgggcaagtcaggactattaagaatgaatagcctggttcagcaagaaaccgaagggaaacacccctaagcctacctagactctatgctgcactccaactttaanaaatcggacgtacccaagtacaagtactcgaggcggacaggtacggactcgtacggctacgtacgtccgtttacacttacctacgtacccgtanacggacctacgcctgactaggttacgtagtaaattcgttttacgaaccgttaatttacttactcgttaactaaactaagttactttaccttacccgttaccgtcgggttaaccggttccggaccggtaaccggggtaaccgtacgggttacggacgttcggtaaccacggtaaccgtaacgttaggttcggttaacgcgtaaccctagttacctcgttacccg

SEQ ID NO: 252988 - DNA, 579 bp, Homo sapiens
  misc_feature: GYAE6OF02I41IA.43.60.F05.1.454.CMB.1.raw
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttcgccgggacaagttcaggacattagaaatgaattagccttggttcagacaagaaaccgagggaacncccctaagcctcctgactctangctgcactcctactttaacaaatggactacccatacaagtacttcagcggacaggtggatcgtggacacagtctttcactcctcaccgtcganccagcctncgtagtcagtaattatttacgacttaacttacttactcgttaactaacgtaagttactttacctttaccgttacccgtcggttaccgttccggacccgacgggtacccgacgggttggtacgtcggttaacaacggtacgtaacgtggttacgttcgaccacctataccgttgtacc

SEQ ID NO: 252989 - DNA, 617 bp, Homo sapiens
  misc_feature: GYAE6OF02GB4Y1.43.60.F05.1.454.CMB.1.raw
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
  modified_base (390)..(390): a, c, t, g, unknown or other
  misc_feature (390)..(390): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccagggtgccaagatgtagccatccgagtatcgacccagtccttcccgtccctccctgtctgtatctgtaggagacaaagtcaccatcacttgccgggcaagtcaaggactatacgaatgacttagctgttcagcaacgaacgaggaaccnccctaagcctctagactctangctgtacactcctacgttaccaaatgaacgttccagtcaagtagtacagcggcagtgactcgtggcacagtcttcactctcaccgtnacgtcagtcctagtcagtaccttagtaacgttatttcgaactaacgtttaacttaacttacgttactaacgtaacgttacgttccgtttaaccgtacccgttacgggttaacgttaccggtaccgtaacggggtacccgtagggttacgggacgttcggtaccaaccggtaccgtaaccgttggttaccggtaccgttagacccctaacccgtacgtcctttaccgg

SEQ ID NO: 252990 - DNA, 522 bp, Homo sapiens
  misc_feature: GYAE6OF02FTUDG.43.60.F05.1.454.CMB.1.raw
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcacatcacttgccggcaagtcaggacattagaaatgaattagcctggtttcagcagaaaccagggaaagcccctaagctcctgatctatgctgcatccactttacaaaatggatcccatcaagattcagcgcagtggatctggcacagtctttcattctcaccgtcagcagcctncagtctagaatnttttgactaattattactnttctaacaagtactttcttaccttacccgttggtaccgttcggccgacgggtaccgcgggtagacgtcgtcgtaacgcgtaacgtgtacggcttacggccaccgtactcttacg

SEQ ID NO: 252991 - DNA, 516 bp, Homo sapiens
  misc_feature: GYAE6OF02FNPTA.43.60.F05.1.454.CMB.1.raw
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaacgcccctaagctcctgatctatgctgcatccactttacaaaatggactcccatcaagattcagcggcagtggatctggcacgagtctttcactctcaccgtcagcagctgcngtcngagtntttgctaacttattactgtactanaagtctttcttacttaccctcggtacgttccggtccgacggggtaccacggtggagtcggacaacgtcgtaatggtcggttcgcacctnttcgtnttcc

SEQ ID NO: 252992 - DNA, 556 bp, Homo sapiens
  misc_feature: GYAE6OF02IJLLT.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaatgaattagcctggtttcagacaagaaaccgagggaaacgccctaaagcctacctagatctatgcgtgacataccaactttaacaaaagtggaacgtccatacaagattacagcggacagtggatctggacagagtctttacactctacaccggtacagtcacgcctgactagtctagaagttattttgacttaacttattactgtactaataagtatttccttacttaccgtcgtacgttccggtacgacgggacctagggtgtagtcgtacgaaggtaccgtaacgtaggtggaccgttgaccgtacctagtcgttacg

SEQ ID NO: 252993 - DNA, 578 bp, Homo sapiens
  misc_feature: GYAE6OF02HF955.43.60.F05.1.454.CMB.1.raw
  modified_base (272)..(272): a, c, t, g, unknown or other
  misc_feature (272)..(272): n is a, c, g, or t
  modified_base (359)..(359): a, c, t, g, unknown or other
  misc_feature (359)..(359): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggttcagcagaaaccagggaacncccctaaagctacctgatctatgctgcactaccaactttaacaaaatggaacgtcccaatacaagtattcaagcggcaggtggatcnggcactagtctttcacttctacccgaccgtacacgtccaacgtccgtgactaggtactgtaaagttcttttacgacttaaactttatacttagtacttaacgaagttactttaccttcctttacccgtcggtaccggttcgaccggtagggccctagggtggtacgtcggtacctaggtacctagtaggttcggcgtaccgactacccgtatcgtaccg

SEQ ID NO: 252994 - DNA, 849 bp, Homo sapiens
  misc_feature: GYAE6OF02JXJN0.43.60.F05.1.454.CMB.1.raw
  modified_base (168)..(168): a, c, t, g, unknown or other
  misc_feature (168)..(168): n is a, c, g, or t
  modified_base (233)..(233): a, c, t, g, unknown or other
  misc_feature (233)..(233): n is a, c, g, or t
  modified_base (310)..(310): a, c, t, g, unknown or other
  misc_feature (310)..(310): n is a, c, g, or t
  modified_base (511)..(511): a, c, t, g, unknown or other
  misc_feature (511)..(511): n is a, c, g, or t
tcagtgtgagtagtcacgaccggtgctcgatttagtacgtcatcaggaaaggggaggtcgagaccactcaggacacagcatggacatgagggtccccgctcagctcctgggtctcctgcctgctctgtctccgaggtcgccagactgtcgccatcccagatcgacccngtctccgtcctccctgtctagtactctcgtaggacgtacaaagtccaccatcacttcggccgggnaaagtccaaggtacaacttaggaaactgtaacttagtccttaggtttaccagaccgaagaaacccgaagggaaaccnccccgtaagacctcctacgataccgtagtcgacttcgctaacctaccgtaactttaaaccgaaagttaggtaaccttcccgaacgttaccgtaaagtaaccttaccgaacggtacccggacgtaacggtttaggaacgtttccgtacgggacctaacgtacggtacccttttacgtacctccgtaacccgtaacccggttnaaacccggctaacccggtacccggttacgacccgtagggtttaacccagggttaaacgttaactttttcccggtaaacggtttaaaaccgtttcttttaacgaacgtttaaccccgttaaacgtaacgttaaactttttcccggtttaaacccctttacccgggttaccccgggttaacgggttttaacccgggaccccggttaaacgggggttacccccggtaccgggttgggtttaaaaccgtcgggtttaaccccgtaaacggtaccggtaaccgttttacgggccgttacccggtacggtttcccaaaccccgggttacttaccccggtttccg

SEQ ID NO: 252995 - DNA, 679 bp, Homo sapiens
  misc_feature: GYAE6OF02JSVL5.43.60.F05.1.454.CMB.1.raw
  modified_base (191)..(191): a, c, t, g, unknown or other
  misc_feature (191)..(191): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (630)..(630): a, c, t, g, unknown or other
  misc_feature (630)..(630): n is a, c, g, or t
tcagtgtgagtagtcacgaccggtgctcgatttagtacgtcatcaggaaaggggaggtcgagaccactcaggacacagcatggacatgagggtcccgctcacgctcctgggctcctgctgctctggctccaggtgccagatgtgccatccagatcgacccagtctccgtcctcctgtctgtatctgtaggnacaagtcacatcactgccgggcaagtcaggacattagaatgattagctggttcanacgagaaccagggaanccctaagctacctgactcgattacgctacgactacgtcctaacttttaacaaaagttcggaacgtccctaatacgtaacgaattaccgaacncgggtactacggtaacggtnttaccgtagggtaccctaacgtacgtaccgttttaccgaaccgtttccgtaccgtaaccccgggtataaaccggtcccaacgggtccccttaggtacccgtagttaacccgggtttagaaacgtttacgtttttcggaaaccttaattttacgttaaccttcgttaactacgttaacacgtttttcctttaccttaccccggtagtaccggtttcggaccgaacgggtcccgacggttgtaaccgtgttaacccgngaaccggttataggttcggtttcacggtaacctcgttcgttaccgttcg

SEQ ID NO: 252996 - DNA, 608 bp, Homo sapiens
  misc_feature: GYAE6OF02JZDDM.43.60.F05.1.454.CMB.1.raw
  modified_base (257)..(257): a, c, t, g, unknown or other
  misc_feature (257)..(257): n is a, c, g, or t
  modified_base (341)..(341): a, c, t, g, unknown or other
  misc_feature (341)..(341): n is a, c, g, or t
  modified_base (559)..(559): a, c, t, g, unknown or other
  misc_feature (559)..(559): n is a, c, g, or t
  modified_base (588)..(588): a, c, t, g, unknown or other
  misc_feature (588)..(588): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatcgacccagtctccgtcctccctgtctgtatctgtaggagacaaagtcaccatcacttgccggcaagtcaggactattagaatgaattagccttgtcaganagaaccgaggaacgccctaagctcctagactctatcgctgacacgtcctaactttaacaaaatcggactacccataccaaggtnttaccgaggtccggatacggttggactcgtaggccaactcggtactttaccgaacttcctacgtacccgtacacggtccaacgtccgttgacgttacgtccgtacgtaaagttcttttacgaccttaaaccgttattaacctgttactaaactagttatttccctttacgttacccgtcgttacgttccggacgtacgggacccgtacgtggtaccgngtacgtacgtacgtaacgtgtccggttanaccgacttcgtactgttacc

SEQ ID NO: 252997 - DNA, 600 bp, Homo sapiens
  misc_feature: GYAE6OF02GFDUZ.43.60.F05.1.454.CMB.1.raw
  modified_base (354)..(354): a, c, t, g, unknown or other
  misc_feature (354)..(354): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaacgccctaagctcctagatctatgctgcatccactttacaaaatcggagtcccatcaagattcagcggcagtgatctggcacngtctttcactctcaccgtcacgcacgtcctgacgagttcgtagtaagttagttttacgacttaactttaactttacgttacttaccttaactaagttacttttccgtttaccctttaccccgttacgggtaaccgtttcccgggaccgaccgggggttacccgacgggttggtacgttggtaccgaaacggtccggtaaaccgttggttacgggtttcgaccgtaacctcgttccgtgtttacccg

SEQ ID NO: 252998 - DNA, 549 bp, Homo sapiens
  misc_feature: GYAE6OF02IRVCO.43.60.F05.1.454.CMB.1.raw
  modified_base (272)..(272): a, c, t, g, unknown or other
  misc_feature (272)..(272): n is a, c, g, or t
tcagtgtgagtagtcacgaccggtgctcgatttagtacgtcatcagggaaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacatagaaatgaattagcctggtttcagcagaaaccagggaaancccctaagctcctgatctatgctgcactccactttaacaaaatggacgtaccatcaagattacaacgcgacagtggatctggacacagtcctttcactctcaccgtcacgcagtccgtgactggtacctggtaagttagttttgactaactttactttactcgtactactaagtactttcgttaccttacctcgggtaccttcggaccgtacggggacctacgggtggtacgtcggtacgaacggcgtaacgtgtcggtactgactaccagttctcg

SEQ ID NO: 252999 - DNA, 724 bp, Homo sapiens
  misc_feature: GYAE6OF02HYSHX.43.60.F05.1.454.CMB.1.raw
  modified_base (271)..(271): a, c, t, g, unknown or other
  misc_feature (271)..(271): n is a, c, g, or t
tcagtgtgagtagtcacgaccggtgctcgatttagtacgtcatcagggaaagggggagtcagacccactcaggacacagcatggacatgagggtccccgctcagctcctgggctcctgctgctctggctcccaggtgccagatgtgccatccagatgacccagtctccgtcctccctgtctgtatctagtaggagacaaagtcaccatcacttgccggcaagtcaggacattagaaatgaattagcctggttcagcagaaaccgaggaacnccctaagctcctgatctatgctgcactcctactttaacaaatggactccatacaagtattcacgcgcaggtgatcacggacacgacgttctttacaccttcctaccgtacccgtcgacgacctacgtacccgtgacctacgttcgttaaaggtaacgtttacgttttacgaccttaaacctttttaacgttaaccgttcgtttaaccttaaacgttaaaccggtttacttttttacccttttacccgttttaaccccccggttacgggtttaccccgggttttaccgggaacccccgggtaacggggggttaacccccggttacggggtttaacgggtaccggttacgggttaacccgtaaaccgggtacccggtaaacgggttttcgggttaccggggttttaccggtaaccccgttaacccgtacgtttaccccggttcggttttaacccc

SEQ ID NO: 253000 - DNA, 707 bp, Homo sapiens
  misc_feature: GYAE6OF02JAA6K.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaagtcaccatcacttcgccgggcaagtcgagactagtaagaatgaattacgccttggttcagtacaaggaaaccgagggaaaccaccctaagccctactagtactcgttatcgactcgactacttacctaatttaaacaaagtcggtacgtacccagtacaagtacttacacggtcggctaggtacggtacttcgacggtaccaacgtgttccctttaccgaccttcctaccccgaaccggtcgaaggccctacgtcctcggactcggttaccgtaaggtaacgttttattacgttaactttaaacctttagtttaaccgtccggttaacctaaagttaagtttacctttacccgtttacccgttaaccgttccggttaaccgggttccggaacccgggttaggggtaaccccgttagggttaacggtacgttcggtttaacgaacggttaaccggtacgtttcgggttacggtttaccgcccttaacgtcgtttacggttccgtttacc

SEQ ID NO: 253001 - DNA, 607 bp, Homo sapiens
  misc_feature: GYAE6OF02GVUUL.43.60.F05.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (273)..(273): a, c, t, g, unknown or other
  misc_feature (273)..(273): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtccctccctgtctgtatctgtagganaacaagtcaccatcacttgccggnaagtcaggacattagaaatgaattagcctggttcagcagaaacgaggaaacncccctaagctctgactctatgctgccatacctaactttaacaaagtggactacccatacaagtattcgagcggcagtggactcgtcgactacagtccgtttacacttcctacctacccggtcacgcacgtccctggcctagtctaggaacgttattttcgacttaactttacttactgttactaacaggttactttccctttaccgttacccgtaggttaccgttcggtacccggtaacggggacccgttacggggtacggtacgttcggttaccaaacgggtccgaacggttgggttccggcttaacggccctaacgttcgttaccgttccgg

SEQ ID NO: 253002 - DNA, 633 bp, Homo sapiens
  misc_feature: GYAE6OF02IMM0Q.43.60.F05.1.454.CMB.1.raw
  modified_base (374)..(374): a, c, t, g, unknown or other
  misc_feature (374)..(374): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgcggcaagtcaggacattagaaatgaattagcctggtttcagtcagaaaccgagggaaacaccccgtaagctcctgatctatagctgcactcctaactttaacaaaagtggacgtccatcaagattacgagcgcagtggatcgtgacacgagtcctttacnctactaccgtaccgtcgacgtcacgtccgtcgacgtacgttacgtagtaaagttacgttttaggacctttaaactttagttaactcgttactaaacttaagtaccgttttcctttacccgttacccgttacggttacccggttaccggaccggtacggggtaacccgtaccgggttacggtacgttaacggtacctaacgggtacccgtaacgttgggttacggttacgaccctaaccgtacttaccgtcgtttacccg

SEQ ID NO: 253003 - DNA, 654 bp, Homo sapiens
  misc_feature: GYAE6OF02GVFXI.43.60.F05.1.454.CMB.1.raw
  modified_base (219)..(219): a, c, t, g, unknown or other
  misc_feature (219)..(219): n is a, c, g, or t
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaagtcaccatcacttgccgggnaagtcaggactattagaaatgaattagtcctggtttcagtcaagaaaccgagggaaacgacccctaagcctacctgatctagtgcgtgacactacctactttaacaaaattcggaactccctatacaaacgtnttacgagacggcaggtggactcgngcanacgtctttacactctacaccgtcgacgcgacgtcctgacgtagtacgtagtaagttacttttcgaacttaactttactttacgtgtaaccttaacgtaacgttacgtttcctttaccgtttacccgtacgggttaaccgttcccgggtaaccggacggggttaacccgtacggggttcggtaacggtttacggtaacgtaacgggtaccggttaacggtttagggttcgggtttaccgaccgttaacccgtaggtttacccttggtttaacccg

SEQ ID NO: 253004 - DNA, 732 bp, Homo sapiens
  misc_feature: GYAE6OF02IUPO4.43.60.F05.1.454.CMB.1.raw
  modified_base (192)..(192): a, c, t, g, unknown or other
  misc_feature (192)..(192): n is a, c, g, or t
  modified_base (288)..(288): a, c, t, g, unknown or other
  misc_feature (288)..(288): n is a, c, g, or t
tcagtgtgagtagtcacgaccggtgctcgatttagtacgtcatcagggaaaggggagtcagacccactcaggacacagcatggacatgaggtccccgctcagctcctgggctcctgctgctctggctccaggtgccagatgtgccatccagatcgacccagtctccgtcctccctagtctgtatctgtaganacaagtcaccatcacgttcgccgggtacaagtcacggactagttaacgaatgaacttagccttggttaccagtacgaacgtaaacgaagggaaacnccccgtaaagtcctaccctaggaacttcgttatacggcttcgaccacgttacctaactttaaagaaaacgttcggaaccgttccccaagtacctaagtacttcgacgtcgacgtaggtgtactcgtacgacaagtccgttcttacctacgtaccgttacctaccggtacgtacgtacctcgtacccggtacacgttaccgtacgttaacgtaaggtttacctttcggtaaacctttaaaccttaccgttttaacgccgtttaaccttaaacgttaacgttaaccctttttcctttaaccggttacccgtttaccggtaccgttacccggaaccgggtacgggtacccgtagggtcgttaacgacggttacctaacgggtaaccgtaccgtttagggttaccggttacggtacccctacggtttaaccgtcgttactttacccgg

SEQ ID NO: 253005 - DNA, 669 bp, Homo sapiens
  misc_feature: GYAE6OF02IAGED.43.60.F05.1.454.CMB.1.raw
  modified_base (195)..(195): a, c, t, g, unknown or other
  misc_feature (195)..(195): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctccaggtgccagatgtgccatccagatcgacccagttctccgtcctcctgtctgtatctgtagganacaagtcacatcacttgccggcaagtcagacatagaatgaattgcctgttcagacaagaaccgaggaacaccctaagcctacctagactcgtatcgactgacactcctaactttaacaaaagtggtaactacccaatacaagtacttcgagtaccgagaggtcgtatcgtgacacgtagtccttacacttccgtactaccgtacaacgcacgccgttagcgtacgtcgtaagtaacgttaattttcgaaccttaaatttactttacgtacttacgttaaacgtaagttactttaccgtttacccgttaacccggtttacggttaccggttacggtaacccgggtaacggggtaacccgttacggggtaacggttaccggttacggtaaccgtaacggtaacccggttaaacccgtttgggtaccgggttaacggtacccgtaaccccttacgttttacccgtcgtttaaccccg

SEQ ID NO: 253006 - DNA, 657 bp, Homo sapiens
  misc_feature: GYAE6OF02J2U4N.43.60.F05.1.454.CMB.1.raw
  modified_base (196)..(196): a, c, t, g, unknown or other
  misc_feature (196)..(196): n is a, c, g, or t
  modified_base (275)..(275): a, c, t, g, unknown or other
  misc_feature (275)..(275): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctcctgtcctgtatctgtagganacaaagtcaccatcacttgaccggcaagtcaggacagttagaatgaattcgctggttacagcaagaaaccgagggaacnccctaagctctagactctatgctgacactacctacttaacaaagtcgactccatacagtactcgagcggacgagtagactcgtcggactacgacgtcctttacgaccgttcgaccgtaccgtacgaccgaccgtaacgcccgttacgtacctaagtcgtaacgtaaggttaacttttacggtaaacttaactttaacgttacctacgttaactaactaacgtttaccttttcccgttaacccgttttacccgtaccgggtaccgttttaccgggacccggtaacgggtacccggttacgggtcgtaacggttccggtacgaaacggtacccggttagtaccggtcgtaccgtaccgtaccctaaccggtcttcccgttaccg

SEQ ID NO: 253007 - DNA, 683 bp, Homo sapiens
  misc_feature: GYAE6OF02HEZBQ.43.60.F05.1.454.CMB.1.raw
  modified_base (198)..(198): a, c, t, g, unknown or other
  misc_feature (198)..(198): n is a, c, g, or t
  modified_base (279)..(279): a, c, t, g, unknown or other
  misc_feature (279)..(279): n is a, c, g, or t
  modified_base (402)..(402): a, c, t, g, unknown or other
  misc_feature (402)..(402): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctccaggtgccagatggtgccatccgagatcgacccagtcctccgtcctccctgtctgtatctgtagganacaagtcacatcacttcgcggacagtcaggacattagaatgaattacgcttggttcagactaacgaaaccgaagggaaccnccccgttaagcctacctgatctatcgctcgctactacctaactttaacaagttggacctccagtaccaagtacttcgacgtcggacgtaggtgacttacgtgacctacgtcgtccttttaccncttaccgtcccgtaccgttcacggtcaacgtccaggtacctacggttactcgtaaacgtttcgttttacgtaccttaaacctttagttaccttgttaactaacgttcggttaaccttttccgttaccgtttacccgggtaccgggtttaaccggttccggaaccgggggtaccgggttaacccgtacgggggttgtaccggtacgttaaccgaacggggttcctaaccgggttgggtttaccggttctaccggtacccgtttcgttaccgttacgttcccg

SEQ ID NO: 253008 - DNA, 541 bp, Homo sapiens
  misc_feature: GYAE6OF02GL5P0.43.60.F05.1.454.CMB.1.raw
  modified_base (272)..(272): a, c, t, g, unknown or other
  misc_feature (272)..(272): n is a, c, g, or t
  modified_base (399)..(399): a, c, t, g, unknown or other
  misc_feature (399)..(399): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaatgaattagcctggtttcagcagaaaccagggaacncccctaagctcctgatctatgctgcatccactttacaaatggactccatcaagattcagcggacaggtggatcgtaggcacgagtctttcactctcaccgtcacgcacgcctgctagtctagagttntttgactaactttattcttgtactaactagtactttcttaccgtttacccgtcgggtaccgttccggaccgtacggggaccgtacgggtggtacgtgtacgaacggacgtacgtcggttcggctcgactaccgtatcttacg

SEQ ID NO: 253009 - DNA, 625 bp, Homo sapiens
  misc_feature: GYAE6OF02GDQW2.43.60.F05.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaganacaagtcaccatcacttgccgganaagtcaggacattagaatgaattagcctgttcagcagaaccgaggaacgaccctaagcctcctgtactctatgctgcatcctaactttaacaaatcggacgtaccatacaagtacttcgacgcggcaaggtcggtaactcgtacggactacgtcgtcctttactaccttcctaccgtacccgtcaacgcctacgtcctagaccgtacgttactagtaagtttacgtttacgaacttaactttacttactagttacctaactaacgttacctttcctttacccgttacccgttacggttacccgttccggaaccggtcgggtacccgtacgggtacggtactacggttaacgaacggtaccgtaacggttgtacgggtcctacggtaccgaccttacgtcgtttaccg

SEQ ID NO: 253010 - DNA, 537 bp, Homo sapiens
  misc_feature: GYAE6OF02F6K1V.43.60.F05.1.454.CMB.1.raw
  modified_base (344)..(344): a, c, t, g, unknown or other
  misc_feature (344)..(344): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcacatcacttgccggcaagtcaggacattagaaatgaattagcctggtttcagcagaaaccagggaaagcccctaagctctgatctatgctgcatccattacaaatggatccatcaagattcagcgcagtggatctggcacngtctttcactctcaccgtcagcagcctgacagtctagaagttatttcgacttaacttactttactgtactacaattctttaccttacttacccgttcgaccggttcggaccgtaggggtaccctacgggttcggacgttcggtacgaaggtccgtaacgtggttacggttcgacctactagttccttagttcc

SEQ ID NO: 253011 - DNA, 653 bp, Homo sapiens
  misc_feature: GYAE6OF02JO1TQ.43.60.F05.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (495)..(495): a, c, t, g, unknown or other
  misc_feature (495)..(495): n is a, c, g, or t
  modified_base (509)..(509): a, c, t, g, unknown or other
  misc_feature (509)..(509): n is a, c, g, or t
tcagtgtgagtagtcacgaccggtgctcgatttagtacgtcatcagggaaagggggagtcagacccactcaggacacagcatggacatgagggtccccgctcagctcctgggctcctgctgctctggctccaggtgccagatgtgccatccagatgacccagtctccgtcctccctgtctgtatcgtgtagganaacaagtcacatcncttgccggcaagtcaggacattagaatgaattagcctaggttcagcaagaaacgaggaacgccctaagctacctagacttcagtcgtcctgacctagttacctaacgtttaacaaaagttggaaccgtacccctaataccgaaaggtacttacgaggtaccggctaacggtaggtaacccttgtaccgggacctacacgttaccgtttaccacgttccctaccggaacccgttccgagaccgtcgtacccttgggacctacggttactagtaaacgtttagttttanaccttaaacgtttntttacgtacttacctaagtaacttacgttcctttaaccttaccgtacggttaccgttcgacgggtacgtaaccggtggtaccggagttcgacgaacggtacgtaacgtggttacgtaccggtctaaaccgtcgttctagttccg

SEQ ID NO: 253012 - DNA, 792 bp, Homo sapiens
  misc_feature: GYAE6OF02F7QSU.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggcctcccaggtgccagatgtgccatccagatcgacccagtctccgtcctccctgtctgtatctgtagagaacaagtcaccatcacttggccggacaagtcaggactattaagaaatgaattacgccttggtttacagtacgaaacgaaaccgaagggaaaccgtccccgtaagtcctactagtaacttcgtagtcgtactcgacctacgtaccttaacttaacaaagtcggtaacgtccccaatacgtaagtacttacgacggtacggacgtagggtacgtacgttcgtacgggtccaacggtaccgttaccgtttacccaccttaccgtacccgacccggttacacgtacccggtacgtacccgtacgacgtacgttaccggtaaggttaaccgtttcgtttaacgttaaccgttaaacttttaccgtttaaccgtaacggtttaacccttaaacgtaaagttttacccttttacccgttttaaccccgtttaacccccgggttcccgggttaccgggttacccggtacccggggtaaccgggggttaaccccgtacggggttacggtaacggttaccgggttaacggaaacccggtaccggtttacggttacgggtttcggtaccgttaccccgtacggttactttcccggttacgtttcccg

SEQ ID NO: 253013 - DNA, 702 bp, Homo sapiens
  misc_feature: GYAE6OF02GTVFJ.43.60.F05.1.454.CMB.1.raw
  modified_base (218)..(218): a, c, t, g, unknown or other
  misc_feature (218)..(218): n is a, c, g, or t
  modified_base (270)..(270): a, c, t, g, unknown or other
  misc_feature (270)..(270): n is a, c, g, or t
  modified_base (363)..(363): a, c, t, g, unknown or other
  misc_feature (363)..(363): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcacatcacttgccggnaagtcaggactatagaatgaattagcctggttcagcaagaaaccagggaacnccctaagctcctgactctatcgctgcatcctaactttaacaaaacgtggactaccccaatacaaagtacttcgaagcggctaggtggactcgnggacctacgacgttcctttcaaccttcctaccgacccgttacgacgtccaacgtccctcggacgtagttaccgagttaaagttcgttttagaaccgtttaaactttacgtttaactttcgttaacgttaaaccgtaacggtttacttttaaccgttttaccctttaaccccgttacgggttaacccgggtttcccggaaacccggggtaaccggggtaacccggttaacggggttacggtaacggtttccgggttaaccggtaaacggtacccggttaaaccgttaggggttaccggccggtttaccgaacccgtaaccgttaaccgttccggtttacc

SEQ ID NO: 253014 - DNA, 596 bp, Homo sapiens
  misc_feature: GYAE6OF02GWFK1.43.60.F05.1.454.CMB.1.raw
  modified_base (413)..(413): a, c, t, g, unknown or other
  misc_feature (413)..(413): n is a, c, g, or t
  modified_base (555)..(555): a, c, t, g, unknown or other
  misc_feature (555)..(555): n is a, c, g, or t
  modified_base (585)..(585): a, c, t, g, unknown or other
  misc_feature (585)..(585): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctgtaggagaacaaagtcaccatcacttggccgggcaagtcaggactataagaaatgaaattgccttggttcagcaagaaaccgaagggaaacacccctaagcctactgatctatgctgcatcctaacttaacaaagtcgactaccatacaagtatacagtcggcgtagtcggatcgacggacactacgttactttccacttcctaccaccgtcacgtccagtccngactacgttcgtaacgtaagtttactttaacgtacttaacttatttaccgtattaactaacgttacgttacttttcccttaccgttaccgtaccggttaccggttccgtaaccgacggggtactacgggtgtacgtcggtanacggtcgtaacgtggtcgtacgcctaactnttcgtattacc

SEQ ID NO: 253015 - DNA, 658 bp, Homo sapiens
  misc_feature: GYAE6OF02JSQBG.43.60.F05.1.454.CMB.1.raw
  modified_base (138)..(138): a, c, t, g, unknown or other
  misc_feature (138)..(138): n is a, c, g, or t
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
  modified_base (513)..(513): a, c, t, g, unknown or other
  misc_feature (513)..(513): n is a, c, g, or t
  modified_base (522)..(522): a, c, t, g, unknown or other
  misc_feature (522)..(522): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtnccagatgtgccatccagatcgacccagtcctccgtaccctcctgtctagtactctggtagganacaagtccacatcacgttgaccggntaagtcacggacattaacggaattacggtattacgccgtttagggttaccaggtacaacggaaaccgaacgggaaacgtacccccttaaggccctaccttagtaacctcgaattccggactgactacctaccgtaacgtttaacaaaagtggacctccgtancgtaaatntacgngaccgtcgagtcgagtcgagtaccacngttaccttacgctccgttacncccgtgaaccngtaccgctgactcgtagtacgaagtagttttccgaattacgttacttaccgtnttacgtaanaacgttcttaccgtttacctacccgtacggtattcccggacggtaccggtaccgtaccgggtgaccgttcggtaccggtaagtaccgtacggttacctacgggttacttacggaccctacggttacctgttaccgg

SEQ ID NO: 253016 - DNA, 597 bp, Homo sapiens
  misc_feature: GYAE6OF02HEVZQ.43.60.F05.1.454.CMB.1.raw
  modified_base (220)..(220): a, c, t, g, unknown or other
  misc_feature (220)..(220): n is a, c, g, or t
  modified_base (361)..(361): a, c, t, g, unknown or other
  misc_feature (361)..(361): n is a, c, g, or t
  modified_base (409)..(409): a, c, t, g, unknown or other
  misc_feature (409)..(409): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggnaagtcaggacattagaatgaattagctgttcagcagaaacaggaagcccctaagctcctgatctatcgctgctactcctaactttaacaaaatcggacgtcccaataccaagtacttcgagcggcgagtggatcgtgcacngtctttcactcacaccgtcagccacgcctgactacgtactgtaagttnttttacgacttaacgtttacttacgtcgttaactacgtaaagttactttacctttaccgttaacccgttacgggttaaccgttccgggtaaccggtaaccggggtacccgacgggttggtacgttcgtaaccgtaaaggtaccgtaagttcggttaggtcgaccgtaacctcgttacgttcgttaccc

SEQ ID NO: 253017 - DNA, 681 bp, Homo sapiens
  misc_feature: GYAE6OF02IYE0V.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggtcaagtcaggacattagaaatgaattagcctggttcagcagaaaccgaggaaacgccctaagctcctgtatctatgctgctactaccactttaacaaaagtcggacgtcccaatacgaaagtacttacaggccggactagggttggaacgttcgtacgggtacaacgtaacgttccgttttaccaccgttcctacccgtacccgtacaacgtcccgacgtcccgtaggacctacggttccgtaaggtaaatttattttacggtaacccttaatttaactttacgtagttaccgtaaacgttaaacgtttccttttaacctttcccgttaacccggttccgggtaaccggtttaccggaccgggtaccggggtacccgtacgggtggttacgttacggaccgtaagggtacccgttaacggtcggttggtaccgtacccgtacctttacgtccgtttgttaccc

SEQ ID NO: 253018 - DNA, 556 bp, Homo sapiens
  misc_feature: GYAE6OF02GTS5C.43.60.F05.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (353)..(353): a, c, t, g, unknown or other
  misc_feature (353)..(353): n is a, c, g, or t
  modified_base (386)..(386): a, c, t, g, unknown or other
  misc_feature (386)..(386): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctgtagganacaaagtcaccatcacttgccggnaagtcaggacattagaaatgaattagcctggtttcagcagaaaccaggaacncccctaagctcctgatctatgctgccatcctaatttaacaaaatcggacgtacccatacgaatacttcagcgcagtgatcncgacacagtcttcactctcaccgtcacgtcacncctcgcagtctaggtaacttagttttcgacttaatttacttacgtagttacctaataacgttactttccttaccttacccgtcggtacgttccggacgtacggggacctacggtgacgtcgtactaacggtcgtaacgttgacggtctaccgacctaccgtagtcttacg

SEQ ID NO: 253019 - DNA, 552 bp, Homo sapiens
  misc_feature: GYAE6OF02F8AAZ.43.60.F05.1.454.CMB.1.raw
  modified_base (274)..(274): a, c, t, g, unknown or other
  misc_feature (274)..(274): n is a, c, g, or t
  modified_base (355)..(355): a, c, t, g, unknown or other
  misc_feature (355)..(355): n is a, c, g, or t
  modified_base (358)..(358): a, c, t, g, unknown or other
  misc_feature (358)..(358): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaacncccctaagcctcctgatctatgctgccatcctaactttaacaaaatggactcccatacaagattcagcgcagtgatctggnacngtctttcactctcacgtcagcacgcctgactagtcctagtaattntttgactaactttattactntacctaanagttacttctttaccgtaccgttacgggtaccgttcggccgtacgggacctacgggtggtacgttcgtacgaacggtacgaacgtttggttacggttcgaccgactacgttcgtgtttacc

SEQ ID NO: 253020 - DNA, 663 bp, Homo sapiens
  misc_feature: GYAE6OF02H1YWY.43.60.F05.1.454.CMB.1.raw
  modified_base (219)..(219): a, c, t, g, unknown or other
  misc_feature (219)..(219): n is a, c, g, or t
  modified_base (253)..(253): a, c, t, g, unknown or other
  misc_feature (253)..(253): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
tcagtgtgagtagtcacgaccggtgctcgatttagtacgtcatcagggaaagggggagtcagacccactcaggacacagcatggacatgagggtccccgcccagctcctggggctccctgctgctctggctcccaggtgccagatgtgccatccagatgaccagtcctccgtcctccctgtctgtatctgtaggagacaagtcacatcacttgccgggnaagtcaggacattaagaatgaattagcttagttnagcaacgaaacgagggaacgacccgtaanctctagctactancgctgacatacctaacttaanaaagttacggtactaccaactactaacgtacgttacgacggtcggacgtaggttacggtatccgtacggacaacgtacgttaccttttccaccgtttccctacctacccgtctacgtccgaacgtccgtagtcgtacgttactagtaagtttacttacgtacttaactttagttacgttacgttactaacgttaacgttacttttacgttacccgtttaacccgtaccgggttaccgttccgggtaccggtaacgggggtacccttaggggtcgtacggttacgtacgaaccggtgtaaccgttggaccggttcgtacggaccgtacctacgtttcgtagttacccg

SEQ ID NO: 253021 - DNA, 570 bp, Homo sapiens
  misc_feature: GYAE6OF02F5IPN.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctgttcagcaagaaaccaggaagccctaagctccgtgatcatgctgcatctacttaacaaaagtgacgtacccatacaagattacagcgcagtcggatcgtagcacagtcctttcgactcactacctcagcacgtctgacagtctagaattagtttcactattagttactagtactaacaagttctttacttaccttacccgttggtaccgttccggaccgaacggggtaccgtacgggttacggtacgttcgtaaccgtaaggtaccggtaacgttcgggttacggttcgaacccgttacgtactttccggacgttttacccg

SEQ ID NO: 253022 - DNA, 697 bp, Homo sapiens
  misc_feature: GYAE6OF02GZKU8.43.60.F05.1.454.CMB.1.raw
  modified_base (442)..(442): a, c, t, g, unknown or other
  misc_feature (442)..(442): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatcgacccagtcctccgtcctccctgtctgtatctgtaggagacaagtcaccatctacttcggccggacaagtcaaggactaagttaagaaatagtaattacgccgttggtttacagacgaacgaaaaccgaaggggaaaccgacccctaagtcctacctagtacttactagtcgacctgactacttaccgtaactttaaacaaagtcgaacgtccatacaagtactacgacggcgacgtaggtaggactcgagtacactagtccttacaccttcctaccacccgtnacgtccgacgtacctcgactagttacgtagtaaacgtttgtttacgactttaaacgttcgttaacccgttattaacccgttaacgttaacgtttaccttttacccgttaacccgttacccggtttacgggtaacccggtttaccgggacccgggttaacgggggtaccctacggggttagtaaccggtaggtacctaaacgggtcgttaacgtgggtacggtaccgttacgaaccttacctacgttccttaccgg

SEQ ID NO: 253023 - DNA, 642 bp, Homo sapiens
  misc_feature: GYAE6OF02JI22R.43.60.F05.1.454.CMB.1.raw
  modified_base (213)..(213): a, c, t, g, unknown or other
  misc_feature (213)..(213): n is a, c, g, or t
  modified_base (588)..(588): a, c, t, g, unknown or other
  misc_feature (588)..(588): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctccaggtgccagatgtgccatccagatgacccagtctccgtcctcctgtctgtatctgtagagacaagtcacatcactgccggnaagtcagcatagaatgaatagcctggtttcagcaagaaaccgaggaaacgacccctaagctcctgactctatgacctgctactaccaactttaacaaaagtcggaacgtaccctagtactaaacgtagtttacacggtaccggcgtaaggtggtaacgttccgtgggtaccaacgtacgtacccgtttttccaacccgtttcctacccgtaaccccgttacgaaccgtccgtaccggtacccttacggaccttacggttaccgtaacggtaaggtttacgtttttacgaccgttaaacctttcgttaacgtacgttactactaacgtatttccttaccttaccgtcgtacgtcgtacgacgggtaccgacgtggngtcgtacgaagtaccgtaacgtggttcgacgtcgtaccgtacctacgttctacg

SEQ ID NO: 253024 - DNA, 567 bp, Homo sapiens
  misc_feature: GYAE6OF02F2JRA.43.60.F05.1.454.CMB.1.raw
  modified_base (495)..(495): a, c, t, g, unknown or other
  misc_feature (495)..(495): n is a, c, g, or t
  modified_base (508)..(508): a, c, t, g, unknown or other
  misc_feature (508)..(508): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
  modified_base (544)..(544): a, c, t, g, unknown or other
  misc_feature (544)..(544): n is a, c, g, or t
  modified_base (546)..(548): a, c, t, g, unknown or other
  misc_feature (546)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (563)..(564): a, c, t, g, unknown or other
  misc_feature (563)..(564): n is a, c, g, or t
tcagtgtgagtagtcacgaccggtgctcgatttagtacgtcatcagggaaagggggctggagtcgggtggccaatataaggaaagatggagaaaagatacactacatggactctgtggagggccgattcaccatctccagagacaacgccaagagttcgctgtttctccaaatgagtagtctgagagtcgaggacacggctgtgtattattgtgcgagagactcgacgcccctccaaagtgggactctactatgatgctatttgattagtttggggaccgtaggggtacaggtggtcacgtgtctcttcacgccctccgaccgaacgggcccaagtccggtccttccccgtgggccgtacccgtgcctaccgaggtccgcctacccgtaccggagacgtacgacgacggccggtcccgtgggacctcgcccgttaggtacccgaaacggtccttaacgtccctactacctaccaccgactaggacggcggtacgnggaccaagggccnctagtancgatcgatngtacncgnacancgatacgngnnntntngtncgngngcnntcg

SEQ ID NO: 253025 - DNA, 604 bp, Homo sapiens
  misc_feature: GYAE6OF02HHO0Q.43.60.F05.1.454.CMB.1.raw
  modified_base (194)..(194): a, c, t, g, unknown or other
  misc_feature (194)..(194): n is a, c, g, or t
  modified_base (379)..(379): a, c, t, g, unknown or other
  misc_feature (379)..(379): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaganacaaagtcacatcacttggccggcaagtcaggactattagaaatgaattagcctggtttcagcaagaaaccgagggaaacgcccctaagctcctgtatctatgctgcactccaactttacaaatgacgtccatacaagattcgagcgcaagtgatcgtagactacagtctttacacttcgtaccncgtacgagtaccacgtcctgcctagtcgtagtaacgttattttacgacttaactttaacttactacgttactaactaagttacttaccgtttaccttacccgtcggttaacccgttcgggaccgtacggggtacccgtacgggtcggtacgttcggtacctaagggtaaccttacgtacgggtttgttaccggtacctaaccgtacgtttccgtcgtttaacccg

SEQ ID NO: 253026 - DNA, 540 bp, Homo sapiens
  misc_feature: GYAE6OF02GQDNT.43.60.F05.1.454.CMB.1.raw
  modified_base (198)..(198): a, c, t, g, unknown or other
  misc_feature (198)..(198): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
  modified_base (411)..(411): a, c, t, g, unknown or other
  misc_feature (411)..(411): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtcgccatccagatcgacccagtcctccgtcctccctgtctgtatctgtagganacaagtcaccatcacttcgccggacaagtcaggacagttagaaatgaattgccgttggtttcagcaagaaaccgagggaacnccctaagctcctgatctatcgcngcactcctaactttaacaaaatggactccatacaagtatacgagcgacaggtgatcgngcacacgtcttcnctctacacgtcagctacgcctgctagtctagtaattntttcgacttacttatctgtactactaagtctttcttacctaccgtcgtaccgttcggaccgtacgggaccgtacgggtagtacgtcgtacgaacgtcgtaacgtgtacgctgaccgtactgttcttacg

SEQ ID NO: 253027 - DNA, 798 bp, Homo sapiens
  misc_feature: GYAE6OF02G9QJR.43.60.F05.1.454.CMB.1.raw
  modified_base (217)..(217): a, c, t, g, unknown or other
  misc_feature (217)..(217): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccgaggtgccagatgtgccatccagatcgacccagtcctccgtcctcctgtctgtatctgtagagacaagtcacatcactgccggnaagtcaggacattagaatgtaattacgtccttggttacagtacgaacgaaaccggaagggaaaccgtacccctaagtcctacctagactactagtcgctcgctactcctaaactttaacaaagtcgactaccctaatacgaagtactacgacgccggtactaggtcgacgtcgtacggactacgtacgttccttacctaccttccgtaccgtacccgtacgacgacctaccggtccttacgtacgtacgggttaccctaagggtaaacttttaacgtttaccgtaaacctttaaacgtttcgtttttaaccggtacgttaaccttaaacggtttaaaccgtttaccctttttacccggttttaaacccgttaacccccggggttttaaccgggttacccgggtttaccccgggtaacccgggggtaaacccggggtttaccccgggaacccgggggtttttgggaaacccgggtttccggttaaccggggtaaaccggttaccgttaacggggtttcccgggttacggggttaccgaacccgtttaaccgttaccggtttacccggtttcggttaaccccg

SEQ ID NO: 253028 - DNA, 694 bp, Homo sapiens
  misc_feature: GYAE6OF02IPO23.43.60.F05.1.454.CMB.1.raw
  modified_base (139)..(139): a, c, t, g, unknown or other
  misc_feature (139)..(139): n is a, c, g, or t
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
tcagtgtgagtagtcacgaccggtgctcgatttagtacgtcatcagggaaagggggagtcagacccactcaggacacagcagtggacatggagggtccccgctcagctccgtggggctcctgctgctctggctccaggngccagatgtgcccatccagactcgacccagtcctccgtcctcccgtgtctagtatcgtgtagganactaagtcaccatcacttggccgganaaggtcaggactattagaaatcgtaaatggacctggttccaggacagaacgagggaaacnccccgaagcctacctgatcgtangtcngctactccgtaatttaacaaaagtcgtaacgtccaatcgaagtactcgaacgcgggacctaaggttgaagttccgtcgcgacctaggttcccttcacgctttacccgacggtctacgtaccagtttccccgaggtactaaggttcccgtaagtaaagtttaaacggttttcgaaaccctttaaagttttcttaacccgggttttaactaccgttaaaaccgtaactttaccggtttacccctttaccgttaacccggttacggttacccgggttaccggaacccggtaaccgggtacgtaaccgggtggtaccggtaacggtaaccgaacggtaaccgtacgcggttacggactaccgaccgtccgtactacggtcc

SEQ ID NO: 253029 - DNA, 635 bp, Homo sapiens
  misc_feature: GYAE6OF02IZVNK.43.60.F05.1.454.CMB.1.raw
tcagtgtgagtagtcacgaccggtgctcgatttagtacgtcatcagggaaagggggagtcgagacccactcaggacacagcatggacatgagggtccccgctcagctcctggggctcctgctgctctggctcccaggtgccaggatgtgccatccagatgacccagtctccgtcctccctgtctgtatctgtaggagacaaagtcaccatcacttgccgggcaagtcaaggacagttagaaatgaattagctggttcagcaagaaaccaggaaacgccctaagcctacctagatacgttatggctgactactacctaactttaacaaaagttacggagtaccccatacaagtatcctagcggcaggttgaatcgtaggacaacgtacgtcttttacaaccttctacctacccgtacacgtccgacgtccctaggtcaggttacctaggaaagttgtttttacgacttaaccgtttaactttactcgttactaacttaacgtatttaccgtttacctttacccgtacggttaaccgttcggtcccggtaacgggtaccgtacggtacggtacggtaggttaccgtaagacccgaacggtacgttacggccgttacgacctacgtccgttagttccc

SEQ ID NO: 253030 - DNA, 646 bp, Homo sapiens
  misc_feature: GYAE6OF02GW6OY.43.60.F05.1.454.CMB.1.raw
  modified_base (288)..(288): a, c, t, g, unknown or other
  misc_feature (288)..(288): n is a, c, g, or t
  modified_base (636)..(636): a, c, t, g, unknown or other
  misc_feature (636)..(636): n is a, c, g, or t
tcagtgtgagtagtcacgaccggtgctcgatttagtacgtcatcagggaaagggggagtcagacccactcaggacacagcatggacatgagggtccccgctcagctccgtggggctcctgctgctctggctcccaggtgccagatgtgccatccagatcgacccagtcctccgtccctccctgtctgtatctggtagagacaagtcacatcacttcgccggacagtcagactatagaatagtaacttagccttggttacagactaaacggaaaccgaacgggaaaccnccccgtaaagtccttaccgtagtacttcgtagtcgcttagcctaacttacccttaactttaaaacaaaggttcggtaacctaccctaatacgtaaacgtacgttacgacggtacggagtaacggtggaacttcggtacggactacgccgttacctttaccgacccttacctacccgtaccgtacaccggtcgaccgtccgtacgactacgtacgtacgttaattcgtttacgaacttaatacgttactgtactaagtacttctttaccttcgtacccggtagtacgtccggacgacgggtacctcgggtgtaactcgtacgtagacttagtggttcgacgtccacgtntcgtagttcc

SEQ ID NO: 253031 - DNA, 792 bp, Homo sapiens
  misc_feature: GYAE6OF02G84RJ.43.60.F05.1.454.CMB.1.raw
  modified_base (698)..(698): a, c, t, g, unknown or other
  misc_feature (698)..(698): n is a, c, g, or t
  modified_base (709)..(709): a, c, t, g, unknown or other
  misc_feature (709)..(709): n is a, c, g, or t
tcagtgtgagtagtcacgaccggtgctcgatttagtacgtcatcagggaaagggggagtcagacccactcaggacacagcatggacatgagggtccccgctcagctccgtggggctccgtgctgctctcggctcccgaggtcgccagatgtgccatccagatcgacccagtcctccgtcctccctgtctgtatctggtaggagaacaagtccactactctacgttcggaccggacaaggtcgaggactaagtaagaagtagaacttcgtccgttgttacgagacgaaacgaaaccggaacgggaaccgcccctaagcctaccgtagtaacttcgtaacgtcgtaccgtcgaccttaacctaacccttaaacgtttaaaaccgaaagttccggtaacccgtaccctaacgtaactaacggttaccttacggacggtacgggaccgttagggtacgtaaccgttcggtacggtaacctacgttaccgttacctttacccgtacccgtttccgtaacccggtaaccgtcgtaaaccggctaccggtacgtacggaccgttaacgtaggttacgttaagtttctttaaccgtaaacttttaacgttcgttaactggttaaaccctaaggttactttccgttttacccttaccggttaacccggtaccggttcgggacccggtaacgggaccgggttacccgnggggtttaacncggttacggtaaaccaacggggttaacctacggttcgggtttaaccgccgtaacgttaccggtttacttcgtccggttaaccc

SEQ ID NO: 253032 - DNA, 826 bp, Homo sapiens
  misc_feature: GYAE6OF02I36KS.43.60.F05.1.454.CMB.1.raw
tcagtgtgagtagtcacgaccggtgctcgatttagtacgtcatcagggaaagggggagtcagacccactcaggacacagcatggacatggagggtccccgctcagcctccgtggggcctcctgctgctctggcctcccaggtgccagatgtcgccatccagatcgacccagtcctcccgtcctccctgtctgtatcgtagtaggaagaacaacgtcaccatactacgtcggcggtacaagtcgacggactaagttaagaatagtaattcgacgttggttacaagacgtaaacgaaaccggaaacgggaaccgtaccccgtaagcctaacgtcgaataccgtactcgtcgtcgtactaaccttaccttaaactttaaaacaaaacggtcgggtaacctaccccgtaaactaacgtaaacgtaccttaccggaagggtaccggtaggtacgggtacgtaacgtcggttaccgaacttaccgtaacgtttccttaccgtacccttacctacccggtaacccgacgaacggttcccgtaacggtccctagggtaccgcgtttaccgttaacggttaatttaccggtttactaaacctttaaccgtttaagtttaccgtacgtttacccgttaaagttaacttttccgttttaaccctttacccgtttaccggtccggttttacccggtccggtaaccccggggttaacggggaccccttacgggggttaacgtaccggtttaacccgggtaagtaacccggttaagttaaccgggtgggtttaacgtttaccggccgttaacgttaccggtttacttaccggttttaccc

SEQ ID NO: 253033 - DNA, 687 bp, Homo sapiens
  misc_feature: GYAE6OF02IJW0T.43.60.F05.1.454.CMB.1.raw
tcagtgtgagtagtcacgaccggtgctcgatttagtacgtcatcagggaaagggggagtcagacccactcaggacacagcatggacatgagggtccccgctcagctccgtggggctcctgctgctcgtggctccgaggtcgccagatgtcgccataccagatcgaccagtcctccgtcctcctgtctgtatcgtaggtagagacaacgtcacatctacgtcggccggtacgaagtcgaggactataagaactagtaacgtgaccgttggttacagaccgaacgaacgtaaggacctaccgtaagtcctacgtcgactactacgtcggtcctacgactacctaacgtaaactttaaacgtaaacggtacggtaccgtaacccaagtaacgtaaacgtcgttactaccgggacggtagttacggacggttaacgtaccggtgtacccggaaacttgtacccttttaacgtcccgtacccttaacggtacccgtaccgtaccggaccgacggttcgtaacgtacgtacggttacgtaacgtacgttaacgttacgtaacttaagttctacgtacttaaacgtacgttaatccttccgtttaccgtccgttacgtcggtcgacggttaccgacgtacggtagtctaacgctaggacgtacttcggcgttacgctaccgcgtactacggttc

SEQ ID NO: 253034 - DNA, 750 bp, Homo sapiens
  misc_feature: GYAE6OF02HYLLA.43.60.F05.1.454.CMB.1.raw
  modified_base (224)..(224): a, c, t, g, unknown or other
  misc_feature (224)..(224): n is a, c, g, or t
  modified_base (371)..(371): a, c, t, g, unknown or other
  misc_feature (371)..(371): n is a, c, g, or t
  modified_base (402)..(402): a, c, t, g, unknown or other
  misc_feature (402)..(402): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatcgacccagtcctccgtcctccctgtctgtatctggtaggagacaaagtcaccatcacttggccgganaagtcaaggactattaagaaatgaattagccttggtttcagcagaaaaccgagggaaacgccccctaagctcctagactctatcgctaggccattcctaactttacaaaaagttcggactacccatacaagactttcgagtaccggntacggttagacgttacgacggcgtaaaccgngtcccttttacgtacccttacgttaccgtacccggtactaaccggtacctaaccggtcccgttaggaccctacgggttacccgttaaggtaactttacgtttttacggaccctttaaactttttaaaccgtaaccgtttctaaccgtttaaacctaacgggtttaccttttaccgtttccctttaacgttccccggttaccgggaaccggttttccgggaacccggggttaacggggaaccccgggttacgggtcggttaacggttccgggtacgtaaaccgggtaaccgttaaacggtttcgggttaccggtaccgtaggggtacccccttacgtacccgttaacgg

SEQ ID NO: 253035 - DNA, 784 bp, Homo sapiens
  misc_feature: GYAE6OF02G86MK.43.60.F05.1.454.CMB.1.raw
  modified_base (224)..(224): a, c, t, g, unknown or other
  misc_feature (224)..(224): n is a, c, g, or t
  modified_base (772)..(772): a, c, t, g, unknown or other
  misc_feature (772)..(772): n is a, c, g, or t
tcagtgtgagtagtcacgaccggtgctcgatttagtacgtcatcagggaaagggggagtcagacccactcacggacacagcatggacatgagggtcccgctcagctcctggggctcctgctgctctggctcccaggtgccaggatgtgccatccagatcgacccagtctccgtcctcccgtgtcctgtatctgtaggagacaagtcaccatcacttgccggganaagtcaggacagttaagaatggaactttacggccttggttacacgcaagaaaccgagggaaacgcccctaagccgtcctaggtactacgtagttcggcctggacctacgttaccctaagttttaaaccaaaaggttcgggtacctacccgaaatacgtaaaggtacttaccgacggtaccggtacgtagggtttacggtacgttccggttagggtacccgaaaccgttacggtacccgtttttaccgaacccgttccgtaacccgtacccggttaccgtaacggtaccgtaccgggtcctacggtaccgttaacggttaccgttaacgggtaacgtttaacggttttttcgaaacccgtttaaacgtttaacgtttaccggttaacggtttaaacccttacgtaaaccgtttaccgtttaccctttacccggtttaccgtaacccgggtttccggttaccgggtaacccgtaaccggggtacccgtacggggttcgtacggttagaccgttacggtacgtacgttacggttaggtaccgtactaccgnttccgtagttcc

SEQ ID NO: 253036 - DNA, 656 bp, Homo sapiens
  misc_feature: GYAE6OF02IJVAJ.43.60.F05.1.454.CMB.1.raw
  modified_base (199)..(199): a, c, t, g, unknown or other
  misc_feature (199)..(199): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccgaggtcgccagatgtgccatccagatcgacccagtcctccgtcctccctgtctgtatctgtagganacaagtcacatcacttggaccggcaagtccagactataagaatgaattgccttgttcagcaagaaccgaggaacnccctaagcctcctgactctagtcnctgcaattcctaactttaaacgaaagtcggtaacctaccagttaacaagtattacgaggacgcgtaggtgacgttcgaggacctaactcgtccctttaccacgttacctccgtaccgtacctacgaccgtacctccgtcgacgttacgttccgtaaggtaattacgttttacaaccgttaactttacgttactacgttacttaacgtacgttaccttttaccgttccttaccggttacggtacccgttaccggacccgggtacgggaccgtacgggtacggttacgtacggtaacggacggtaaccgtacggttacgttacgggtcctaccgtaccggtacgttccgtacgttacccg

SEQ ID NO: 253037 - DNA, 899 bp, Homo sapiens
  misc_feature: GYAE6OF02G99N1.43.60.F05.1.454.CMB.1.raw
tcagtgtgagtagtcacgaccggtgctcgatttagtacgtcatcagggaaagggggagtcagacccactcaggacacagcatggacatgagggtccccgctcagctcctggggctcctgctgctctggcctcccaggtcgccagatgtgccatccagatcgacccagtcctcccgtcctccctgtctgtatctagtagagacaacgtcactatctacgtcggccgggacaagtcgaggactaagttaagaagtagtaattacgtccgttggttaccagacgaaacgaaaccgaacgggaaaccaccccgtaagtcctaccgtacgacttactacgtacgtctacgactaccttaccttaaaccgtttaaacaaaacggtcggtaaccgttaccctaagtaacgtaaacgtacgttaccgacgggtacgtacggtacgggtaggtacgttaccgtacggacctaaacgtaccggtttacctttaccgtaaccgtttcccgaacccgttaccgtaacccggtacggacccggtaaccgttcccgttacggtaccttaacggttaccgtaaacggttaacgttttacgttttaccggtaaacctttaaaccggtttttctttaaccggtttaccgttaacgtttaaaacggttaaacctttacccggttttttaccccttttaacccccggtttacccccggtttaacgggtttaaccccgggggttaccccgggtaacccgggggtaaaccggggttaccccgggttttaggggaaccgggtttaccggtaacggtaaccccggttaaacgggtaaccgtttaacccggggttcgtttaccggggttacccgtaaacccggttaacccgtttacggtttacgttacccgttttaaccccgg

SEQ ID NO: 253038 - DNA, 683 bp, Homo sapiens
  misc_feature: GYAE6OF02HBBDS.43.60.F05.1.454.CMB.1.raw
  modified_base (131)..(131): a, c, t, g, unknown or other
  misc_feature (131)..(131): n is a, c, g, or t
  modified_base (162)..(162): a, c, t, g, unknown or other
  misc_feature (162)..(162): n is a, c, g, or t
  modified_base (214)..(214): a, c, t, g, unknown or other
  misc_feature (214)..(214): n is a, c, g, or t
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
  modified_base (412)..(412): a, c, t, g, unknown or other
  misc_feature (412)..(412): n is a, c, g, or t
  modified_base (614)..(614): a, c, t, g, unknown or other
  misc_feature (614)..(614): n is a, c, g, or t
tcagtgtgagtagtcacgaccggtgctcgatttagtacgtcatcaggggaaagggggagtcagacccactcaggacacagcatggacatggacgggtccccgctcagctccgtggggcctcctgctgctcnggcctccgagggtgcctaagatgtcgcctanaccagagtcaccacgtcctcctccttcctgtctatatcgtagtaggacgaanaataccacatctacgtcgacggacacgtcaaggtactaagtaaagganacgtattagtcctaggttcanacgaaggaacgaggtaaacncaacgtcgactacgntataacggctcacgctactaaccgtaacttaacaaagtccgtactaccgtaacagtaatacgtgaagcgacggatagcttagcgactacgactnttacccagtaccgtaccgtcgacgttaacaccgtacggtacacgtaaccgtaacgtacggtagttaaaggttacttagttaaacgttaacctttaagttaacttactaaacgaacctaacggttaacctttccgtaacgtttacccgtaacggtacccgttcgggacccggtaacgggacccgtacgggttagaaccgttanaaccgggagtaacccggtaacgggttacgttagggttaccaactttaacgcgttacttacgttaacccg

SEQ ID NO: 253039 - DNA, 622 bp, Homo sapiens
  misc_feature: GYAE6OF02F0K4S.43.60.F05.1.454.CMB.1.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (423)..(423): a, c, t, g, unknown or other
  misc_feature (423)..(423): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggcctcccgaggtgccagatgtagccatccagatgacccagtctccgtcctccctgtctgtatctgtaganacaagtcacatcacttcgccgggacaagtcaggactattaacgaaatgaattgccttggtttcagcaagaaaaccagggaaacnccccgtaaagcctcctagactctatcgctcgctattacctaactttaacaaaacgttggaccgttaccatacaaagtctacgagccganaggtagactcgnggactactacgtctttaccacttccacctaccgtcacgacncgtacctggacagtctacgtaagtacttttgacttaactttactactcgttactaacgtaagttctttaccttaccgttacccgagggttaaccggttcccggaacgtacccggggtactacgggttcgtacgtacgtaccggtaaacgtacggttaaccctgggttaggcccgttacgccgtaacttcgtcttacccg

SEQ ID NO: 253040 - DNA, 576 bp, Homo sapiens
  misc_feature: GYAE6OF02FIZHT.43.60.F05.1.454.CMB.1.raw
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctgtaggagacaaagtcacatcacttgccggnaagtcaggacattagaatgaattagcctggtttcagtcaagaaaccagggaaacncccctaagcctctgatctatgctgcatccaactttacaaatggagtcccatcaagtattcagcgcgagtggatcgtggacacgagtctttcactctacacgtctagcacgcctgaccagtcctagtaacgtattttcgacttaactttacttacgtgttactaacgaagttactttctttaaccttacccggttacgaccggtttcggaccgtacggggaccctacgggtaggtacttcggtacaaacggtccgtaacgttaggttcgggttacgacctaaccgtacttacgttacgttacg

SEQ ID NO: 253041 - DNA, 821 bp, Homo sapiens
  misc_feature: GYAE6OF02I4ZCV.43.60.F05.1.454.CMB.1.raw
tcagtgtgagtagtcacgaccggtgctcgatttagtacgtcatcagggaaagggggagtcagacccactcaggacacagcatggacatgagggtccccgctcagcctccgtggggctcctgctgctctggcctccgaggtcgaccagatcgtgccatccgaagatcgacccacgtcctcccgtcctaccctgttactcgttaatcgttaggtaaggaacgaactaaagtcccaactagtcctaacgttcgggaccgggtactaaaggtaccaaggtaactaagttaaaggtaaatacgaaacttacggtctttaacggttacgaacgaacgtaaacggaaaccgtaaacgggaaaccgtaccccgtaaacgtaccgttaccgtacggtaataccgtatcggacttacggaccttactaccgttaacttaaacgtaaacgtcgtacgtaccaagtacgaactacttacgacgtacggacgtaggtacgacgtacgtacgaaccgtactcggttaccttcgtaaccttcgtaacccttaccgaagtaccgtacaacggttaccgtagtcgtaacgtacggtaacgttaacgtttaacgttacgtaaccttaaacgtttaattacccgttaacgtaacgtaacgtttaaacgtaccgttttacccttaaccggttacccggttacggtttaaccgttccggaacccggttacgggtacccgggtacgttaccggtaacggtacgtaacccgttaaggtaacccctaagggttacttacggggtcttaacccgacccggtttacgttaaccgttgtttaacccgg

SEQ ID NO: 253042 - DNA, 712 bp, Homo sapiens
  misc_feature: GYAE6OF02III4Z.43.60.F05.1.454.CMB.1.raw
  modified_base (159)..(159): a, c, t, g, unknown or other
  misc_feature (159)..(159): n is a, c, g, or t
  modified_base (199)..(199): a, c, t, g, unknown or other
  misc_feature (199)..(199): n is a, c, g, or t
  modified_base (290)..(290): a, c, t, g, unknown or other
  misc_feature (290)..(290): n is a, c, g, or t
tcagtgtgagtagtcacgaccggtgctcgatttagtacgtcatcagggaaaggggggagtcagacccactcaggacacagcatggacatgagggtccccgctcagctccgtggggctcctgctgctctggctcccaggtcgccagatgtgccatccagntcgacccagtctccgtcctcctgtctgtactctgtagganaacaaacgtcaccatcacttcggcggacaagtcaggactattaagaatgaattagccttggtttcagtcgaacgaaaccgaaggggaaacncccctaaggcctccgtagacttctatcgtcgtgactacgtcctaactttaaacaaaacgtggaaccgtccctatacgaacgtacttccgaggccggatacggtggacttcgcggaccacgtagttcctttacaccgttcctaaccgccgttaacgacggtcaacgtcctacggacgtaccgtcggttaaacgaaagttttcgtttacgaactttaaccgtttagttaccgtacgttaacgtaaaccgttaacgtttacgtttcccttttacccggtttaaccgttcccggtttaaacccgggttcggtacccgggtaaccggggtaaccgtacgggttacggaacgttacgttacccggaaggtaaccgtaacggtgggtttaccggtcgaacccgtaacgtacttaccgttcgtttaaccg

SEQ ID NO: 253043 - DNA, 747 bp, Homo sapiens
  misc_feature: GYAE6OF02F6N2T.43.60.F05.1.454.CMB.1.raw
  modified_base (228)..(228): a, c, t, g, unknown or other
  misc_feature (228)..(228): n is a, c, g, or t
  modified_base (288)..(288): a, c, t, g, unknown or other
  misc_feature (288)..(288): n is a, c, g, or t
  modified_base (333)..(333): a, c, t, g, unknown or other
  misc_feature (333)..(333): n is a, c, g, or t
  modified_base (450)..(450): a, c, t, g, unknown or other
  misc_feature (450)..(450): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtcctccgtcctccctgtctgtatctaggtaggagaacaaagtccaacctatcacgttgccgganaagtcaggactattaagaaatgaattagccgttggttacagacaacgaaaccaggaaacncccctaagcctcctgactctatcgctgacatacctaactttaaanaaacgtggaccttccaagttacaaaggttactacgaacggcgggtactaacgggttaggacttacggtacgaataaccgtaggttcctttaccacctcctaccgtaaccgtcgaacnccgtacgtccgtagtacctacgttacgtaacgttaagttacttttacggtaaccttaacgttttaacgttaccgttacgttaacctaacgttaagttaccttttacccttttacccggtttaacccgttccggggttaaccgttaccgggacccggttaacggggggtaacccgttacgggttacgggtaaccgttacgggttaacccgtaaacggtaccgggtttaaacccgttgggttaccgggtttaaccgggtacccttaaccggttacgtttacccgtttacggttaacccc

SEQ ID NO: 253044 - DNA, 623 bp, Homo sapiens
  misc_feature: GYAE6OF02FXAWW.43.60.F05.1.454.CMB.1.raw
  modified_base (100)..(100): a, c, t, g, unknown or other
  misc_feature (100)..(100): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
tcagtgtgagtagtcacgaccggtgctcgatttagtacgtcatcagggaaagggggagtcagacccactcaggacacagcatggacatgagggtccccgntcagctcctggggctcctgctgctctggcctccaggtgccagatgtgccatccagatgacccagtcctccgtcctccctgtctgtatctgtaggagacaagtcacatcacgtggccggacaagtcaggactattaagaatgaattgccttggttcagcaagaaaccgagggaacnccctaagctctnatctatgctgcatcctacttacaaatggacgtccatacaagtacttacgacgtcggactaggtaggacttcgacggctaacgtacgtcctttaccaccttacctaccgtaccgtcaacgtcacgtcctcgaccgtgttaccgtagtaacgttactttacggacttaacgtttacgttaccttagttaccgtaacttaacgtacttttccgttaccgtttaccccgtgggtaacccgtttccggacccgtacgggtaccgtacggtaggtacgtaggtaccgtaagtacccgtaagttggtacggttcaccggtactttcgtttccgttcttaaccg

SEQ ID NO: 253045 - DNA, 733 bp, Homo sapiens
  misc_feature: GYAE6OF02IAH76.43.60.F05.1.454.CMB.1.raw
  modified_base (257)..(257): a, c, t, g, unknown or other
  misc_feature (257)..(257): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
tcagtgtgagtagtcacgaccggtgctcgatttagtacgtcatcaggggaaagggggagtcagacccactcaggacacagcatggacatggacgggtccccgctcagcctccgtggggctcctgctcgctctcggcctccgaggtcgccaggtatgtcgcctatccgaagtactcggacctcgttcctcccgtccctccgtgtctgtactcgtaggacggacaacgtaactccacgtactctacgttcggaccgganaacggcaaacggataaagttaagaatacggaacttcggtccgttagttcgaagaccgaaacggaaccggaaggtaaaccgacccgtanccgttacctgactcgtactcgtccntcctaacgttacctaaacgttaacgaaaggtcgacccgttacaagaacgtaagtactcgggacgtcgagttacggcggtacgcgtcgacttactagtttcctcctttattccgactcgacgtggccttacgccgtacgtaccgtagttacgtagttaacggttagtttacttaaccgtttacttaacttacgtaactaccgtaacttaaacttccttttacccgtacccgtttaacccggtggtaaccccttgggaacccggtgggggttaaccccgagggtgttaaccgacggttaacgacccggttacgacgggtttacgggctaacccggtccgtaactaacccgtagtaccggtttacc

SEQ ID NO: 253046 - DNA, 718 bp, Homo sapiens
  misc_feature: GYAE6OF02GE6W3.43.60.F05.1.454.CMB.1.raw
  modified_base (453)..(453): a, c, t, g, unknown or other
  misc_feature (453)..(453): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggctcccgaggtgccagatgtgccatccagatcgaccctagtcctccgtcctccctgtctgtatctgaggagaacaaatcacatctactggccggacagcgagactaattaagaaatagtaattacgtccgttggtttacgagacaaacgaaaccgaagggaaaccgaccccgtaacgcctaccgtgacttcgtagtcgcttcgactactaccgtaacttaacaaagtacgtacgtaccatactaacgtctcgaacggcggacgtaggtacgacgtcgtacgtactacgtacgttacctttaccgaccgttcctaccgtacccgtanacggtcgaccgtccgtagaccgtacgttacgtagttaagtttaacgtttccgtaactttaacctttattaccgttagttaaacccttaagtaaccttttcctttttacccggttaaccctttacccggttccgggttaaacccggtccccgggttaacggacccgggggtttaaccgacggggtttaacggaacggtcggtaaccgaccgggtacgtaacggtttcggcgttaccgtcgaccgtaacccgtacgttccgtttacg

SEQ ID NO: 253047 - DNA, 663 bp, Homo sapiens
  misc_feature: GYAE6OF02GTWNE.43.60.F05.1.454.CMB.1.raw
  modified_base (197)..(197): a, c, t, g, unknown or other
  misc_feature (197)..(197): n is a, c, g, or t
  modified_base (388)..(388): a, c, t, g, unknown or other
  misc_feature (388)..(388): n is a, c, g, or t
tcagtgtgagtagtcacgaccggtgctcgatttagtacgtcatcagggaaagggggagtcagacccactcaggacacagcatggacatgagggtccccgctcagctcctggggctcctgctgctctggcctcccaggtgccagatgtgccatccagatgacccagtcctccgtcctccctgtctgtatctgtagganacaaagtcaccatcacttgccggcaagtcaggacattagaaatgaattagccttggttcagacaagaaaccgagggaaacgccctaagctcctagacttacgtatgctcgctacttaccctaactttaacaaaagtcggtactacccattacaaagtacttacgacggtcggtactaggtcggaacttcgnggaccagtacgttcctttaccacttctaccgtacccgtcacgtcaacggtcctgacctacgtactagtagttagttttagaccttaaacgtttacgttccttacggtaacttaaacgtaacgtttacttttcccgtttaacccggtttaccttacccgggttaacgttcccgggaaccgtaccgggtaaccggtaccgggtaggtaccgtgtaaccgtaacgggtataccggttggtacggttagcccttaaccgtgttacccgttgtttacccg

SEQ ID NO: 253048 - DNA, 764 bp, Homo sapiens
  misc_feature: GYAE6OF02INBQ9.43.60.F05.1.454.CMB.1.raw
  modified_base (204)..(204): a, c, t, g, unknown or other
  misc_feature (204)..(204): n is a, c, g, or t
  modified_base (420)..(420): a, c, t, g, unknown or other
  misc_feature (420)..(420): n is a, c, g, or t
tcagtgtgagtagtcacgaccggtgctcgatttagtacgtcatcagggaaagggggagtcagacccactcaggacacagcatggacatgacgggtccccgctcagctcctggggctcctgctcgctctggctcccaggtgaccagatggtcgccatcccagatcgacccagtcctcccgtcctcctgctgtatctgtaggacanaacgtcaccatccacgttcggccggacaaacggtcaaggactaagttaagaaatgaacttacgtcgtcggtttacagaccgtaaggaaaaccgaacgggaaacgtacccccgtaagaccttccgtacgtacttactaacgttcgtcgttacgacctactaaccctaaactttaaacgaaaaacgttcggtaaccgtacccctaaagtaaccgtaanaacgttaccgaacggtccggagtaagggtaggtaacgttcgtacgggacctaaactcggttacttttaccgaacccttccgtacccgtaaccctcgaaccgaccgtacgtcccgtacgcgtaccgtagttaacgtaacggttaagtttaccgtaacgttaacttaccgtacgttgttaacctacttaaacgttccttaccttaccgttaccggtccgttaaccggttccggaaacccggtccggggtaaacgtccgggttaacggcggttaaaccggtccgtaaacggcccggttaacttcggtaacgggttcctaagacccggtttaacaccgttacggttcc

SEQ ID NO: 253049 - DNA, 719 bp, Homo sapiens
  misc_feature: GYAE6OF02GUJ8S.43.60.F05.1.454.CMB.1.raw
tcagtgtgagtagtcacgaccggtgctcgatttagtacgtcatcagggaaagggggagtcagacccactcaggacacagcatggacatgagggtccccgctcagctccgtggggctcctgctgctctggctcccaggtcgaccagatgtgccatccagatcgacccagtcctcccgtcctcccgtgtctgtatcgtgtaggagaacaagtccacatctacgtcgccgggacaagtcgagaactattaagaactagtaattacgtccgttggttacagtacgaaacgaaaccgaagggaaccctacccgtagcctaccgagtactctatcgcgtcgactacttacccttaacttaaacgaaacggttcgtaacccgtaccaaacgtacgtaaacgtactacgacggacggtcggtaaggtcgtatacggacgtaaccaggttaccttaccgttcctaaccttccgtccgtaaaccgcgacgttccgccgtcggtacgacctagggttacgtaaggtttacgttacgtttaaccgtacctttaaacttagttccggttaacttaacgtaaccttacgttactttttccgtacccggttaccgtacgggttacccgtccgggaaccgtacgggtaccgtacgggtcttaacggtcggtaacgaacggttccgtaggttccggtactaccgaccggtactttacgggttccaggtttaccccg

SEQ ID NO: 253050 - DNA, 741 bp, Homo sapiens
  misc_feature: GYAE6OF02FRHOQ.43.60.F05.1.454.CMB.1.raw
  modified_base (303)..(303): a, c, t, g, unknown or other
  misc_feature (303)..(303): n is a, c, g, or t
  modified_base (392)..(392): a, c, t, g, unknown or other
  misc_feature (392)..(392): n is a, c, g, or t
  modified_base (705)..(705): a, c, t, g, unknown or other
  misc_feature (705)..(705): n is a, c, g, or t
  modified_base (722)..(722): a, c, t, g, unknown or other
  misc_feature (722)..(722): n is a, c, g, or t
  modified_base (726)..(726): a, c, t, g, unknown or other
  misc_feature (726)..(726): n is a, c, g, or t
  modified_base (731)..(731): a, c, t, g, unknown or other
  misc_feature (731)..(731): n is a, c, g, or t
tcagtgtgagtagtcacgaccggtgctcgatttagtacgtcatcagggaaagggggagtcagacccactcaggacacagcatggacatgacggtccccgctcagctcctgggctcctgctgctctgtctccaggtgccagatgtcgccactccagtagtgaccctagtcctccgttccctcctgtctgttatctagtaggacgactaaacgtccactactaccgtaccgttggacccgggtacaaggtcgtaagacgtaagttaacggaaaagttgtaaacttacggtcccttacgggtttanaacgcgaaaacggaaaacccggtaacgggaaaacgtacccccggtaaactacccgttcccgtagtaattaccgtactacggtcgtaacnccgtaccttaccttaacgtttaaccgaaaagtccggtactacctaacgtacaaacgtacgttacgacggtacggtcgagtcggaacttcggtagaaccgtcgtacgtttcctttaccctacgtttcccacccgtaccgtttccgaaccgtccgtaacccggtcctacggtccgttaacgacggtacgttaaccgtttaagtttccgtaactttacgttactttaccggtacgtactaacttaacggttctttaccttaaccgtttaccgtccggtacgttcggaccgtacgggtcgtacgtcgtagttcgtanaccgtagtcgtgttcgntacnccgtntagtccgttc

SEQ ID NO: 253051 - DNA, 785 bp, Homo sapiens
  misc_feature: GYAE6OF02GJ7W1.43.60.F05.1.454.CMB.1.raw
  modified_base (500)..(500): a, c, t, g, unknown or other
  misc_feature (500)..(500): n is a, c, g, or t
  modified_base (558)..(558): a, c, t, g, unknown or other
  misc_feature (558)..(558): n is a, c, g, or t
tcagtgtgagtagtcacgaccggtgctcgatttagtacgtcatcagggaaagggggagtcagacccactcaggacacagcatggacatgaggtccccgctcagctcctgggctcctgctgctctggcctccgaggtcgaccagatgtgccatccgagatcgaccctagtcctccgtaccctcccgtgtcctagtattcgtcggtaagggacgtaacgaaacgtccaacctactacctacgttcggaccgggtactaacggtaccgaacggtacctaagttaaacggtaaagttaggtaaacttacggttccgtttacggttacgtaacggaccgaaacggtaaaaacccggacggggtaaaacccggtaccccccgttaaagtacccgttaccgtaacgtacgttaacgttaacgtcgaccgtacgtaccttaccgtaaccttaaacgttaactaaaacgtacggtacctaccaagtactaagtactacgtacggacgtntacggtagcgttcggacgtactacgacgtttcctacccgtacttccgacgtacccgtnaccgccgtacctcgtacgtactgtactcggttaacgttactttacgtaacttactttacgtcgtattaccgtaattaccttacgttttacccttcccgttccgtaccggttcggtccggtaaccggtaccgtacggtacgtagtaacgttaacgtaaccggtaattacccgggacgtttaggttacggtacgttaccgaccgtttaacgtccgttttaccgttaccg

SEQ ID NO: 253052 - DNA, 652 bp, Homo sapiens
  misc_feature: GYAE6OF02JJIN5.43.60.F05.1.454.CMB.1.raw
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (455)..(455): a, c, t, g, unknown or other
  misc_feature (455)..(455): n is a, c, g, or t
tcagtgtgagtagtcacgaccggtgctcgatttagtacgtcatcagggaaagggggagtcagacccactcaggacacagcatggacatgagggtccccgctcagctccgtggggctcctgctgctctggctcccaggtgccagatgtgcccatccagatcgaccctagtcctccgtcctccctgtctgtatctgtagacgacaaagtcaccatcacttcggccggacaagtcaggtactattaagaatgattacgcctggttcagnaagaaccgagggaacncccctaagctactgatctatgctgctatccgtaacttaacaaatcggacttacccatacgaatattcgaacgcggtacaggttagactcgacggactactacgttcctttacacctcgtacccgaccgtaacacgcctaacgccttaacgccgttacacgtaacgtaaggttnttttaacgacctttaaaccgttagtttacgtccttacgtaacgtaacgttacttttcccgttaaccttacccgttacgggtaaccggttcccgggtaccgaaccggggggttcctaaccgggtggtaacgttccgtaaacggaacggtaacctaccggtagttcggaactccggttacaaccgttacgtcttaccgg

SEQ ID NO: 253053 - DNA, 627 bp, Homo sapiens
  misc_feature: GYAE6OF02IKY2T.43.60.F05.1.454.CMB.1.raw
  modified_base (185)..(185): a, c, t, g, unknown or other
  misc_feature (185)..(185): n is a, c, g, or t
  modified_base (600)..(601): a, c, t, g, unknown or other
  misc_feature (600)..(601): n is a, c, g, or t
  modified_base (603)..(604): a, c, t, g, unknown or other
  misc_feature (603)..(604): n is a, c, g, or t
  modified_base (606)..(627): a, c, t, g, unknown or other
  misc_feature (606)..(627): n is a, c, g, or t
tcagtgtgagtagtcacgaccggtgctcgatttagtacgtcatcagggaaaggggctggagtgggtggccaatataaggaaagatggagaaaagatacactacatggactctgtggagggccgattcaccatctccagagacaacgccaagagttcgcttgtttctccaaatgagtagtctgagngtcgaggacacggctgtgtattattgtgcgagagactcgacgccccctaccaaaggtgggatcgtactatgatgctatttgaaaaaattgttttgggggaccgagggggacagggttcggtaccacgtacgttcttccttcacgccctacccgaaccgaacgggccccacgttcccggttccctttcccccgtgggcccgtcccccgttgcccttccgacggaccgtcccgaaccccgtccggaagacggaccgaaccgtacggggccccggtccccggtggggtccctcgggtcccgttacggggtaccgtaaacgggtaccctttaccttaccccaaccgttacctacccaaccgtaccgtacgggacggccggggacgtcgggacgaacggggcctaccgaagttagctganngnngnnnnnnnnnnnnnnnnnnnnnn

SEQ ID NO: 253054 - DNA, 764 bp, Homo sapiens
  misc_feature: GYAE6OF02G0445.43.60.F05.1.454.CMB.1.raw
  modified_base (247)..(247): a, c, t, g, unknown or other
  misc_feature (247)..(247): n is a, c, g, or t
tcagtgtgagtagtcacgaccggtgctcgatttagtacgtcatcagggaaagggggagtcagacccactcaggacacagcatggacatgagggtccccgctcagctcctggggcctcctgctgctctggctcccgaggtcgccagactgtgaccactccgagtatcgaccctagttcctcccgtcccttccctgtctagtactcgtaggtaggagaacaacgtacacactactacgtcggccggtanacgtacgaggtactagttaagaatcgtaacgttacgtccgttgtttacgacgacgtaaacgaaaccggaacgggtaaaccgtaccccgtaagtccgttaccgtagacgttaccgtagtcggtaccgtcgtacctaccttaccgttaactttaaacgaaacgttacggacccttacccgaattaccgaagttacgttaccgacggcggtactaacgggtgtacgtcgtacggacctagtacgttccttaccgtccttcgtacccgtaccacgtacgtaccgaccgtaccgttacgacggttactacgtacgttaagtttccgtttacgtaacctttaagttacgttaactacgttaacgtaacgttaacgtttacctttacccgtccggttaacccgtcggttaaccggtaccggacggtaccgggtaccgtacgggttacggtacgttcgtaaccggtaacgtaaccggtacgtttacgggcgttaccgacttaacccgttcgttacgttcgttacc

SEQ ID NO: 253055 - DNA, 731 bp, Homo sapiens
  misc_feature: GYAE6OF02G9QHS.43.60.F05.1.454.CMB.1.raw
  modified_base (210)..(210): a, c, t, g, unknown or other
  misc_feature (210)..(210): n is a, c, g, or t
  modified_base (428)..(428): a, c, t, g, unknown or other
  misc_feature (428)..(428): n is a, c, g, or t
  modified_base (492)..(492): a, c, t, g, unknown or other
  misc_feature (492)..(492): n is a, c, g, or t
tcagtgtgagtagtcacgaccggtgctcgatttagtacgtcatcagggaaagggggagtcagacccactcaggacacagcatgggacagtcggggggtccccgctcagcctccgtgggggctcctgcgtgctctcggctcccaggtcgccagatgtcgccatccagatcgacccagtcctccgtcctccctagtctgtatctggtagganaactaagtcacgtatctacgttcgggaccggcacgtcgaagtactaataaggaaattagaagttcgccgtttggttacacgtacgaaacggaaacggaaacgggaaccgaccccgttaagccttccaggtacttcgtaagtcggcttacgacctaactaccccttaagtttaaaacgaaagtcggtaaccgtacctacgaacgtaaactgttaaccgnggtaccgggactacgggtacgtacgtaacggtcgggaaccttaacggctttacccgtttaaccnccgttacgtaccgtaacgtcgaacgtaccgcgttaccgtcgtacgtacggttactaaggttactcgtttacgtactttaacgttaacttcgtaacgttaccgtaaagtacgtttacctttaccgttaccgttaaccggtccgggttaccgtaccggggtaccggacgggtaaccggtcgtacgtacgtacgaacggtacgacggtcgttacgttcgacactacgtggtcttctactacg

SEQ ID NO: 253056 - DNA, 486 bp, Homo sapiens
  misc_feature: GYAE6OF01EI99O.3.33.C11.1.454.CMB.1.raw
  modified_base (431)..(431): a, c, t, g, unknown or other
  misc_feature (431)..(431): n is a, c, g, or t
  modified_base (482)..(482): a, c, t, g, unknown or other
  misc_feature (482)..(482): n is a, c, g, or t
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtggggtcccatcaaggttcagcggcagtggatctgggacagaattcactctcaccatcagcagcctgcagcctgatgattttgctaacttattactgccaacagtataactacccgngtagacgttcggccaagggaccaaggtggagatcatacgaactgtgctgcncatc

SEQ ID NO: 253057 - DNA, 506 bp, Homo sapiens
  misc_feature: GYAE6OF01E4KN9.3.33.C11.1.454.CMB.1.raw
  modified_base (275)..(275): a, c, t, g, unknown or other
  misc_feature (275)..(275): n is a, c, g, or t
  modified_base (503)..(503): a, c, t, g, unknown or other
  misc_feature (503)..(503): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaancccctaactcctgatctatgatgcctcagtttgcaagtgggtccatcaagttcagcggcagtggatcgtgggacagtaattcactctcacatcagcagcctgcagcctgatgtattttcgctaactttattactgaccaaatagtaactaactacccgtcgtacgtaccggttcggaccgaagggaccaagggtggagatacagtacgaacgtgtcggctagctacgntcg

SEQ ID NO: 253058 - DNA, 490 bp, Homo sapiens
  misc_feature: GYAE6OF01DZK8Z.3.33.C11.1.454.CMB.1.raw
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtggggtcccatcaaggttcagcggcagtggatctgggacagaattcactctcaccatcagcagcctgcagcctgatgattttgctaactttattactgaccaacagtaataatacccgcgtagacgttcggaccaagggaccaaggtggagatcatacgaactgtggctgcncntc

SEQ ID NO: 253059 - DNA, 502 bp, Homo sapiens
  misc_feature: GYAE6OF01EMHFG.3.33.C11.1.454.CMB.1.raw
  modified_base (276)..(276): a, c, t, g, unknown or other
  misc_feature (276)..(276): n is a, c, g, or t
  modified_base (498)..(498): a, c, t, g, unknown or other
  misc_feature (498)..(498): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaacncccctaacctcctgatctatgatgcctccagtttggcaagtgggtcccatcaaggttcagcggcagtggatcgtgggacagaattcactctacaccatcagcagcctgcagcctgatgtattttgactaactttattactgaccaatagtataactacccgcgtacgacgttcggaccgaagggaccaagggtggagatacatacgaatgtggctagccacnttcg

SEQ ID NO: 253060 - DNA, 504 bp, Homo sapiens
  misc_feature: GYAE6OF01CW2MN.3.33.C11.1.454.CMB.1.raw
  modified_base (440)..(440): a, c, t, g, unknown or other
  misc_feature (440)..(440): n is a, c, g, or t
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccaagggaaacgccccctaactcctgatctatgatgcctccagtttggcaaggtgggtcccatcaaggttcagcggcagtgatcgtgggacagaattcactctcaccatcagcagcctgcagcctgatgtattttgactaacttattactgacccaaactagttaataatacccgngttacgacgttcggaccaaagggaccaagggtggaagatcatacgaactgtcggctgcaccatc

SEQ ID NO: 253061 - DNA, 524 bp, Homo sapiens
  misc_feature: GYAE6OF01C2OE9.3.33.C11.1.454.CMB.1.raw
  modified_base (273)..(273): a, c, t, g, unknown or other
  misc_feature (273)..(273): n is a, c, g, or t
  modified_base (431)..(431): a, c, t, g, unknown or other
  misc_feature (431)..(431): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagagccaggaaancccctaactcctgatctatgatgctcagtttgcaagtgggtcccatcaaggttcagcggcagtggatctgggacagaattcactctcaccatcagcagcctgcagcctgatgtatttgactaactttattactgaccaactagtaataactacccggngttacgtacgttccggaccaaaggggaccctaaagggtcggaagtatcgaagtaaccgaacttggtacgggactaggaccacccgtgttcccg

SEQ ID NO: 253062 - DNA, 557 bp, Homo sapiens
  misc_feature: GYAE6OF01CJF19.3.33.C11.1.454.CMB.1.raw
  modified_base (353)..(353): a, c, t, g, unknown or other
  misc_feature (353)..(353): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacttgccggccagtcagagtattagtacctggttggcctggtatcagcagaagccgagggaacgcccctaacctcctgatctatgatgcctcctagtttggcaaggtcggggtcccatcaaggttcagcggcagtgatcgngggacagattcactctcaccatcagcacgcctgacacgcctgattgtattttcgacttaactttattacctagaccctaaatagtaactaacgtacccggtcgttacggaccgttaccgggacccgtaaagggacccgtaagggtacggtaagaatacaacgttacggaaacgttggtacggactaggacctaccgtattcccg

SEQ ID NO: 253063 - DNA, 526 bp, Homo sapiens
  misc_feature: GYAE6OF01AHDAM.3.33.C11.1.454.CMB.1.raw
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
tcagagacgcactccacgaccggtgctcgatttagagtgagctcggtttggggtttgggggagtcagactcagtcaggacacagcatggaccatgagggtcccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttaggcctggtatcagcagaagccagggaaacgcccctaacctcctgactctaatggatcgcctccagtttcggcaaggtggggtcccagtcaaggttcagcggcagtggatcgtgggacagaattcactctcaccatcagtcagcctgctagcctgatgtattttgactaacttattactcgcctaacagttaactaacgtaccccgcgtagtacggttcggaccaagggacccaagggtcgagatacgataccgaatggtcgctanccactnttccg

SEQ ID NO: 253064 - DNA, 505 bp, Homo sapiens
  misc_feature: GYAE6OF01BZSYY.3.33.C11.1.454.CMB.1.raw
  modified_base (501)..(501): a, c, t, g, unknown or other
  misc_feature (501)..(501): n is a, c, g, or t
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaactcctgatctatgatgcctcagtttgcagtgggtccatcaaggttcagcggcagtggatcgtgggacagaattcactctcaccatcagcagcctgcagcctgatgattttgctaacttattactgacctaactagtaataactacccgacggttgtaccgttcggaccgaacgggacctaagggtggaagatacagtaacgaactgtcggctgacaccgnttcg

SEQ ID NO: 253065 - DNA, 523 bp, Homo sapiens
  misc_feature: GYAE6OF01BWYVT.3.33.C11.1.454.CMB.1.raw
  modified_base (276)..(276): a, c, t, g, unknown or other
  misc_feature (276)..(276): n is a, c, g, or t
  modified_base (335)..(335): a, c, t, g, unknown or other
  misc_feature (335)..(335): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaacncccctaactcctgatctatgatgcctcagtttgcagtgggtccatcaaggttcagcggnagtgatcgtgggacagaattcactctcacatcagcagcctgcagcctgatgtattttgctaactttattacctgaccaactagtaacttaactacccgtacgtacggtaccgttcggaccgtaaaggggaccctaaagggtcggaagtactcgaatacgaacttggtaggcctagcctacctgttccg

SEQ ID NO: 253066 - DNA, 576 bp, Homo sapiens
  misc_feature: GYAE6OF01CI6HF.3.33.C11.1.454.CMB.1.raw
  modified_base (277)..(277): a, c, t, g, unknown or other
  misc_feature (277)..(277): n is a, c, g, or t
  modified_base (428)..(428): a, c, t, g, unknown or other
  misc_feature (428)..(428): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccaagggaaacncccctaacctcctgatctatgatgcctcagtttggcaagtgggtcccatcaaggttcagcggcagtggatcgtgggacagaattcactctacaccatcagcagcctgctagcctgattgtattttgactaacttattactagtacccaaanacgttaactaacgtacccgtagtacggtaccggttccgggaccgtaaacggggaaccctaaaggggtggaaacggtactacggtaaacgttaaaccggtaaacgttacggttacgggaaccttggaaccctacccgtaacgtttcccg

SEQ ID NO: 253067 - DNA, 506 bp, Homo sapiens
  misc_feature: GYAE6OF01AB6LZ.3.33.C11.1.454.CMB.1.raw
  modified_base (274)..(274): a, c, t, g, unknown or other
  misc_feature (274)..(274): n is a, c, g, or t
  modified_base (503)..(503): a, c, t, g, unknown or other
  misc_feature (503)..(503): n is a, c, g, or t
tcagagacgcactccacgaccggtgctcgatttagagtgagctcgttgggtttgggggagtcagactcagtcaggacacagcatggacatgagggtcccgctcagctcctgggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaacncccctaaacctcctgactctatgatgcctccagtttggcaagtgggtccatcaaggttcagcggcagtggatcgtgggacagaattcactctcaccatcagcacgcctgcagcctgatgtattttgactaactttattactgaccaactagtactaactacccgtgtacgaccgttcggaccgaagggaccgaaggtggacgatacataccgaactgtcggctgcacgntcg

SEQ ID NO: 253068 - DNA, 615 bp, Homo sapiens
  misc_feature: GYAE6OF01EMODZ.3.33.C11.1.454.CMB.1.raw
  modified_base (276)..(276): a, c, t, g, unknown or other
  misc_feature (276)..(276): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgcccgggccagtcagagtattagtacctggttggcctggtatcagcagaagccagggaaancccctaacctcctgatctatgatcgcctcctagtttgcaagtgggtcccatcaaggttcagcggcagtggatcgtgggacagaatcactctcacatcagcagcctgcagcctgatgtattttgactaactttattacctacgacctaactagttaacttaaactacccggtacgttacggtacccggtttaccgggaacccgtaaacggggtaaacccgtaaacggggttagggtaaacggtaagttacccggtaaacgtttaaacccggggtaaaacccgtttacggggttacggggtacccgttaacggccccgtaaaccccgtagttttaccccgg

SEQ ID NO: 253069 - DNA, 566 bp, Homo sapiens
  misc_feature: GYAE6OF01BFPL6.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaacgccccctaacctcctgatctatgatgcctcagtttggcaaggtcggggtcccatcgaaggttcaggcggcaggtggatcgtgggacagtaattcactctcacatcagcagcctgcagcctagattgtattttgacttaactttacttactcgacctaacaacgttaactaaccgtacccgtcgttacggtaccggtttaccggacccgtaaacggggaccgtaagggtacggtaacggtactacgaagtaaccggtaacgttgggtacggctacggcctaaccgtgttaccg

SEQ ID NO: 253070 - DNA, 583 bp, Homo sapiens
  misc_feature: GYAE6OF01CGMDS.3.33.C11.1.454.CMB.1.raw
  modified_base (277)..(277): a, c, t, g, unknown or other
  misc_feature (277)..(277): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttgcctggtatcagcagaagccgaagggaaacncccctaacctcctgaatctatgatcgcctcagtttggctaaggtcggggtacccatccgaaaggttcagcggctaggtggatcgtggggacaggtaacttcactctacacctatcagcagccctgcagcctgatgtatttgactaactttattactgacctaactagtaacttaaactcccggcgttacgtacggttaccggaaccgaaacggggtacccgaaagggttcgggaaacgtaagttaccgtaagttaaaccggtaaaccgttggtacgggtacctagggaccctaacccgtagttccg

SEQ ID NO: 253071 - DNA, 544 bp, Homo sapiens
  misc_feature: GYAE6OF01CX7VH.3.33.C11.1.454.CMB.1.raw
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (539)..(539): a, c, t, g, unknown or other
  misc_feature (539)..(539): n is a, c, g, or t
tcagagacgcactccacgaccggtgctcgatttagagtgagctcggttgggtttgggggagtcagactcagtcaggacacagcatggacatgagggtcccgctcagctcctggggctcctgctgctctggctccaggtgccaaatgtgacatccagatgacccagtctccctccaccctgtctgcatctgtaggagacggagtcaccatcacttgccgggccagtcagagtattagtacctggttggcctggtatcagcagaagccaagggaacgcccctaactcctgatctatgatgcctcgagtttggacaaggtgggtcccatcaaggttcaagcggacaggtggatcgtgggacagtaattcgactctacaccgtatccaagtcaagcctggcaacggcctagatgtattttgacttaacttattacngacccaanacgttaataacgtacccgcgttcgaccggttcggacccgaaggggacccaaggggtcggaagtataccaagtacgaaactggtcggacttgaccaacgnttccg

SEQ ID NO: 253072 - DNA, 590 bp, Homo sapiens
  misc_feature: GYAE6OF01C40LE.3.33.C11.1.454.CMB.1.raw
  modified_base (274)..(274): a, c, t, g, unknown or other
  misc_feature (274)..(274): n is a, c, g, or t
  modified_base (535)..(535): a, c, t, g, unknown or other
  misc_feature (535)..(535): n is a, c, g, or t
tcagagacgcactccacgaccggtgctcgatttagagtgagctcgttgggtttgggggagtcagactcagtcaggacacagcatggacatgacgggtcccgctcagctcctggggctcctgctgctctggctcccaggtgccaaatgtgacatccagatgacccagtcctccctccaccctgtctgcatctgtaggagacggatcaccatcacttggccggcagtcagagttatagtaccgtggtggcctggatcagcagacgacgagggaacncccctaactcctgacttctatgatcgcctcgtagtttcggactaggtcgggtacccatacgtaaggtcgaggcggcgaggtggatcggtaggactaaggtaacttcactctaccactatcagtccagcctagcacgtcctagacgttgttactttacgaaccttaaagtttacttaccgtacgaacctaacgtaacgttaaactaccgtacccggtagttacggaccggttaccggaccggtaaacgggaccgtaaagggnggtaaacgctaactacgtaacggaacgttggtcggtactgaccctacgtattccg

SEQ ID NO: 253073 - DNA, 607 bp, Homo sapiens
  misc_feature: GYAE6OF01D40QF.3.33.C11.1.454.CMB.1.raw
  modified_base (277)..(277): a, c, t, g, unknown or other
  misc_feature (277)..(277): n is a, c, g, or t
  modified_base (358)..(358): a, c, t, g, unknown or other
  misc_feature (358)..(358): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacttgccgggccagtcagagtattagtacctggttggcctggtatcagcagaagccaagggaacncccctaacctctgatctatgatcgcctctagtttggactaaggtcggggtccagtacgaaggttcagcggcagtggatcgngggacagtaatcactctcacatcagcagcctgcacgcctagattgtattttcgacttaactttattactcgaaccctaaactagttaacttaaaccgtacccggtacgttaccggtaccggtttaccgggaacccggtaaaacggggtacccgtaaaggggtacgggaaacgtaacgttaacgtaaacggtaaaccggtaaacgttcgggtacgggtaccttacggaccctaaccgttacgtttacccg

SEQ ID NO: 253074 - DNA, 632 bp, Homo sapiens
  misc_feature: GYAE6OF01EBZOA.3.33.C11.1.454.CMB.1.raw
tcagagacgcactccacgaccggtgctcgatttagagtgagctcgttggggtttggggagtcagactcagtcaggacacagcatggacatgaggtccccgctcagctcctgggctcctgctgctctggctcccaggtgccaaatgtgacatccgagatgacccagtcctccctccaccctgtctgcatccgtgtaggagacggatcacatcacttcgccgggcaagtcagagtattagctaggttatttaaattggtatcagacaaaaccgaggaaacaccccttaaatttgactctatcgctgctatcctagtttgacgtaaaggtcgggtacccagtcgtaaggttcaagtcggactagtggatcgtagggactagtactttcacttcgtacaccgtatccgagcctacgttctacgacgtccgtaagaagttactttacgacttaaccttactactgtaacaactagtacgttacagtttaccgttagttacctttccgtacgtttccgggacccgttagggtaaaccctaaagggtcggtaaacctacgttaaccgaaaaccggttacgttcgggtacggacccgttagaccccttaacccgtagttccgttcgttcccgttaacccg

SEQ ID NO: 253075 - DNA, 548 bp, Homo sapiens
  misc_feature: GYAE6OF01BIM72.3.33.C11.1.454.CMB.1.raw
  modified_base (282)..(282): a, c, t, g, unknown or other
  misc_feature (282)..(282): n is a, c, g, or t
  modified_base (363)..(363): a, c, t, g, unknown or other
  misc_feature (363)..(363): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttcgccgggccagtcagagtattagtaccttggttggcctggtatcgagcaagaacgccgagggaaacncccccgtaacctcctagactctatgatcgcctcgtagtttggctaaggtcgggtccatcgaagttcagcgacagtgatcgngggacagaattcactctacacatcagcagtcctgacagcctgtatgtattttgactaatttacttacagaccaatataactaactacccgtaggttacgtaccggttccggaccgtaaacgggacctaaggggtggaactaatcgtaacgtaacgtatcggtggctagccctaaacgtcgttacg

SEQ ID NO: 253076 - DNA, 527 bp, Homo sapiens
  misc_feature: GYAE6OF01BC2YG.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccgagggaacgccccctaacctcctgatctatgatgcctccagtttggcaaggtgggtcccatcaaggttcagcggcaggtggatcgtgggacagaacttcactcacaccatcagcagcctgcagcctgatgtattttgactaacttacttactgaccaactagtaactaactacccggcgtacgtacggttcggaccgaagggaccaaagggtacggagtagtacaagtacgaacgttgtacggctagacctacctgttcc

SEQ ID NO: 253077 - DNA, 652 bp, Homo sapiens
  misc_feature: GYAE6OF01CTUYN.3.33.C11.1.454.CMB.1.raw
  modified_base (278)..(278): a, c, t, g, unknown or other
  misc_feature (278)..(278): n is a, c, g, or t
tcagagacgcactccacgaccggtgctcgatttagagtgagctcggttgggtttgggggagtcagactcagtcaggacacagcatggacatgagggtccccgctcagctcctggggctcctgctgctctggctcccaggtgccaaatgtgacatccagatcgacccagtcctccctccaccctgtctgcatctgtaggagacggagtcaccatcacgttgccgggccagtcagagtatagtaccgtggttcggctggtatcagcagaagcgaggaacnccctaactctgatctatgatcgcctcgtagtttcggacgtaaggtcggggtacccagttccgaaaggttcgaggtcggacaggtcggatcgtagggacagtaacttccactctacaccatcagcacgtccctgaccacgtcctagtagttgtacttttcgaaccttaacgtttattaaccgtacgtaaccctaaacttaggttaaaccttaaacccgtaccccgggtacgtttaaccgggtaaccggtttacccggggaaccggttaaacggggaacccgttaaaggggtacgggtaacgtaacgttaccgaacggttaaacccggtaacgttacgggttcgggaccttacggacctaacccttacgtttcccg

SEQ ID NO: 253078 - DNA, 588 bp, Homo sapiens
  misc_feature: GYAE6OF01CIQI7.3.33.C11.1.454.CMB.1.raw
  modified_base (277)..(277): a, c, t, g, unknown or other
  misc_feature (277)..(277): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacttgccgggccagtcagagtattagtacctggttggcctggtatcagcagaagccaagggaacncccctaactcctgatctatgatcgcctcctagtttggactaaggtcggggtacccatacgaaggttccaggcggctaggtggatcgtaggggacagtaattcactctcaaccatcagcacgtccctgactacgcctagtattcgtattttcgaacttaactttattaactcgaaccctaactaacgttaaactaacgtacccggtacgttacgtaccggttacccgggaccgtaaaacggggacctaaaggggtacggaacgtaatacgtaagtaacgtaacgttggtacggactgaaccacgtagttccg

SEQ ID NO: 253079 - DNA, 566 bp, Homo sapiens
  misc_feature: GYAE6OF01B14F8.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccgagggaaacgcccctaacctcctgatctatgatgcctcagtttggctaaggtgggtcccatacaaagttcagcggcagtggatcgtagggacagtaattcactctacaccatcagcacgctgcagcctgattgtattttgacttaacttattactgacctaatagttaactaaccgtacccgtcgtacgtaccgttacggaccgtaaagggacccgtaaagggtacggtaaagtagtacgtaacgtaaccggtaaacgttcgggttacggactacggtacccaaccgtacgtttacccg

SEQ ID NO: 253080 - DNA, 529 bp, Homo sapiens
  misc_feature: GYAE6OF01ECF1T.3.33.C11.1.454.CMB.1.raw
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
tcagagacgcactccacgaccggtgctcgatttagagtgagctcgttgggtttgggggagtcagactcagtcaggacacagcatggacatgagggtccccgctcagctcctggggctcctgctgccctggctcccaggtgccaaatgtgacatccagatgacccagtcctccctccaccctgtctgcatctgtaggagacggagtcaccatcacttgccggccagtcagagttattagtacctggttgcctggtatcagcagaagccaagggaacgcccctaactcctagactctatgatcgcctcagtttgacgaagtcggtccatcgaaggttcagcggcaggtggatcgaggacagattcactcacacatcagcagcctgcacgctagatgtatttgactaactttattacngaccaactagttaactacgtacccgngttacgtaccggttacggaccgaaaggggtaccagggtacgaagactacgaagtacgaacgttgtacggctacgataacctgtctacg

SEQ ID NO: 253081 - DNA, 500 bp, Homo sapiens
  misc_feature: GYAE6OF01ADU2L.3.33.C11.1.454.CMB.1.raw
  modified_base (431)..(431): a, c, t, g, unknown or other
  misc_feature (431)..(431): n is a, c, g, or t
  modified_base (447)..(447): a, c, t, g, unknown or other
  misc_feature (447)..(447): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaacgcccctaaacctcctgactctatgatgcctccagtttggcaagtcggggtcccatcgaagttcaggcggcaggtggatcgtgggacaggaattcactctacaccatcagcagcctgcagcctgatgtattttgactaactttattactgacctaanagtaataactacccgngttcgacgttcgaccgagggaccaggtgagatacanacgatgtgcngcacntc

SEQ ID NO: 253082 - DNA, 608 bp, Homo sapiens
  misc_feature: GYAE6OF01CW2HK.3.33.C11.1.454.CMB.1.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
tcagagacgcactccacgaccggtgctcgatttagagtgagctcgttggggtttgggggagtcagactcagtcaggacacagcatggacatgagggtcccgctcagctcctggggctcctgctgctctggctcccaggtgccaaatgtgacatccagatgacccagtcctccctccaccctgtctgcatctgtaggngacggatcaccatcacttgccgggcagtcagatattagtacctggttggcctggtatcagcagaacgccaagggaacnccccctaactcctagatctatgactcgtcctctagtttggactaaggtcggggtacccagtaccgaaggttcaggccggcgaggtggtaacgtcgtaggggactaagtaacttccactcctcaacctatcgaacgtcacgcctcgacacgcctgattcggtatttgacctaactttatacctgaacccaagtaacgttaactacgttacccgtcgtaacggtccggtttaccgggacccgtaaagggacccgtaaggggtacggaaacgtagttaccgaaagttaaccgggaaacgttcggtacggaccgttacaccgtaacctcgtttaccg

SEQ ID NO: 253083 - DNA, 583 bp, Homo sapiens
  misc_feature: GYAE6OF01CYVTL.3.33.C11.1.454.CMB.1.raw
  modified_base (190)..(190): a, c, t, g, unknown or other
  misc_feature (190)..(190): n is a, c, g, or t
  modified_base (199)..(199): a, c, t, g, unknown or other
  misc_feature (199)..(199): n is a, c, g, or t
  modified_base (231)..(232): a, c, t, g, unknown or other
  misc_feature (231)..(232): n is a, c, g, or t
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
tcagagacgcactccacgaccggtgctcgatttagagtgagctcgttgggtttgggggagtcagactcagtcaggacacagcatggacatggagggtccccgctcagctcctggggctcctgctgctctggctcccaggtgctaagtgcggactaggccaaggcgtcgaacctagtctcctcacctgtcngcatcgtgnggagcggtatcacctgtcactcgaccggcagnnggatattagcttggtggaccttggtacncagcaagacgacggaacggacctaccctacncngtactactagtcgactcgtacctcgtagtacgagtacggccgtactagtacggtagtacgaggcgtacgtgtgtagtacgtagtacgtacgtactactactcacactactacgacgacgacgctcgacgcgtacgtagtagtatacgttactacttacttactactactaactactacgtacgtacgtacgtacgtacggtacggtaccggtacggtacggacggtaacggtaggtacgtagtacgtaacgtacgtacggtacgtacggtacgtacgacgtacgtcgtcg

SEQ ID NO: 253084 - DNA, 584 bp, Homo sapiens
  misc_feature: GYAE6OF01CUIW4.3.33.C11.1.454.CMB.1.raw
  modified_base (278)..(278): a, c, t, g, unknown or other
  misc_feature (278)..(278): n is a, c, g, or t
  modified_base (358)..(358): a, c, t, g, unknown or other
  misc_feature (358)..(358): n is a, c, g, or t
  modified_base (392)..(392): a, c, t, g, unknown or other
  misc_feature (392)..(392): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtactggttggcatggtatcagcagaacgaccgagggaaacncccctaacctcctagatctatgatcgcctctagtttggcaaggtcgggtacccatcgaaggttcaggcggcagtgatcgnggacagtattcactcacacatcagcagcctgacngctgattgtatttcgacttaacttattacgtacgacctaaacgtacgttaactaaccgtaccccggtagttacggtacccggttaccgggaaccggtaaacggggacccgtaaagggggtacggaagtaacgttacgaaacgttaaaccggtaacggttcggtacggtcgtacgtcccgtaacccgttaacg

SEQ ID NO: 253085 - DNA, 584 bp, Homo sapiens
  misc_feature: GYAE6OF01A19XL.3.33.C11.1.454.CMB.1.raw
  modified_base (276)..(276): a, c, t, g, unknown or other
  misc_feature (276)..(276): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaacnccccctaacctcctgatctatgatcgcctcctagtttcggactaaggtcggggtcccagttcgaaaggttcaggcggcagtggatcgtgggacagtaattcactctcaccatcagcacgcctgacagcctgattgtattttgacttaacttattacctcgaacctaactagttaactaaccgtacccgtacgtacggtaccggttccgggaacccgaaacggggtaaccctaaaggggtacggaagtaacgttacgaaagttaaccgaaacgttcgggtacggtactacgacctaacccgtagttccg

SEQ ID NO: 253086 - DNA, 523 bp, Homo sapiens
  misc_feature: GYAE6OF01BIGLV.3.33.C11.1.454.CMB.1.raw
  modified_base (278)..(278): a, c, t, g, unknown or other
  misc_feature (278)..(278): n is a, c, g, or t
  modified_base (390)..(390): a, c, t, g, unknown or other
  misc_feature (390)..(390): n is a, c, g, or t
  modified_base (466)..(466): a, c, t, g, unknown or other
  misc_feature (466)..(466): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgaccaaatgtgacatccagatgacccagtcctccctccaccctgtctgcatctgtaggagacggagtcaccatcacgttcggccggccagtcagagttattagtacctggttggcctggtatcagcagagacaggaacncccctaacctctagatctatgatcgcctcgtagtttgcgtaaggtcgggtcccagtacgtaaggtcagcggacaggtcgatcgaggactagtacttcactctacacatcgancaacgctgacacgcctagattgtatttacgacttaacgtttactaccgtacgactaaactagttaactacgtccgngtacgacgtcgaccgaaggacgaggngatanacanagtactgcncacncncctntcg

SEQ ID NO: 253087 - DNA, 586 bp, Homo sapiens
  misc_feature: GYAE6OF01EL12D.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtaccgtggttggcctggtatcagcaggaagccgaagggaaacgccccctaacctcctagactctatgatcgtccctctagtttcggacgtaaggtcggggtaccctagtaccgtaaggttcgacggcggcgaggtggtacgtcgtagggacaagtaacttcaccgtctacaccactaccagcacgccctgccacgtcctgtatgtactttgaccttaactttactactacgaacctaactagttaactaaccgtacccgtcgtacgtaccggttaccgacgtaacgggacaagggtcggaacgtatacgtaactaacgaacgtggtcggtactagccctactagttccg

SEQ ID NO: 253088 - DNA, 626 bp, Homo sapiens
  misc_feature: GYAE6OF01AS6LL.3.33.C11.1.454.CMB.1.raw
tcagagacgcactccacgaccggtgctcgatttagagtgagctcgttgggtttgggggagtcagactcagtcaggacacagcatggacatgagggtcccgctcagctcctggggctcctgctgctctggcctcccaggtgccaaatgtgacatccagatcgacccagtcctccctccaccctgtctgcactcgtgtaggagacggatccacctatcacgttcggccggccagtcagtagtattacgtaccgttggttcggcctaggtactcgagacgaaggaacgaccgaacgggaacctcccctaacctcctagactactagtcgatcgcctcgtagttcgacgtaggtcgggtacctagtacgtacggtcgacggcggcgaggtcgagtcggagacgagtaactcactcaccacatacgacgcgtacgtcgtcgaccgtacgtccgtagtattgttacgtttacgactttaacttactaccgtacgtaacctaacgtaacgttaacgttaaccgttaccggtacgttaccggtaccggtacgggtaaccgtaaacgggtaccggaaagggtcgaagtaacgtacgacgtaacgtacgttggtacgtctagaccgtctcgttccg

SEQ ID NO: 253089 - DNA, 577 bp, Homo sapiens
  misc_feature: GYAE6OF01BBD5P.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctggtaggagacggagtccaccatcacttgccgggccagtcagagtattagtacctggttggcctggtatcagcagaagccagggaacgcccctaacctcctgatctatgatcgcctctagtttggactaaggtcgggtcccatcgaaggttcagcggacagtggatcgtgggacagtattcactctcaccatcagtcacgcctgcacgcctagattgtattttgacttaacttatactgacctaatagttaataaccgtacccgtcgttacggtacggttacccggaccggtaaacgggaacccgtaaggggtacggaagtaacgtacgtaaacgttaaccggtaacgttacgggtcggtactaccggacctaaccgtcgttacccg

SEQ ID NO: 253090 - DNA, 521 bp, Homo sapiens
  misc_feature: GYAE6OF01C8TZ7.3.33.C11.1.454.CMB.1.raw
  modified_base (384)..(384): a, c, t, g, unknown or other
  misc_feature (384)..(384): n is a, c, g, or t
  modified_base (440)..(440): a, c, t, g, unknown or other
  misc_feature (440)..(440): n is a, c, g, or t
  modified_base (482)..(482): a, c, t, g, unknown or other
  misc_feature (482)..(482): n is a, c, g, or t
  modified_base (513)..(513): a, c, t, g, unknown or other
  misc_feature (513)..(513): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccggcagtcagagtattagacctggttgcctggtatcagcagaagccaaggaacgcccctaacctcctgaatctatgatgcctcagtttgcagtcgggtccatcaaggttcagcggcagtgatctgggacagaacttcactctcaccatcagcagcctgcagcctagntgtattttgacttaaacgtttattactagacctaactaagtaactaacgtacccgngttacgtcgttacggaccaaacgggaccgaaaggtcgggaanaacgtcaacgttacgacctgtcggactgacnctattccg

SEQ ID NO: 253091 - DNA, 580 bp, Homo sapiens
  misc_feature: GYAE6OF01CMITF.3.33.C11.1.454.CMB.1.raw
  modified_base (350)..(350): a, c, t, g, unknown or other
  misc_feature (350)..(350): n is a, c, g, or t
  modified_base (375)..(375): a, c, t, g, unknown or other
  misc_feature (375)..(375): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacttgccgggccagtcagagtattagtactggttcggcctggtatcagcagaagccgaagggaaacgcccctaacctcctagatctatgatcgcctccagtttggctaaggtcggggtcccatcgaaggttcagcggnagtgatcgtaggacagattcactcncacatcagcagcctgcagcctagattgtattttcgacttaactttacttactcgtaaccaactagttaacgtaacttaccccggtacgtacggtaccgttccgggaacccgtaaacggggaaccgtaaaggggtgggtaacgtagttaccgaaacgttaaccggtaaccttgggtacggtaccgtagaccctaccgtgtttaccg

SEQ ID NO: 253092 - DNA, 553 bp, Homo sapiens
  misc_feature: GYAE6OF01CC7PV.3.33.C11.1.454.CMB.1.raw
  modified_base (276)..(276): a, c, t, g, unknown or other
  misc_feature (276)..(276): n is a, c, g, or t
  modified_base (547)..(547): a, c, t, g, unknown or other
  misc_feature (547)..(547): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttggccgggccagtcagagtattagacctggttggcctggtatcagcagaacgcaagggaacncccctaactcctgactctatgatcgcctctagtttggctaaggtcgggtacccatacgtaaggttcacgcggcaggtcggatcgtagggacagaacttcactctacacatcagcacgcctgacagcctgattgtatttcgactaacttattactcgaccaactagtaactactaccgtcgtacgtacggttaccggaccgtaaacgggacgaagggtcggaagtactacgaagtaccgtaaagttcggtacgggcctaggaccctaccgtnttaccg

SEQ ID NO: 253093 - DNA, 558 bp, Homo sapiens
  misc_feature: GYAE6OF01BIPDF.3.33.C11.1.454.CMB.1.raw
  modified_base (197)..(197): a, c, t, g, unknown or other
  misc_feature (197)..(197): n is a, c, g, or t
tcagagacgcactccacgaccggtgctcgatttagagtgagctcggttgggtttgggggagtcagactcagtcaggacacagcatggacatgagggtcccgctcagctcctggggctcctgctgctctggctcccaggtgccaaatgtgacatccagatgacccagtctccctccaccctgtctgcatctgtagganacggagtcaccatcacttgccgggccagtcagagtattagtacctggttggcctggtatcagcagaagccagggaaagcccctaacctcctgatcctatgatgcctcctagtttggcaagtcggggtcccatcaaggttcagcggcagtggatcgtgggacaggaattcgactcctacaccatcagcagccctgcgagcctgattgattttgacctaacgtttattaacgtcgaaccaactaacggtaattaaacgtaccccgtcggttacgtaccggttacggtacccgaaagggacccgtaaagggtggacgaagtaccgaacgtaacgaactcggtcggactagaccacctagttccg

SEQ ID NO: 253094 - DNA, 549 bp, Homo sapiens
  misc_feature: GYAE6OF01B7J37.3.33.C11.1.454.CMB.1.raw
  modified_base (268)..(268): a, c, t, g, unknown or other
  misc_feature (268)..(268): n is a, c, g, or t
  modified_base (422)..(422): a, c, t, g, unknown or other
  misc_feature (422)..(422): n is a, c, g, or t
tcagagacgcactccacgaccggtgctcgatttagagtgagctcgttgggtttgggggagtcagactcagtcaggacactagcatggacatgagggtcccgctcagctcctggggctcctgctgctctggctcccaggtgccaaatgtgacatccagatgacccagtcctccctccaccctgtctgcatctgaggagacggagtcacatcacttgccggcagtcagagtattagtacctggttggctggtatcagcagagcaggaacnccctaactctgactctatgatcgcctcgagtttggctaaggtcgggtcccagtcgaaggttcaaggcggcaaggtggatcgtagggactagtaacttcgactctacacctatcacgcagcctgacagctgatgtactttgactaacttataccncgacctaaatgttaaataaccgtacccgtggtaccgtacgttccggaaccgtaagggtaccgaagggtacggaactagtacaacgttaacgaacgttcggtacgtctaacgcctaacgtgttacccg

SEQ ID NO: 253095 - DNA, 546 bp, Homo sapiens
  misc_feature: GYAE6OF01EH7XW.3.33.C11.1.454.CMB.1.raw
  modified_base (540)..(540): a, c, t, g, unknown or other
  misc_feature (540)..(540): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaacgccccctaacctcctgatctatgactgcctccgtagtttggctaaggtcggggtcccatcaaggttcagcggcagtggatcgtggacagtatcactctacaccatacagcagccctgcagcctgattgtattttgacctaactttacttactgaacctaactagtaacttaacgtacccgcgttacgtaccggttaccggaaccgaagggaccgtaagggtaggagtatacgaagtaccgaacgttggtcggactacgcctaccngttccg

SEQ ID NO: 253096 - DNA, 567 bp, Homo sapiens
  misc_feature: GYAE6OF01D82O0.3.33.C11.1.454.CMB.1.raw
  modified_base (274)..(274): a, c, t, g, unknown or other
  misc_feature (274)..(274): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacgagtcaccatcacttgccgggccagtcagagtattagtacctggttggcctggtatcagcagaagcaggaaacnccccctaactcctgatctatgatcgcctctagtttggacaaggtcggggtcccagtcgtaaggttcaggcgcagtggatcgtgggacagtaactcactctacacatcagcagcctgcagcctgtatgtacttttgactaactttattactgacctaaactagttaactaacgttacccgaggttcgtaaccgttccggaaccgtaaaggggacccgaaagggtcgggaagtaactacgtaacgtaaccggtaacgttgggtacggtacctcggaccctaaccgtagtttcccg

SEQ ID NO: 253097 - DNA, 528 bp, Homo sapiens
  misc_feature: GYAE6OF01A2CQG.3.33.C11.1.454.CMB.1.raw
  modified_base (497)..(497): a, c, t, g, unknown or other
  misc_feature (497)..(497): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacttgccgggccagtcagagtattagtacctggttggcctggtatcagcagaagccagggaaacgcccctaacctcctgatctatgactcgcctcctagtttggctaaggtcggggtcccagtcaaggttcagcggcaggtggatcgtgggacagtaattcactctcaccatccagcacgcctgcagcctgatgtatttcgacctaactttattactcgaccaactagtaactaactacccgtcgtacgtaccgttcggaccgaacgggaccgaagggaggatancgagtacgacgtggtacggctagccncngtc

SEQ ID NO: 253098 - DNA, 514 bp, Homo sapiens
  misc_feature: GYAE6OF01B3BZW.3.33.C11.1.454.CMB.1.raw
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccgaggaaacgcccctaacctcctgatctatgatgcctcagtttgcaagtgggtccatcaaggttcagcggcagtggatcgtgggacagaattcactctacacatcagcagcctgcagcctgatgtattttgctaactttatactcgaccaactagtaacttaacgtacccgtacgtacgtaccggttccggaccgaagggaccgaagggtggacgtatcatacgaacgtggtacggctagcactgttcg

SEQ ID NO: 253099 - DNA, 580 bp, Homo sapiens
  misc_feature: GYAE6OF01APMHJ.3.33.C11.1.454.CMB.1.raw
  modified_base (275)..(275): a, c, t, g, unknown or other
  misc_feature (275)..(275): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagagccagggaaacncccctaacctcctgatctatgatgcctccagtttggcaagtcggggtccatcaaggttcagcggcagtggatcgtgggacagaatcactctacacatcagcagctgcagcctgacttgtattttcgacttaactttattactcgtacccaaacgtagtaactaacgtacccggtcggttacgtaccggttccggaaccggtaacggggaaccgtaaggggttacgggaacgtaacgttaccgaaacgttaacccggtaaacgttcgggtacgggtacctacggaccgtaacccgtagtttacccg

SEQ ID NO: 253100 - DNA, 774 bp, Homo sapiens
  misc_feature: GYAE6OF01CPVY9.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacgttcgccgggccagtcagagtattacgtactggttcggcctggtatcgagcaagaacgccgaagggaaacgccccctaaactcctagattctatgatcgccttccgtaggtttcggcgtaacgggtcggggtcccaagtccgtaaggtttcgacggcggtaccgtagggtacggtactcggtaaggggacctaaaggtaaactttccgtaaccttccgtaccaaccctaagttacccgaacggccgaacggtccccttacggacccgtaaccggtccccttagggaacttttagggtttaacgttttttacggaacccttttaaaacgtttttacgtttaacccgttaacggtaaccccttaaacgttaacggtttaaacctttaaacccggttaccccggtaggtttaacccgggtacggtttaccccggggaaacccggtaaaacgggggaaaccccgtaagggggttaaccggaacggtaaccttacggtaaaacgttacccgggtaaacgtttcgggtaacgggtcgttacgaacccctaacgttacgtttcccgg

SEQ ID NO: 253101 - DNA, 723 bp, Homo sapiens
  misc_feature: GYAE6OF01BLPH9.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatcgacccagtcctccctccaccctgtctgcatcgtaggtaggagacggagtcactatctacgtcggccggcagtcagtatattacgtacgtggttcggctaggtactcagcaagacgacgaacgggaacctcccctaactcgtagtactactatacgtactccgtaccttacgtagtttcgggacgtacgggtccggtacctagtacgtaacggttcgacggtcggagtaggtcggtaacttcgggaacgggtaactaacgtaacttccaacgttcctacctaacgctacggaacgtcgtaacgtccgtacggacctacggtaccttaggtaaactttcggttaacgttttaacgtaaccctttaacgttttaacgacccggtttaacaaaccgtaacgtttaaaccggttaacgttaaccccggtaacccggttagggtaacccgttaccgggtaaccgggaaacggtaaaccggggtaccgttaaagggggtacgtaagtaacccgtagtaaaccgttacggtaagtccgggtacgacgttacaccgtaacgttcttaaccgg

SEQ ID NO: 253102 - DNA, 524 bp, Homo sapiens
  misc_feature: GYAE6OF01EO8I5.3.33.C11.1.454.CMB.1.raw
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
  modified_base (519)..(519): a, c, t, g, unknown or other
  misc_feature (519)..(519): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccggccagtcagagtattagtacctggttggcctggtatcagcagaagccgaagggaaacgccccctaacctcctgatctatgatgcctctagtttgcaaggtcgggtcccatcgaaggttcaggcgcgagtggatcgtgggacagtaatcacttcncaccatcagcagcctgnagcctgatgtatttgactaacttnttactgacctaacagtaataacgtacccgtgtacggacgttccggaccgtaagggacccgtaagggtggacgatcgataaccggaattggtcgactagctacccnttccg

SEQ ID NO: 253103 - DNA, 600 bp, Homo sapiens
  misc_feature: GYAE6OF01BGBDO.3.33.C11.1.454.CMB.1.raw
  modified_base (274)..(274): a, c, t, g, unknown or other
  misc_feature (274)..(274): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggatcaccatcacttgccgggccagtcagagtattagtacctggttggcctggtatcagcagagccgagggaacncccctaacctctgatctatgatcgccttcctaggtttcggacgtaaggtccggggtacccagttcgaaggttcgaggcggcaggtggatcggtagggacagtaacttcactcctacaccatcagccagccctagactacgtcctagtactgtacttttcgacttaactttataccgtcgaccctaacgtaagttaactaaccgtacccgtacggttacgtaccggttaccggaccgaaacggggaacccgtaaagggtaggtaaacgtataaccgtaacgtaaccggtaacgttgggtacggtactacggaccctaacgtcttccg

SEQ ID NO: 253104 - DNA, 680 bp, Homo sapiens
  misc_feature: GYAE6OF01BN5QW.3.33.C11.1.454.CMB.1.raw
  modified_base (292)..(292): a, c, t, g, unknown or other
  misc_feature (292)..(292): n is a, c, g, or t
tcagagacgcactccacgaccggtgctcgatttagagtgagctcgttgggtttgggggagtcagactcagtcaggacacagcatggacatggacgggtccccgctcagctccgtggggctcctgctgctctggcctcccaggtcgaccaaatgtagacatccagatcgacccagtcctccctccaccctgtctgcatcgtggtaggagacggatcaaccatcacgttcggccggcagtcagtagtattagtaccgttggtcgctggtatcgagcaagacgacgaagggaacnccctaacctctgactctatgatcgacctccgtagttcggacgtaaggtcgggtacccagtacgtaacggttcgaacggcggtacgagtggtacgtcggtacggggaactaagtaacttccacgtccttacaaccgtactacacgaccgtacgtcccgtacgccgaacgtccgttatacgttagttacgttttacgacttaaactttagttaacctacgaacctaacgttaagttaaacctaaccgttaacccggcggttaaccggtaccggttaccgggaaccggaaacgggtaaccgtaaacggggtaggtaaacgtaacgtaaccgtaacgttaaaccggtacggttacgggtaccggtacgtaccgaacccaccgttaagttccg

SEQ ID NO: 253105 - DNA, 611 bp, Homo sapiens
  misc_feature: GYAE6OF01A27JK.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctttaggagacagagtcaccatcacctgccggccagtcaaagtattagtaactcgttgcctggtatcagcaaagaccaggcagacgaccccaaagcctaccttatctctgatcgcctaccaatttgactacgtaggtcggggtacccaccgtaacgttcacggcggacaggtggacgtcgtgggacaggtacgttcacttctaccacctatccgagcacgccctagaccacgtccctagacgagttcggtacggacctaacttttacttacctcgaaccaacgtagtatagtaattaacgtttaggttacgggtaacggttaccgggaacccgtaaaggggaaccctaaaggtaacgtaaagaaaacgtaccgaaaaacggtaccgttaggtacggtacttacgacctaccgtagtttacccg

SEQ ID NO: 253106 - DNA, 570 bp, Homo sapiens
  misc_feature: GYAE6OF01DIQTB.3.33.C11.1.454.CMB.1.raw
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacttcgccggccagtcagagtattacgtactggttgcctggtatcagcagagccgaggaaacncccctaactcctgatctangatgcctctagtttgacgagtcggccatcaaggttcagcggcaggtgatcgtggacagtacttcactctcacctatcgagcacgcctgactacgcctgacttgttattttacgactttaaacttatttacctacgaacctaataacgtttaactaaccgttacccggccgttaggtacccggttaccgggaacccggtaagggaacccgtaaggggtacggtaaacgtatacaagttaaccggtaactgggttacgactcgacccacctagttccg

SEQ ID NO: 253107 - DNA, 594 bp, Homo sapiens
  misc_feature: GYAE6OF01BWGBN.3.33.C11.1.454.CMB.1.raw
  modified_base (274)..(274): a, c, t, g, unknown or other
  misc_feature (274)..(274): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
tcagagacgcactccacgaccggtgctcgatttagagtgagctcgttgggtttgggggagtcagactcagtcaggacacagcatggacatgaggtccccgctcagctcctggggctcctgctgctctggctcccaggtgccaaatgtgacatccagatgacccagtctccctccaccctgtctgcatctgtaggagacggagtcacatcacttgccgggcagtcagagtattagtacctggttggcctggtatcagcagaagccgagggaaacncccctaactcctgatctatgatcgcctcagtttggactaaggtcggtcccatcgaaggttcaggcggcaggtggatcgnggacagtaactcactcncacatcagcagctagcagtcctgattgtatttcgactaactttattactcgaacctaacgtacgttaactaaccgtacccggtcgttacggtacccggtttaccgggaacccgtaaacggggaacccgtaaaggggtcgggtaacgtaacgttaccaaacgggtaaccggtaaacgttcgggttacggtacccgttaggaccccgttaaaccctgtttacccgg

SEQ ID NO: 253108 - DNA, 541 bp, Homo sapiens
  misc_feature: GYAE6OF01BBP8L.3.33.C11.1.454.CMB.1.raw
  modified_base (278)..(278): a, c, t, g, unknown or other
  misc_feature (278)..(278): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
  modified_base (450)..(450): a, c, t, g, unknown or other
  misc_feature (450)..(450): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctcccctccaccctgtctgcatctgtaggagacggatcaccatcacttgccggccagtcagagtattagtacctggttggcctggtatcagcaagaagccgaagggaacnccccctaacctcctgatctatgatcgcctctagtttggactaaggtcgggtcccatcgaagttcagcggnagtgatcgnggacagtactcactctcacatacagcagcctgcagcctagattgtatttcgacttaactttatacctcgaacctaatagtactaacgtcccgngttacgtaccgttacggaccgtaaagggaccgtaaagggtcgaagtatacgtaagtaacgtaacgtcggtacggctacgactactgttccg

SEQ ID NO: 253109 - DNA, 537 bp, Homo sapiens
  misc_feature: GYAE6OF01A01Y2.3.33.C11.1.454.CMB.1.raw
  modified_base (418)..(418): a, c, t, g, unknown or other
  misc_feature (418)..(418): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagacctggttggcctggtatcagcagaagccagggaagcccctaacctcctgatctaatgatgcctccagtttggcaagtgggtcccatcaaggttcagcggcagtgatcgtgggacagaattcactctcaccatcagcagcctgcagcctgatgattttagctaacttattactagccaaanagtaataacgtacccgacgttacgtacgttccgggaccaaacggggaccctaaagggtggaacgtagtaccaacgtacgaaacgttggtacgggctaggccctaaccgtacgttacccg

SEQ ID NO: 253110 - DNA, 674 bp, Homo sapiens
  misc_feature: GYAE6OF01CTPM4.3.33.C11.1.454.CMB.1.raw
  modified_base (277)..(277): a, c, t, g, unknown or other
  misc_feature (277)..(277): n is a, c, g, or t
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtcctccctccaccctgtcctgcatctgtaggagacggagtcaccatccacttgccggcagtcagagtattagtaccgtggttcgctggtatcagcagacgaccaagggaacncccctaacgtctagactctatcgactcgtcctcctagtttcggacgtaacggtcgggtacccattaccgtaaaggtttcgaacggcggtacgtaggtcggtaactcggtaacggggactaaggtaaactttccaaccttactaccgaacctagttcaacggtacacgttccctggacaacgtccgttagtattcggtattttacggaacctttaaacgtttacttaacgtacggtaaccctaaacgtaacgttaacttaaccgtacccggttcgtaaccggttccggttaaccggacccgtaaagggaacccgtaaggggttacggaactacgtaactaaagttaacccggaaacgttcgggtacggtaccgttacgaaccttaaccgtgtttaccg

SEQ ID NO: 253111 - DNA, 568 bp, Homo sapiens
  misc_feature: GYAE6OF01BW0SH.3.33.C11.1.454.CMB.1.raw
  modified_base (455)..(455): a, c, t, g, unknown or other
  misc_feature (455)..(455): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacttgccggcagtcagatattagtactggttggcctggtatcagcagaagccaagggaaacgcccctaacctcctagatctatgatcgcctcgtagttggcaggtcgggtcccatcgaaaggttcaggcggacaggtggatcgtgggacagaattcactctacaccatcagcacgtcctgcagtcctagatgtattttgacttaactttattactcgaaccaatagtaaactacgtaccccgngtacggtaccgttccggaccgaaacgggtaccgtaaagggtacgggaataacgtacgtaaacgttaacggtaaaccggttgggtacggaccgtaaggcctacccaggtttccc

SEQ ID NO: 253112 - DNA, 816 bp, Homo sapiens
  misc_feature: GYAE6OF01ETFMF.3.33.C11.1.454.CMB.1.raw
tcagagacgcactccacgaccggtgctcgatttagagtgagctcgttgggtttgggggagtcagactcagtcaggacacagcatggacatgacggtcccgctcagctcctggggctcctgctgctctggctcccaggtgaccaaatgtgacatccagatcgacccagtcctccctccaccctgtctgctatcgtaggtaggacgacgggactccaacctatcctaccgttcggacccggggcctagtaccgaaggtagttaacgttacggttaccgttgggttcggtccgttggtaactcgaggacaaggaaacggaccggaaacgggaaacccgtaccccccttaaacccgttccgtagtacttacttaagtgtaacgtcgtaccccgttacgttacggtttcggacggtaaacggttccggggtacccctaagttaccggtaaaggttccggaggtaccggtacgtaggggttacggtaagttaccggtacggggtaaacctaacggttaaacttacccgaacccgtttcctaacccgttaacccgtaacgtaccgaccggtaccgtaaccggtaccgtacggaaccgtacggtacccgttagttaacgtttagttactttttacgaaccctttaactttaacgttaaccgtacgtaacctaaacgtaacgtaacgttaaccgtacccggttacgtacggttaccgggtaccgaaccggtaaacgggtaccgtaaagggtacggtaacgtaacgtacgtaaacgtaaccggttacgtacggttacggaccgttacgaccgtacgtacgttcccg

SEQ ID NO: 253113 - DNA, 561 bp, Homo sapiens
  misc_feature: GYAE6OF01D62NT.3.33.C11.1.454.CMB.1.raw
  modified_base (274)..(274): a, c, t, g, unknown or other
  misc_feature (274)..(274): n is a, c, g, or t
  modified_base (339)..(339): a, c, t, g, unknown or other
  misc_feature (339)..(339): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttgcctggtatcagcagaagccagggaacncccctaactcctgatctatgatgcctcagtttgctagtgggtccatcaagtcagcgcagtgatgngggacagtaattcactcacacatcagcagcctgcagcctgactgattttcgactaactttatactcgacctaactagttaactaacgttaccccggcgttacgaccggtttccgggacccgtaaaggggtaccccgtaaaggggttacgggaacgtaagtacccgtaaagttaacccggaacttcgggttacggacttacggacccgtaacctagtttcccg

SEQ ID NO: 253114 - DNA, 519 bp, Homo sapiens
  misc_feature: GYAE6OF01C50FT.3.33.C11.1.454.CMB.1.raw
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (513)..(513): a, c, t, g, unknown or other
  misc_feature (513)..(513): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccaagggaacgcccctaactcctgatctatgatcgcctccgtagtttggacaaggtcggggtcccagtcgaaggtttcagcggcagtggatcgtagggactagaacttcactctcacatcagcacgctgcagcctgactgtatttcgactaattnttacngaccaagtatacgtacnccgtgttacgaccgttcggaccgaacgggacctagggcgaagtatactagtacgaacgttgtcgactgccncgtatc

SEQ ID NO: 253115 - DNA, 624 bp, Homo sapiens
  misc_feature: GYAE6OF01E2EPK.3.33.C11.1.454.CMB.1.raw
  modified_base (291)..(291): a, c, t, g, unknown or other
  misc_feature (291)..(291): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatcgacccagtcctcccctcccaccctgtctgcatctggtaggagacggagtcaccatcacttgccgggccagtcagtagttattagtaccgtggttggccttggtatcagcaagaacgccgaacggggaaacnccccctaacctctgactctatgatcgcctcgtagtttcggactaaggtcgggtacccagtcgtaaaggttcaaggcgggacaggtggactcggtagggacaagtaacttccaactcctacgaccactacacgacacgcccgtgacgacgtacccgtagtacttaggttattttcgacttaactttacttactacgaacctaaacagttaacgtaacgtacccgtacggttacggtaccggttccggaaccggtaacgggtaaccgtaaaggggtacggaacgtacgtacaacgtaaccgaacgttcggtacggtcgtagacctaccgtattcg

SEQ ID NO: 253116 - DNA, 678 bp, Homo sapiens
  misc_feature: GYAE6OF01CUIU3.3.33.C11.1.454.CMB.1.raw
  modified_base (428)..(428): a, c, t, g, unknown or other
  misc_feature (428)..(428): n is a, c, g, or t
tcagagacgcactccacgaccggtgctcgatttagagtgagctcgttggggtttgggggagtcagactcagtcaggacacagcatggacatgacgggtccccgctcagctcctggggctcctgctgctctggcctcccaggtgaccaaatgtagacatccagatcgacccagtcctcccctccaccctgtctgcatcgtggtaggagacggatcaccatcacttcggccgggccagtcagagtattacgtaccgttggttcggcctggtatcgagacaaggaacgaccgaagggaaccgaccccctaaccgtcctagtactctagtgactccgtcctccgtaggtttcggacgtagggtccgggtaccagtacgtaaggtcaggtcggactaggtgatcggtagggacagtacttccactctacaacntacgacgctacgccgtgactacgtcctagtattcgtttacgtttacacctttaaactttacttaacgtcgtaaaccctaacgttaacgttaaaccgttacccgtacccgggttacggttaccgggtacccggttaccgggaaaccggtaaaccggggtaaccgtaaaggggtaggtaaccgtaacggttaaccgaaacggttaacccggtagttacgggtcggtaacctacgaccgtaccctgtttcccg

SEQ ID NO: 253117 - DNA, 542 bp, Homo sapiens
  misc_feature: GYAE6OF01DX6UN.3.33.C11.1.454.CMB.1.raw
  modified_base (276)..(276): a, c, t, g, unknown or other
  misc_feature (276)..(276): n is a, c, g, or t
  modified_base (379)..(379): a, c, t, g, unknown or other
  misc_feature (379)..(379): n is a, c, g, or t
  modified_base (430)..(430): a, c, t, g, unknown or other
  misc_feature (430)..(430): n is a, c, g, or t
  modified_base (537)..(537): a, c, t, g, unknown or other
  misc_feature (537)..(537): n is a, c, g, or t
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtctccctccaccctgtctgcatctgtaggagacggagtcaccatcacttgccggccagtcagagtattagtacctggttggcctggtatcagcaagaagccaagggaaacncccctaactcctgattctatgatcgcctccgtagtttggctaaggtcgggtacccagtcgaaggttcaggcggcaggtggatcgtgggacagtaattcactcncaccatcagcacgcctgccagcctagattgtatttgacttaatttattacncacctaatagttaactaactcccgtcgtagtaccgttcggaccgtaaagggacctaagggtcggaatactacgaacgtaacgaagtcggtcggactagacctacgtnttccg

SEQ ID NO: 253118 - DNA, 759 bp, Homo sapiens
  misc_feature: GYAE6OF01ED9W2.3.33.C11.1.454.CMB.1.raw
  modified_base (740)..(740): a, c, t, g, unknown or other
  misc_feature (740)..(740): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatcgacccagtcctccctccaccctgtctgcatctggtaggagacggagtcaccatcacgttcggcccggccagtcaagtagttattacgtaccgttggttcggtccgttaggtactacgacggacgtaaggaaccggacccggaaacggggaaaccccgtacccccccttaaacccttccgtaggtacttaccgtaagtcgtaactccgtaccccttaccgttaggtttacgggacgttaacgggttccggggtaccctaagttacggtaacggttccgacgggtcggacgaggttcggtaacgttccggtaaggggaactaagtaaccgttcctacttacctaccaactagtccgaacgccgtacgtccgtcgacgtacgtcccgtagtactttacggttatttaaccgaaccgtttaacttttacgttaccgaacgtacctaaagtacgttaacctaacccggttacccgtggttaccggtaccggtacccgggaaaccggtaacggggtaaccgtaaggggtacgtaacggtaacttaccggaacggttaaaccgtacggttacgggtcgtaccgtaanaccctaccgttgttacccg

SEQ ID NO: 253119 - DNA, 698 bp, Homo sapiens
  misc_feature: GYAE6OF01COTPW.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatcgacccagtcctccctccaccctgtctgcatctggtaggagacggatccaccatcacgttgccggcagtcaggtagtattagtacctgggttcggccgtggtactcgagacaggaacgccgaaacgggaaaccgccccctaaaccgtccgtagacttctacgtgactcggcccttaccgtaggttttcggacgtaacgggttcggggtaccctagttaccggtaacggttccaacgggccgggacgtaacgggttcggtaacgttcggtaacgggggaactaacgttaacgttacctacccgtcctaaccgaccctacgtccacgtacgacgtccccgtagaccgtacgtccgtagtacgttcgtttaacgtttcgtaaccttaacgtttacttacgtcgtaacctaacgttagttaaaccgtaccgttaccgtacgttacggtaccgttaaccggaccggtaaacggtacgtaacgggtcggaagtacgtacgaacgttaccgtaagtcggtacgtaccgacgacctcgtcgttaccg

SEQ ID NO: 253120 - DNA, 710 bp, Homo sapiens
  misc_feature: GYAE6OF01ARCXL.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatcgacccagtcctcccctcccaccctgtctgctatctgtaggagacggatccaccatctacgttcggccgggacctagtcagtacgtagttacgtaccgttgggttcggccgttggtactcgagaccgaaggaaccgaccgaaggggaaaccctccccccttaaaccgtcctagtacttctaagtgacgtcgacccttacggtagtttcggacgtacgggttccgggtaccagttacgtaacggtcgacggcggacgtaggtcggtactcggtacgggaactaacgtaacttccgaccttccaccaaccgtactaccgagtaccgacgtcccgtagcctaggtccttagtaacgtttacgttacgttttacgaacctttaaacgtttacgtacctaacgaacccgtaaagtacgttaaacgtaacccggtacccggttacgttacggtaaccggttacccgggaacggtaacgggtaaccgtaaagggtgtaaaccgatacccgtaacgaacgtactcgggttacgccgtaacgacctaccgttagttcccg

SEQ ID NO: 253121 - DNA, 701 bp, Homo sapiens
  misc_feature: GYAE6OF01C1JK4.3.33.C11.1.454.CMB.1.raw
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
  modified_base (438)..(438): a, c, t, g, unknown or other
  misc_feature (438)..(438): n is a, c, g, or t
tcagagacgcactccacgaccggtgctcgatttagagtgagctcgttgggtttgggggagtcagactcagtcaggacacagcatggacatgagggtccccgctcagctcctggggcctcctgctgctctggctcccaggtgccaaatgtgacatccaagatcgacccagtcctccctcccaccctgtctgcatctgtaggagacggagtccaccatcctacgttcgccggcagtcagagtattagtacctggttcggccgtggtatcagacaagaacgaccgaaagggaaaccnccccctaacctcctanactctatgatcgccttacgtagtttcggacgtaacggtcgggtacccagtaccgtaggttacgaggacggcgtacggtggtactcggtacgggactaagtaacttacgaccttacgtaccaaccctanaccgacgtaccgacgtccctgaccgacggtcccgtagtaacgttaggtttactttagtaacctttaactttacgttaaccgttacgtaaccctaacgttaaacgttaaaccgttaacgtacccgttacggtaccggttaacccggttaacccgggaacccggtaaacggggaaccggtaaacggggtaggtaaacgtataaccggtaaacgtaaccggttaagttacgggacggttacctacggaaccctcgtaacttaccgg

SEQ ID NO: 253122 - DNA, 587 bp, Homo sapiens
  misc_feature: GYAE6OF01A2PF5.3.33.C11.1.454.CMB.1.raw
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgccatctgtaggagacggatcaccatcacttggccgggccagtcagagtattagacctggttcgctggtatcagcagagaccgaggaacncccctaacctctagatcgtatgancgcctcgtagttggacgtagtcgggtaccatcgagtcagcggntagnggactgaggacagtaatcactcacactatacncncacgccgtagactacgcctagacttaggttactttactaccgttaactttacttaaccggtcaacctaaacgtacgtaacttaaccggtacccgtggttaaccgtacccggttcgggaaaccgaacgggtaacccggtaagggacggtaacgtattacgaaactttacggaacgtttcggacgggtactagccctacgttgttaccg

SEQ ID NO: 253123 - DNA, 679 bp, Homo sapiens
  misc_feature: GYAE6OF01AZ34R.3.33.C11.1.454.CMB.1.raw
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtctccctccaccctgtctgcatcgtgtaggagacggagtcaccatcacgttcgccggccagtcagagttatagtacctggttcgccgtggtatcgagcaagacgcgaagggaaaccgcccctaactcctgactctatcgactcgcctaccgtagtttcggacgtaaggtcggggtaccctagtacgtaaaggttcgacggcggacgaggtcggtactacgaggggaactaggtaactttccgaaccttcgtacctaaccgtagtaccgaacgtcccgaacgtcccgtacgccgtaacggtcccgtagtaacgtttgttaacgtttttcgaaccttaacgttttaactaaccgttacgaaacccgtaaattaacggtaaacttaaccgtaccccggtagttacggtaacccgttccggaaccggtaaacgggtaccgtaaagggtcggaacgtacgtaaccgtaagtaaccggtaaccgtgggttaccggacttacggacctaaccgttagtccg

SEQ ID NO: 253124 - DNA, 755 bp, Homo sapiens
  misc_feature: GYAE6OF01C4VKY.3.33.C11.1.454.CMB.1.raw
  modified_base (496)..(496): a, c, t, g, unknown or other
  misc_feature (496)..(496): n is a, c, g, or t
tcagagacgcactccacgaccggtgctcgatttagagtgagctcggttgggtttgggggagtcagactcagtcaggacacagcatggacatggacgggtccccgctcagcctcctggggcctcctgctgctctggcctcccaggtcgccaaatgtgacatccagatcgaccctagtcctccctcccacccttgtctcgctatcgtggtaaggacgtacggactccacctatcctacgttcggccggacctgtacagtagtattacggtacgtggttcgccgttaggtactcgagacaaggtaacgaccgaaacgggaaccctaccccctaaaccttccgtacgaacttacctagttacgacgttccgtcccttacggttacgtttacggacgttacgggtccggggtacctagtaccgtaacggttccgacggtcggagtacggtacggtagtcggtacggactaacggtactacgtaccgtcctaccgaccttanaccgtaacgtacgtaccgtcccgtagaccgacgtccgttagtacgttacgtttagttacgtaactttaacttacgttaacgtaccgtaaccgtaaacgttataacccggttaccgtaccggtacggttaccggtaccgggttaaccgggaccgggtaaaagggacccggttaaagggtacccggtaaagtaacttaaccggtaaggttaaaccgttaggttcggtacgtaccgtaaccggaacctcgttccgtttaccg

SEQ ID NO: 253125 - DNA, 695 bp, Homo sapiens
  misc_feature: GYAE6OF01CME94.3.33.C11.1.454.CMB.1.raw
tcagagacgcactccacgaccggtgctcgatttagagtgagctcgttgggtttgggggagtcagactcagtcaggacacagcatggacatgaggtccccgctcagctcctggggcctcctgctgctctggcctcccaggtgaccaaatgtgacatccagatcgacccagtcctccctccacctgtctgctatctgaggagacggatccactatcacgttcggccggcagtcagtagtattacgtaccgtgggttcgccttaggtactcgagacgaagtaacgaccgaacgggtaaaccgtaccccctaaaccgtccgtagtacttacctaagtcgtactccgtcctaccgtagtttcggacgtaacggtccgggtacccagtacgtaacggttcgacggtcgggactagggtcggtacgttacggtagggactaaaggtaacctttccgaaccttcctaccaaccctagtaccgacggtaccacggtccctaggacctacggtccttagtagtttacgttacgtttacgaacctttaaactttacgtaaccgttacggaacccttaaaggttaaccgttaaccgtaacccgttacccggtacgttacggtaccggttaaccggaccggtaaacgggaccgtaggtacgagtactacggtactaacggtagtggtcgacgtacacctactgttccg

SEQ ID NO: 253126 - DNA, 686 bp, Homo sapiens
  misc_feature: GYAE6OF01CS0ML.3.33.C11.1.454.CMB.1.raw
  modified_base (437)..(437): a, c, t, g, unknown or other
  misc_feature (437)..(437): n is a, c, g, or t
tcagagacgcactccacgaccggtgctcgatttagagtgagctcgttggggtttgggggagtcagactcagtcaggacacagcatggacatgaggtcccgctcagctcctggggctcctgctgctctggctcccaggtgccaaatgtgacatccagatgacccatctccctccgaccctgtctgcatcgtgaaggagacgggtatccaacctatcaacgttcgccgggaccagtacagtagtagtttacgaaccgtggttcggcgtggtatacagacaagacgaccgaaggggtaaaccacccctaaaccgtccgtacgtactacgtaacgtggacttcggcccttacgaggtttagacgtacggtcgggtacctagtacgtaaggttacaacgtcggactaggaggtacgtggaggactaagaacttacacttacncaacccatccaagccgaacgctacgacacgaccttgacgttagttagtttacgaacttaacctttaatacccgtagtaacccgtaataacggttaaacctaaccggttacccggtcgttaacgtcccgggtttacggaacccggaaaagggtacccgggaaaggttgggaaacgttaacgtacccgttaaagaaccggttaacgttagggtaccgtacggttcgaaaccccgtacgtaacgtttacccg

SEQ ID NO: 253127 - DNA, 728 bp, Homo sapiens
  misc_feature: GYAE6OF01BBW4X.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtcaccaaatgtgacatccagatcgacccagtcctcccctccaccctgtctgcatcgtggaggagacggagtcaccatcacgttcggccgggccagtcagtattacttacgtaccgtgggtcgccgtggtactcgagcaagacgaccgaaggaaccgccccctaacctccgtagactctatcgtactcgccctacgtaggtttcgacgtacggtcgggtaccagtcgtaacggtcacggtcggacgtaggtggacgttacggtaggggaactaacgtaattccgtacttcctaccaacctagtaccaacggtccgaccgtcccgtacggcctacgggcccttggtacgttggttaactttttccgaacctttaaacgttttaaccttaccgacggtaaaccctaaacgttaacgtaaaccgttaacccgttacccgtacgggtaccgggttaacccggttacccgggaacccggtaaacgggggtaacccgtaaagggggtacggtaaacggtaaccttaccgggtaaacgttaaccggtaacggttcgttaccggggacttaccgggacccttaaaccgtcgtttacccg

SEQ ID NO: 253128 - DNA, 794 bp, Homo sapiens
  misc_feature: GYAE6OF01CMN5D.3.33.C11.1.454.CMB.1.raw
tcagagacgcactccacgaccggtgctcgatttagagtgagctcgttggggtttgggggagtcagactcagtcaggacacagcatggacatgagggtccccgctcagctcctggggctcctgctgctctggcctcccaggtcgaccaaatgtgacactccagatcgacccagtcctccctccaccttgtctgctatcgtaggtaggagacggtacgtccaacctagtactaccgttcgggcccgggacctagtacgaggtaagttagttacggtaccgttggggttcggtccgttggtactcgaggtacgaacggaacggaccggaaacgggggaaaccctaccccccgttaaaccgttaccgaacgttacttaccgtaagttacgtaccgttccgtacccttacccggttagggttttacggaccgtaaggggttccggggtacccctagttaccggtaaaggttccgacgggtacggtacgtagggtcgtacgtcgggtacgggtaacgtacggttaacttcgacctaccgtaccaacctacgtacgaccggacctaccggcccgtacgtcggtacttacggtacgttaggtttaacctttcgtaaaccttaacgttttacgttacgtaacccgtaacgttaaccgtaacgttaactaaccccggttacccggtacggttaccggtacggttaccgggaacccggtaaacgggtaacggtaacggtaagggacgtaaacgtctaaacggtacgacgttagggccgtacacgtaccctacgtactccggttcg

SEQ ID NO: 253129 - DNA, 739 bp, Homo sapiens
  misc_feature: GYAE6OF01A1TET.3.33.C11.1.454.CMB.1.raw
  modified_base (280)..(280): a, c, t, g, unknown or other
  misc_feature (280)..(280): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacttgccgggccagtcagagtattagtacctggttggcctggtactcagcaagacgccgaagggaacncccctaactcctagactctatgatcgcctcgtaggtttggactaacgggttcggggtacccagttaccgaaaggttccgaacggcggacgtaggtcgggtacgttacggtaggggaactaacgtaatttacccgaaaccttccgtacctaacccgtataccgaacgtaccacggtcccctaggaccacggtcccgtagtacgttggttaacgttttcggacctttaaaccgtttaagtttacccgtacgtaaacccgtaaacgttaacggttaaacgttaaacccggttaccccgggtacgttaaccggtaaccccgggtttaaccggggaacccggtaaacggggtaacccggtaaaggggtaccgggaaacgttaacggttaacccgtaaacggttaaacccggtaacgtttcgggtaccgggtaccttacggaccctaaccccgttagttacccgg

SEQ ID NO: 253130 - DNA, 654 bp, Homo sapiens
  misc_feature: GYAE6OF01A2V7W.3.33.C11.1.454.CMB.1.raw
tcagagacgcactccacgaccggtgctcgatttagagtgagctcgttgggtttgggggagtcagactcagtcaggacacagcatggacatgaggtcccgctcagctcctggggctcctgctgctctggctcccaggtgccaaagtgtgacatccagatgacccagtcctccctccaccctgtctgcatcgtgtaggagacggagtcaccatccacgttcgccgggccagtcagtagtattacgtacctggttcggccgtggtatcgagacgagaacgaccgacgggaaaccgcccctaaccgtcctagactctatcgactcgtcctccgtaggtttcggacgtaagggtccgggtaccctagtacgtaaacggttccgaacgggcggacgtaggtacggacttcggtaagggtacctagtaacgttcacgtcgtaccactagtacgacgtccgtacgcccgtagacctacgtcctagtacttagtacgtttacgaccttaaattaccgtactaacgtaccctaaagtacgttaaccgtaaccgtacccggtagttaccgtaccgtaccgggtaaccgtaacgggtaaccggtagggtaacgagtaccgaacgtagtaaccgaagttcggtacgtactacggaccacgtcttcgg

SEQ ID NO: 253131 - DNA, 865 bp, Homo sapiens
  misc_feature: GYAE6OF01DLYC8.3.33.C11.1.454.CMB.1.raw
  modified_base (577)..(577): a, c, t, g, unknown or other
  misc_feature (577)..(577): n is a, c, g, or t
tcagagacgcactccacgaccggtgctcgatttagagtgagctcggttggggtttgggggagtcagactcagtcaggacacagcatggacatggacggtccccgctcagctccgtgggcctctgctgctctggcctccgaggtcacctaaatgtacacactaccaagtacgtaccgaccctacgtccctacccctaccctaccgttcgtctcgtacctagttacggtagggtaacgggacggtaaccggacgtaccaaccgtacgtaccgtacggttccgggaccccgggacaggtaccgtaaggttaacttaacgttacggttaccgtttggtccggtactaggtactagagaagaacggaaccgaaccggaacggtaacccctaccgtaacccttcgagtacttacgtaagtcgtaaccgtccgtaacccttggttaacgggtttcggaaccgggtaacggttccgggaaccctagttaaccgtaacgggtccaaggggtccgtaacgtaggttacggaaccgttcgggaaggtaaacacggtttaaacctccctaacttccgaaccaaccgtanacggacctacggactccgtagaccggtacgtacgtacgtaagtttacggttaacttacgtaaccttttaaactacggttaacctaaccgaaaccgtaaacgttaacttaaacccggtaccttaaccggggtcgttaaaccgggtacccggtaaccggtaaacccggaaccggggtaaaaggtaaaacgggggttctaaaacgttaccggtaaaaccggtaccggtaaaacggttacgacggggttaaccgtttacccaaaggtcccctttaggtaaccccttttaggg

SEQ ID NO: 253132 - DNA, 687 bp, Homo sapiens
  misc_feature: GYAE6OF01AZDGZ.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctgggctcctgctgctctggctcccaggtgccaaatgtgacatccagatcgacccagtcctccctccaccctgtctgcatcgtggtaggacgacggagtcaccactcacgttggccggccagtcagagttattacgtaccgtggttcgccttggtactcgagacaagtaacgaccgaagggaaacctccccctaaactccgtagacttctacgtgactcgccttacgtaggttacggacgtaaggtccgggtacccaagttacgtaacggttaccacgggaccggtacgaggttacgacgtcggtaacgggaactaagtaactttccgactccgtaccaaccgtacgtacgacgtaccgaacgtcccgtaggaccctaacgtccgttagtaacgtttcggttaacttttacggaacctttaaactttacgttacctggaacccttaaacgtaacgttaaccgtaccgttaacccggtgttaccggtaaccgttaaccgggaccggtaaaacgggtaccggtaagggtacgacgttacctacgtaacgtacgtacgtgtacgctacgctacctgttccg

SEQ ID NO: 253133 - DNA, 733 bp, Homo sapiens
  misc_feature: GYAE6OF01DJTZE.3.33.C11.1.454.CMB.1.raw
tcagagacgcactccacgaccggtgctcgatttagagtgagctcgttgggtttgggggagtcagactcagtcaggacacagcatggacatgacgggtccccgctcagcctccgtggggcctcctgctgctcgtggcctcccgaggtcgaccaaatgtgacatccagactcgaccctagtccctccctccctacccttgtctgcatcgtaggtaggaggacggagtaccacctatctacgttcggcccggctagtacgagtagttagttacgtaccgttgggttcgcctaggtatcgagacaaggacggaccgaagggaaaccctcccccttaactcgtagacttcgtagtgactcgccttacgtaggttcggacgtacgggtccggtaccagtacgtaacggttcgacggtcgagtaggttaggagtcggtagggaacctagtaacttacctacgtacctaccgaacctacgaccgacggtcctacggtcccgtacgaccgtacgtaccgttaggtacgtttaggttaccgtttacgtaacctttaaactttacggtacctacggtaaaccctaagttaaccgttaaccgttaaccccgttaccgggttacggtaaccgggtacccggttaccgggaaacccggaacggggtaaccgtaaggggtggaaacttacggtaccggtaaacgtacccggtagttacgggtccgacttacggccttacgtcgtccgg

SEQ ID NO: 253134 - DNA, 596 bp, Homo sapiens
  misc_feature: GYAE6OF01E3DG9.3.33.C11.1.454.CMB.1.raw
  modified_base (351)..(351): a, c, t, g, unknown or other
  misc_feature (351)..(351): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccaagggaacgccccctaactcctgatcctatgatcgccttccagtttggcaaggtcgggtcccagtcaaggttcagcggcagtgntcgtgggacagtaattcactctacaccatcagcagccctgcagcctgattgtattttcgactaactttatactagacctaaacgtagttaactaaacgttaccccggcgttaccgggtaaccggtttacgggaacccgtaaacgggggtaccccgtaaggggttaccgggaacgttacgtaccgtaaacggttaaccgtaacgtttcgggtacggtaccgttacgaacccgacccgtagtttccg

SEQ ID NO: 253135 - DNA, 713 bp, Homo sapiens
  misc_feature: GYAE6OF01BA59E.3.33.C11.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
tcagagacgcactccacgaccggtgctcgatttagagtgagctcgttgggtttgggggagtcagactcagtcaggacacagcatggacatgacgggtccccgctcagctcctggggctcctgctgctctggctcccaggtgccaaatgtgacatccagatgacccagtcctccctccaccctgtcctgcatctggtaggngacgngtcaccatcacgtcgccggacagtcagtatattagtaccgtggttcgctggtatcagcagacgacgaacgggaacncccctaactcgtanactactatgatcgcctcgtagtttcggcgtaacggtcgggtacccagtacgtaaggtcgacgggccgtgtacggtggtaattcggaggggtaacaacgtaacttacaccgttaccacctaaccagttacccaggtaccctacggtcccctagggtacccacggtacccgttagggtaactttacgggtttaaacttttacgaccgttttaaacttttacttacccggtaaccgtaaaccgtaaacgttaaccgttaaacctaaccccggtttaacccggggtacgttaccggggttaacccggttaacccggaacccggggttaaaccggaaccggggttaacgggtacgtaaacggtactaccggtaacgtaacggtaacgtcggtaccggtaccttagaccctaagttacgttccg

SEQ ID NO: 253136 - DNA, 714 bp, Homo sapiens
  misc_feature: GYAE6OF01AB5JK.3.33.C11.1.454.CMB.1.raw
tcagagacgcactccacgaccggtgctcgatttagagtgagctcgttgggtttgggggagtcagactcagtcaggacacagcatggacatgacgggtccccgctcagctccgtggggctcctgctgctcgtggcctcccgaggtcgaccaaatgtagacatccagatacgacccagtcctcccctacccacccttcgtctcgactactcgtaggtagggacgacggacgtccaccatcacgttcggccggaccagtcagtacgttagttacgtaccgttggttcgccttaggtactcgagacaggaacgaccggaaggaaccctccccctaaccgtccgtagatcctagagtacgtcgtcccttacgtggttacggacgttacgggtccggtactacgtacgtacggtcgaggccgagtggtcgacgtcgaggactagtaactccgtactccgtacactagtaccgagccacgtccctagcctacgtacgtacgaggtttattaccgtttacgaacctttacggttacttaccgaaccgtaaccctaaggtaaaccttaacgggttaaccccgtacccggttaggttaaccggttccgggaaacccggttaccgggaacgggttaccgtaaggggttaccgaacgttagaccttacggtaaacggttcccgtagggtaccggttacccgaccgtaccgtaccgttcgtaacccg

SEQ ID NO: 253137 - DNA, 780 bp, Homo sapiens
  misc_feature: GYAE6OF01ESCRF.3.33.C11.1.454.CMB.1.raw
tcagagacgcactccacgaccggtgctcgatttagagtgagctcggttggggtttgggggagtcagactcagtcaggacacagcatggacatggacgggtccccgctcagcctccgtgggctcctgctgctctggcctcccgaggtcgaccaaattgtacgaactataccagactcgacccagttcctcccctccaccctgtctgactatcgtaggtaggagacggctacaactactcaccgttcggacccggaccagtacagtagttacgttacgtaccgttgggttacgcgtaggttacacgagcgaaggaacgaccggaaacgggaaaccctcccccttaaccgtccgtaggtacttacgttatacggtacttccgaccctttacggttaggtttaccggaacggttaaccgggttcgggtacccctaagttaaccggtaacggttacgacgggtacggaccgtaggttacggtaacgtcggaaggaacctaaagttaactttacgaaccttccgtaaccgtaacgtacctaacgaccgtacgtaaccgtacctacggaaccgtacgtaccgttagtacgtttaggttaaccgttttaacggaaccttttaaactttaaccgttaaccgaactaaccgtaaacgttacgttaaacgtaaccgtacccggttaggtaccggttaccggtaccggaaccggtaagggtaaccgaaggtacgaacgttaatacggaaagtaccgtaaggtcgacggtacctagtacctaacgtgttaccg

SEQ ID NO: 253138 - DNA, 563 bp, Homo sapiens
  misc_feature: GYAE6OF01AFFN2.3.33.C11.1.454.CMB.1.raw
  modified_base (276)..(276): a, c, t, g, unknown or other
  misc_feature (276)..(276): n is a, c, g, or t
  modified_base (381)..(381): a, c, t, g, unknown or other
  misc_feature (381)..(381): n is a, c, g, or t
  modified_base (558)..(558): a, c, t, g, unknown or other
  misc_feature (558)..(558): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccgagggaacnccccctaacctcctgatctatgatcgcctcctagtttggctaaggtcggggtcccagtcgaaggttcaggcggcaggtgatcgtgggacagattcactctcaccntcacgcagccctgcgacgcctgattgtacttttgaccttaactttacttacctacgaccaactagttaactaaccgtcccgtcgttacgtaccggttaccggaccgaacgggtacccgaagggtcggaagtacgtacgaacgtacccggtaagttgggtcggactacgcctaccgtnttccg

SEQ ID NO: 253139 - DNA, 571 bp, Homo sapiens
  misc_feature: GYAE6OF01BJ2UL.3.33.C11.1.454.CMB.1.raw
  modified_base (279)..(279): a, c, t, g, unknown or other
  misc_feature (279)..(279): n is a, c, g, or t
  modified_base (457)..(457): a, c, t, g, unknown or other
  misc_feature (457)..(457): n is a, c, g, or t
  modified_base (563)..(563): a, c, t, g, unknown or other
  misc_feature (563)..(563): n is a, c, g, or t
tcagagacgcactccacgaccggtgctcgatttagagtgagctcgttgggtttgggggagtcagactcagtcaggacacagcatggacatgaggtcccgctcagctcctggggctcctgctgctctggctcccaggtgccaaatgtgacatccagatgacccagtcctccctccaccctgtctgcatctgtaggagacggagtcaccatcacttcggcccgggccagtcagtagtattagtacctggttggcctggtatcagcagaagccgagggaacncccctaactcctgatcgtatgatcgcctacgagtttggactaaggtcgggtccagtacgtaaggttcaggcggcaggtggatcgagggacaggtaacttcacttcctacgacctatacgacgccaacggtccctacgcgacgtcctgacttgtagttttcacttaactttactacgtnacctaatagtaacttaacgtccgtagtacgtacggttacgaccgaagggtacctaagggtacgtaggtatacgacgtaacgaacgttcggtggactagcctacgtnttacccgg

SEQ ID NO: 253140 - DNA, 730 bp, Homo sapiens
  misc_feature: GYAE6OF01B729U.3.33.C11.1.454.CMB.1.raw
  modified_base (220)..(220): a, c, t, g, unknown or other
  misc_feature (220)..(220): n is a, c, g, or t
tcagagacgcactccacgaccggtgctcgatttagagtgagctcggttggggtttggggggagtcagactcagtcaggacacagcatggacatgacgggtccccgctcagctccgtggggctcctgctgctcgtggcctcccgaggtgaccaaatgtgacatccagatcgaccctgtccctcccctccaccctgtctgctatcgtaggagggacgacggntaccactatctacgtcggccggacagtcagtagttagttacgtcgtggttcggcctggtacacgagacgaagaacggaccgaacgggaaccctcccctaaccgtctagtacttaccgtatagactccgtaccttcggttaggttcggaccggtaacgggtccggtacctaaggttaccggtaacgggttcgaacggggtcggacgtagggtcgtacgtacggtaagggaacttagtaaccttccaccgtacctaaccaccgtactaccggacgtccgtaccgtcctgaccgtacgtcgtaagtcgtttaagttacgtttactaacgtttaaacttgtaacccgtacaaaccgttaaactaacgttaaccgttacccggaccgtacggttaccgtaccggttaaccgggaaccggtaacgggtaaagtaaccggggaggtaactagggttaacctaacggttaaccggtcgttacgggtacgcccgttaacgaccctaagttcctttaccg

SEQ ID NO: 253141 - DNA, 739 bp, Homo sapiens
  misc_feature: GYAE6OF01BOTKY.3.33.C11.1.454.CMB.1.raw
  modified_base (292)..(292): a, c, t, g, unknown or other
  misc_feature (292)..(292): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatcgacccagtcctccctccaccctgtctgcatcgtggtaggagacggagtcaccatcacttcggcccgggccagtcaggtagttattagtaccgtggttcggccttggtactcagcagaacgccgaagggaacnccccctaactcctagactctatgatcgcctcgtagtttcggacgtaacggtcgggtaccctagtacgtaacggttcgaaggcggtacgtaggtggaacgttcggtaggggaacaaggttaaacttccaaaccttccttacccgaacctacgtaccgaaggcccgtaacggtcccgtacggacccgtaacggtcccgttagtaacgtttacgttaaccgtttttacggaaccttttaaaacgttttaaccttaaccgtaccggtaaaccctaaacgttaacgtttaaacgtaaacccgttaaccccgggtacgtttaaccggtaacccgggtttaccgggaacccgggtaaacgggttaaaccgaaggggttacggaacgtacgtaacgtaaacgttaaccggtaacgttcgggtacggtcccgttagacccttaccgtagtttcccg

SEQ ID NO: 253142 - DNA, 727 bp, Homo sapiens
  misc_feature: GYAE6OF01A6TN3.3.33.C11.1.454.CMB.1.raw
  modified_base (277)..(277): a, c, t, g, unknown or other
  misc_feature (277)..(277): n is a, c, g, or t
  modified_base (318)..(318): a, c, t, g, unknown or other
  misc_feature (318)..(318): n is a, c, g, or t
tcagagacgcactccacgaccggtgctcgatttagagtgagctcgttgggtttgggggagtcagactcagtcaggacacagcatggacatgaggtccccgctcagctccgtgggctcctgctgctctggctcccgaggtgaccaaatgtgactatccagatcgacccagtcctcccctccaccctgtctgcattcgtggtaggagacggcgtaccacctatcgaccttcggcccggcctagtcagagtattacggtaccgtggttcggccgtggtancagcagacgacgacgggaaccacccctactcctagatctangatcgtcctacgtaggttcgacgtacggtcgggtacctagtacgtaacgttcgaggcggagtacggtggacgtcggtaggaactacgtactactacctctaccgtaacactacgacgaccgacgtccgtcgtacacgtcgttagtacgttacgttactttacgaactttaactttacgtaaccgtacgtaacccgtaaacgttaacgttaaacccgttaaccgtaacccggttacggttaaccggttaacccgggttaccgggaaacccgggtaaaccggggtaaccgggttaaacggggtaccgggttaaacgtaacgggtacccgttaaaacggtaccggttaaaaccggttcggggtaccggttaacccggaaccggttaacccgaaaccgtttcggttaaccccg

SEQ ID NO: 253143 - DNA, 635 bp, Homo sapiens
  misc_feature: GYAE6OF01C6YFG.3.33.C11.1.454.CMB.1.raw
  modified_base (224)..(224): a, c, t, g, unknown or other
  misc_feature (224)..(224): n is a, c, g, or t
  modified_base (304)..(304): a, c, t, g, unknown or other
  misc_feature (304)..(304): n is a, c, g, or t
  modified_base (620)..(620): a, c, t, g, unknown or other
  misc_feature (620)..(620): n is a, c, g, or t
tcagagacgcactccacgaccggtgctcgatttagagtgagctcggttggggtttggggggagtcagactcagtcaggacacagcatggacatgacgggtccccgctcagctccgtggggctcctgctgctctggcctcccgaggtgaccaaatgtgaacatccagatcgacccagtcctccctcccacctgtcctgcatctaggaggagacggataccaaccnttacacgttcggaccgggcctagtcaagtagttattacgtacgtggtcgctggatcgagcaagaacgacgaagggaaccncccctaactctagatctagtagactcgtcctaccgtagtttaggactaacgggtcgggtaccagtcgtaaggtcgacggcggcgtaggtagactcggtaacgggaactagtaactcaactacgtaccaactacgtcaaacggtccaacgtccgtacgaacgaacgtccgtaagtacgttaagtacgtttacgaacttaactttataaccgtacgaactaacgtaacgtaataacccgtacggtcggtacgtaccggtacggacggaacggtaccgaagggttagaatacgtatacgtaacgtattacggcgtaacncgtaaccatgttacg

SEQ ID NO: 253144 - DNA, 700 bp, Homo sapiens
  misc_feature: GYAE6OF01APRIS.3.33.C11.1.454.CMB.1.raw
  modified_base (495)..(495): a, c, t, g, unknown or other
  misc_feature (495)..(495): n is a, c, g, or t
tcagagacgcactccacgaccggtgctcgatttagagtgagctcgttgggtttgggggagtcagactcagtcaggacacagcatggacatgagggtccccgctcagctcctgggctcctgctgctctggcctcccaggtgaccaaatgtgacatccagatcgacccagtcctcccctcccaccctgtctgctatctggtagggacgacggagtccacctatccgtaccgttcggcccgggaccagtacgagtagttacttacgtaccgtggttcggtccgtggtactcgagacaagaacgaccggaacgggaacctacccctaacctccgtagtacttacgtagtcgtactccgtccgtacgttaggttcggacgtaacgggtcgggtaccctagtcgtaacggtcgacggcggacgtaggtggtacgtcggtagggtaactaacgttacctactaccgttacctacccactactaccggaactccgacgtccgnggacccgtacgtaccttgttaacgttcgttaacgttacgtaacctttaacgttaattacccgtaagaaccccttaagtacttaaccgttacccgtccggttacgtacggtacccgttaacgaccggtaacggtaccggagggtacgacgttacaacggtcgtaaacgtagtcggttccgacttaccggacctacgttcgtaaccg

SEQ ID NO: 253145 - DNA, 705 bp, Homo sapiens
  misc_feature: GYAE6OF01CUF94.3.33.C11.1.454.CMB.1.raw
  modified_base (204)..(204): a, c, t, g, unknown or other
  misc_feature (204)..(204): n is a, c, g, or t
tcagagacgcactccacgaccggtgctcgatttagagtgagctcgttgggtttgggggagtcagactcagtcaggacacagcatggacatgagggtcccgctcagctcctggggctcctgctgctctggcctcccaggtcgaccaaatgtgacatccagatgacccagtcctccctccacctgtctgcatctgtaggagacggntcaccatcacgtcgccggcagtcagagtattacgtacgttggttcgccgtggtactcgagacaagaacgccgaaagggaaccgtccccctaaacctccgtagtactcctagtgactcgtacctacctaggtttcggacgtaacgggtccgggtacctagtacgtacggttcgaacggcgacgtaggtaggtactcggtaggactagtaacttccgaactcctaccaacctataccgacgtaccgacgtcccgtgaccgtacggtccgtagtaacgtttagttaacgttttacggaaccttttaaaccgttaacgttaccgtaccgtaaacctaaacggttaacgttaaaccgttaaacccgtcccgggttaacgttacccgggtaaccggttaacccggggaaacccgtaacggggtaaacccgtaaggggtacgtacgtaacgtaaccgtaaacgtaccgtaacggtcggttacgaccgtctaaccgacgttcgttaccg

SEQ ID NO: 253146 - DNA, 657 bp, Homo sapiens
  misc_feature: GYAE6OF01AU19M.3.33.C11.1.454.CMB.1.raw
  modified_base (292)..(292): a, c, t, g, unknown or other
  misc_feature (292)..(292): n is a, c, g, or t
tcagagacgcactccacgaccggtgctcgatttagagtgagctcgttgggtttgggggagtcagactcagtcaggacacagcatggacatgagggtccccgctcagctcctgggcctcctgctgctctggctcccgaggtgccaaatgtgacatccagatcgacccagtcctccctccacctgtctgccatcgtgtacggacgacggagtcacctatcacgtggcccggccagtcagtagtattacgtaccgtggttcgccttaggtactcgagcagaacgccgaaggaacncccctaacctcgtagatctatgatcgacctcgtaggttcgacgtaacggtccgggtaccctagttaccgtaaacggttccgaacggtccgggtacgtaggtacggtactccggtacggggaaactaagtaacgtttaccgacgttacctaaccgtacctataccgaacgtcaccgtccgtgaccgtacgtccgtagtaacgttgttaacgtttcgaaccttaacgtttatacctacgacctaatacgttaactaaccgtcccgtacgtacggtaccggttaccgaaccggtaacggtaaccgaagggtacgagtaactaccggtaagtaccgagttcggacgtctaggaccctagtccgttaccg

SEQ ID NO: 253147 - DNA, 750 bp, Homo sapiens
  misc_feature: GYAE6OF01BIKL8.3.33.C11.1.454.CMB.1.raw
  modified_base (498)..(498): a, c, t, g, unknown or other
  misc_feature (498)..(498): n is a, c, g, or t
  modified_base (515)..(515): a, c, t, g, unknown or other
  misc_feature (515)..(515): n is a, c, g, or t
tcagagacgcactccacgaccggtgctcgatttagagtgagctcgttggggtttgggggagtcagactcagtcaggacacagcatggacatgacggtccccgctcagctccgtggggctcctgctgctctcggcctcccgaggtcgacctaaagtggtagacactccgagtatcgacccacgttccctcccctccctacccgtgtctcgctacttcgtaggtaacggacggacggtactaccaaccactctaccgttccggacccggggtaccagttcgaaggtagtttacgttaaccggttaccgttgggttaccggtacgttaggtactacgaacgacgaacgacgaccggtaaacgggaaccctaccccctaactcgtagtacttacgtagtagtactcgtccttacgtagttacggacgtaacgggttccggacctagtacgaagtcgagcgagtaggtgtacgtaggtaggactagtactctactcacgaacnctacgacacgctaccgngacctacgtctagttagttactacgtttactaacttaactttacaacgttaccgaacctaagtaacccgttaactaacccggttcccgtaacgggttaccgtacggggtaaccccgaagggtaaacccggtaaacggtaagggtaccggaaacgttaacggaactaaacgggttaaaccccgagggtttacgtccggggtaactacctaaccccgttagtttcccggtttacccc

SEQ ID NO: 253148 - DNA, 989 bp, Homo sapiens
  misc_feature: GYAE6OF01EP063.3.33.C11.1.454.CMB.1.raw
tcagagacgcactccacgaccggtgctcgatttagagtgagctcgttgggtttgggggagtcagactcagtcaggacacagcatggacatgagggtccccgctcagctccgtggggctcctgctgctctggcctcccgaggtcgaccaaatgtgacatccagatcgacccagtcctcccctcccacccttgtctgcactcgtggtaggacgacggacgtacaccatcaccgttcggcccggccagtcagagttattacgtcgtggttcggccgttggtatcacgacgaaggaacgaccggaacggaaccgacccccttaaccgtcctagtactacgtatcgtacgtcgtccttcgttaggttcgacgtacggttaccggggtaccctacgtaccgtaacggttaccgacggtccgggtacgtacggttacggtacgttcggtaacgggtaccgtaaacggttaaacctttaccgtaccctttacccgtaaccccgtaacctaaccgttaacccgaaccggtaccgtaacccgggtaccccgtaccgggtacccgtaacccgggttacccgttaacggttacgttttaccggttttaacggtttttaaaccggtttaaaccccgtttttaaaaccgtttttttaaaccccggtttaaccccggttaaccggttaaacccccgtttaaaaccggttaaaaccggtttttaaaacccgggtaaaccccgggtttaaaccccccgggtttacgggttaaaccccggggtttaaacccccggggtttaaaaccccgggaaaacccgggggttaaaacccgggggtaaaacccggggttaaaaccgggggttaacgggttaaaaccggtttaacccggttaaaacccggttaaacccggggttaaaccggtttaaaccggggttaccggggttaaaccccgggttcgttaaaccccggtaaccccgttaaccggtttaacccgttttaccccggg

SEQ ID NO: 253149 - DNA, 617 bp, Homo sapiens
  misc_feature: GYAE6OF01BH8VD.3.33.C11.1.454.CMB.1.raw
  modified_base (383)..(383): a, c, t, g, unknown or other
  misc_feature (383)..(383): n is a, c, g, or t
  modified_base (431)..(431): a, c, t, g, unknown or other
  misc_feature (431)..(431): n is a, c, g, or t
  modified_base (490)..(490): a, c, t, g, unknown or other
  misc_feature (490)..(490): n is a, c, g, or t
  modified_base (597)..(597): a, c, t, g, unknown or other
  misc_feature (597)..(597): n is a, c, g, or t
  modified_base (610)..(610): a, c, t, g, unknown or other
  misc_feature (610)..(610): n is a, c, g, or t
tcagagacgcactccacgaccggtgctcgatttagagtgagctcgttgggtttgggggagtcagactcagtcaggacacagcatggacatgaggttccccgctcagctcctggggctcctgctactctggctccgagatgccagatgtgacaccccagatcgacccagtcctccatccctccctgtctgcatcgtggtgggagacagatcatcatctcgttcggccggacaagtcaggtagttgttaagttaattttaatttaaagttgtatactagtaccaaaccgaggaaacgtcccctaagcctctagtactctagtgtctgactactaccgtaagttaacgtaacggtcgggtacctattacgtaaggttctaggtcgngaggtgtactacggtagggactagttacttcgacctactaccaacgtntacgtacgtacgtactaacctaacgtagtaacttacttacgaactaactttactacttntaaccgaatagttacgtaaccaccttaccccgtcgtccttaacgttccggttaccgggaggaccggagtaaggtaccggaagtacttaaccgaaaggtcgtggacgntcacctatcgttntccgttc

SEQ ID NO: 253150 - DNA, 845 bp, Homo sapiens
  misc_feature: GYAE6OF01AC7NR.3.33.C11.1.454.CMB.1.raw
  modified_base (825)..(825): a, c, t, g, unknown or other
  misc_feature (825)..(825): n is a, c, g, or t
  modified_base (834)..(834): a, c, t, g, unknown or other
  misc_feature (834)..(834): n is a, c, g, or t
tcagagacgcactccacgaccggtgctcgatttagagtgagctcgttgggtttgggggagtcagactcagtcaggacacagcatggacatgacggtccccgctcagctccgtggggctcctgctgctcgtggcctcccaggtcaccaaatgtgacatccagactcgaccagtccctcccctaccaccctgtactgcattaccgtaggtaacggacggaaccggtactacccaacctacgttaccgtccgttacggcccgggacctacggtaccaaggtacgttaacgtttacggttaaccggttcgggttaccggaccgttagggtactccggtaagaacgaacggaaacgtaaccggaaccggggtaaaccctacccccccgtaaaccgttaccgttagaaccttacgttaacgtacgtaccgttacccgacccgtttaccgtagggtttacggaaccggttaaccggggttccgggtaaaccctaggttaaccgggtaacggtacgaacgggtaccgtaggtaacggtcggtaacggtcggtaaacgggtaaacggttaacttaaaccgttcccgtaacccgttaccgtaaacccgtaaccttacgaaccccgagtacccacgttacccgtacgaccgtaaccggtctaagggttactttaacgtttaacgttccgtaaacctttacgtttaaacctcgtaaaccctacgtaaagttaaccaaccttaaccgggacttccgggtaaccggtaccggttaaccggaaccggtaaccggacgtaaggacgtacgtaagacaaccgttagtacggtacgtaccgtnaaccccggntcgtcctaccg

SEQ ID NO: 253151 - DNA, 628 bp, Homo sapiens
  misc_feature: GYAE6OF01AQ8UT.3.33.C11.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
  modified_base (340)..(340): a, c, t, g, unknown or other
  misc_feature (340)..(340): n is a, c, g, or t
  modified_base (409)..(409): a, c, t, g, unknown or other
  misc_feature (409)..(409): n is a, c, g, or t
  modified_base (485)..(485): a, c, t, g, unknown or other
  misc_feature (485)..(485): n is a, c, g, or t
  modified_base (614)..(614): a, c, t, g, unknown or other
  misc_feature (614)..(614): n is a, c, g, or t
  modified_base (619)..(619): a, c, t, g, unknown or other
  misc_feature (619)..(619): n is a, c, g, or t
tcagagacgcactccacgaccggtgctcgatttagagtgagctcggttgggtttgggggagtcagactcagtcaggacacagcatggacatgacgggtccccgctcacgctccgtggggctcctgctgctcgtggcctcccgagggtcgaccaaatgtcgacactccgagtatcggacccngttcctcccctccncccgttgtctgcctatcgtggaggagaccggntccactatctacgtccggccggccagtcaggtaatattcggtaccgtggttcggccgttaggtactcgagacgaagacgacggaacggtaacccggccccctaacgtcgtacntacgtagtctatcccgtcctacgttaggttacgacgggttaggtccgggtaccacgtacgtacggtacncggtccgtagagggtctggtacggtaggagtacgtatccctacgccttacgacctactagccgactcgacgttacncgtaactcgtagtacttgtacttactacgtaactctacgacgtactaacgtagttaccgacctcggtactcggtaccggtacgacggtacggaccgtaggagtcgacacgtagacggtatacgcgtacnctacngtacgttcg

SEQ ID NO: 253152 - DNA, 929 bp, Homo sapiens
  misc_feature: GYAE6OF01DY012.3.33.C11.1.454.CMB.1.raw
  modified_base (627)..(627): a, c, t, g, unknown or other
  misc_feature (627)..(627): n is a, c, g, or t
tcagagacgcactccacgaccggtgctcgatttagagtgagctcggttggggtttgggggagtcagactcagtcaggacacagcatggacagtggacggtcccgctcacgctcgtggggctcctgctgctcgtggtcctccgaggtcaactaatgtacgactactccaaggtacaccggaaccctactcccttccccctcccctacccgttgtccgtacggtcctagttacggtacgggttaaggggaaccggtaacgggtacctaccgaaccgtaacttccgtacccggttaccgggcccgggtacctacggtacgtaaggttaacgttacgtttaacgtacggttcgggtttacggccgttaggtacctagaacggtacgaacggacgaccgaaaccgggacccctacccctaacgtacgtataccgttatacgaccgttaggtccctaccgtttacggtacgggtttacgaaccgggtttagggtcccgggtaaccttaggtaccggttaacggtaccgggaggtaccggggtaacgttacgggaacggtcgggtacgtaacggggtaactaaccgggttataaccttacccgtaccacccgtaacactaccgagtaccggacncgtaccgtctaacggcgttacgtagtttacgttaccgtaacggttaacttaaccctttacgtaacccgaacgtaaccggtaaaccttacgtaacccggttaacccgggtaccgttaccgggttaaccggtacccggggtttaacccgaaacgggggttaacccggggttaaaacgcggggggtaaaacgtttaacccggaaaggggtttaaccctaaaacgggtttaaccggggtaaccgtttcgggggtaaacccgtcccggaaaacctttcccggttaaccggttaaccgttttaccggg

SEQ ID NO: 253153 - DNA, 852 bp, Homo sapiens
  misc_feature: GYAE6OF01AU0Y9.3.33.C11.1.454.CMB.1.raw
  modified_base (569)..(569): a, c, t, g, unknown or other
  misc_feature (569)..(569): n is a, c, g, or t
tcagagacgcactccacgaccggtgctcgatttagagtgagctcggttgggtttgggggagtcagactcagtcaggacacagcatggacatgacgggtccccgctcagctccgtgggctcctgctgctcgtggcctcccgagggtcgacctaaagtcggtacgaaccactccgaagtactaccgaaccccgtacgttcccttaccccctcccacccgttcgtccgtcgacctagttcggtacggtaacgggacgtacgggaactaccaacctacgtaccgtaccggttcgggaccccggaccgtaacggtcgaagttacgttacgttacggttaccggttgggttccgtccgttaggtacacgacggtacgaaggaccggaccggaacgggtaaccctccccgttaacctcgactactacgtacgtacgtacgtcctccgttacgtaggttacgacgtacggtaccgtacctacgtaccggttaacgtacggacggtacgtacgagtcggtacgttacgacggactacgtactcgtaccttacacctacagtacggactacgaccgtcncgggtaacctgtacggttgttacgttaagtttaccgttacgtaactttaaccgttccgttaaacgactaaccgtaacttaaccgtaaacggttacccgttaccgggttagtaaccccgggtttaacccggtaccggggtaaaccgttaccggggtaaacgttaacgggtaccgggttaaactaccgggtttaaacccggtaacggttaacccgggttaccggtttcgggtaaacccgttaccccggtaaaccggttaccttaacccggggtttctttacccgg

SEQ ID NO: 253154 - DNA, 640 bp, Homo sapiens
  misc_feature: GYAE6OF01C6NPY.3.33.C11.1.454.CMB.1.raw
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
  modified_base (626)..(626): a, c, t, g, unknown or other
  misc_feature (626)..(626): n is a, c, g, or t
  modified_base (632)..(632): a, c, t, g, unknown or other
  misc_feature (632)..(632): n is a, c, g, or t
tcagagacgcactccacgaccggtgctcgatttagagtgagctcggttggggtttgggggagtcagactcagtcaggacacagcatggacatgacgggtccccgctcagctccgtggggcctccgtgctgctctggcctcccaggtcgaccaaagttgtgaacgtactccaaggtactccggacccctagttccctacccctcccaccgttgtccngctatcgtaggtaggacgacggactaccacctntcgaccgttcggcccggactagtacagtagttacgtacgttaccgtcgttcgcttaggtactacgacgaacgaacgaccgagacacgtacccaacccgatccgttcttagtcctgacgtctaccgaccttacgtagttccgacgtacggtacggaccgtaccaacgtacgtcgacgngtacgnggtacgcgtacggacgagtattactaccgactacacgaccacacgacncgacncctgacgcgtcgacgtacagtggtactacgtacttagtacctacaacgtaacgtgttatacttagttacggtggttaacggtcggtaccggaacgaaggtacgaaagtacgtaaagaacgtaactacggtacgtacgtacngtaccnctcgtacg

SEQ ID NO: 253155 - DNA, 651 bp, Homo sapiens
  misc_feature: GYAE6OF01CQ9V8.3.33.C11.1.454.CMB.1.raw
  modified_base (618)..(618): a, c, t, g, unknown or other
  misc_feature (618)..(618): n is a, c, g, or t
  modified_base (639)..(639): a, c, t, g, unknown or other
  misc_feature (639)..(639): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggcctcccaggtgccaaatggtgacatccagatcgacccagtcctccctccaccctgtctgcatctgtaggagacggagtacaccatcgacttcggccgggcagtcagagtattacgtacgtggttcgctggtatcgagacagacgaccgaaggaaccgtacccctaactcgtagactctatgactcgtcctacgttaggttcggacgtaacggtccggggtaccctaggtacctaaggttcgaacggcgggtacgtaggtggaacgtcggtacgggactaagtacttccgaccttcctcaacccgtatccaacggtcacggcctcgcacgtccgttggattagttacgtttactaccttaactttacgttacctacgtaacctaactaaagttaacctacccgtaccggttacgtaccggtacggttaaccgggaaccggtaaacgggaccgtaagggtacgaacgtacgtaaccgtaataaccgggtntcgtacggtactaggtaaccncgtacgtttacg

SEQ ID NO: 253156 - DNA, 925 bp, Homo sapiens
  misc_feature: GYAE6OF01DWZUR.3.33.C11.1.454.CMB.1.raw
  modified_base (634)..(634): a, c, t, g, unknown or other
  misc_feature (634)..(634): n is a, c, g, or t
  modified_base (881)..(881): a, c, t, g, unknown or other
  misc_feature (881)..(881): n is a, c, g, or t
  modified_base (889)..(889): a, c, t, g, unknown or other
  misc_feature (889)..(889): n is a, c, g, or t
tcagagacgcactccacgaccggtgctcgatttagagtgagctcgtttgggttgggggagtcagactcagtcaggacacagcatggaacatggacggtccccgactcagctcccgtggggccttccgtgctcgtcgttccgtcggccttcccgagggttccaacctaaagttgtacaaccactccgaagtacgtaccgacccctaacgtccccttaccccctcccgtaaccccgttggttcctcgtccgtaacgttcgtagggtaaccggggacgaccgggtaaacgttccgaacccttactaccgttaaccggtcccgggaccggtacccgtagtaaccgtacggttaagttaacgtttaaccggtaccgttttggggttacccggtagtttaacgggtactaccggtaacggaaaccggtaaaacggaacccgggaaccgaaaccggggtaaacccctccccccgtttaaaccggtctaaaacccggtattttacgggtagttaccggaccgttttacccgacccgggttttacggttaaacgggttacgggtaaaccgggttaacggggtttaccccgggacctaacgtaccggtaaaggtaccggcggtaccgtgaggtttaacccgggntttaaccggacggtaaaagaccctttacgtacttaccgtaaccctactaacctacgtacggtaacgtacccgtaacggtacgtacgtacgaccgttcggttaccgttagttaccggtttatttaacccggtactttaaccgtttactaacccgtaacggtaaacttaacccggtaattaacgaacccgttacggtaacgtaccggtacggtaaccggtaacccgacggtaaccgaggtagtctaaancgtaaacngtaacgtggtaccaggtaccacccttagtcttaccg

SEQ ID NO: 253157 - DNA, 795 bp, Homo sapiens
  misc_feature: GYAE6OF01BEM89.3.33.C11.1.454.CMB.1.raw
  modified_base (557)..(557): a, c, t, g, unknown or other
  misc_feature (557)..(557): n is a, c, g, or t
tcagagacgcactccacgaccggtgctcgatttagagtgagctcgttgggtttgggggagtcagactcagtcaggacacagcatggacatgagggtccccgctcagctccgtggggctcctgctgctctggcctcccgaggtcgaccaaatgtcgacatccagatcgacccagtccctcccctcccaccctgtctgcattcgtaggtaggaggacggacgtacacctatctacgttcgccgggccagtcgagtagttattaacgtaccgttggttcgccgttaggtacaccaggacaacggaacgcccggaaacggggtaaccctaccccccgttaaccctcgtacggtaacttaccgtaaggtcgtacgttccggtacccttacggttgggtttacggaacggtaccggggttaccgggtaccctaagttaccggttaacggtaccgaacgggtccgggaagttagggtacggtacgtacgggtaacggaaacctaacgttacttcccgaacttcccgtaacctaccgtacgtaccgacgaccgacgtccccgtanaccgaccgtcgtagttacgttacgttttagtttacaaccttttacgttaactaccgttacaacccgtaaacgttaccgttaaccgtaacccggttaccggttacgttaacgggttaacccggttaacgggaccgggtaaccgggaccggttaagggtccgtaaggttaccctaggttaaaccggtacccggttacggttgggtacgccccgttaacgacctaaccgtttgttaccccg

SEQ ID NO: 253158 - DNA, 1163 bp, Homo sapiens
  misc_feature: GYAE6OF01CB98C.3.33.C11.1.454.CMB.1.raw
tcagagacgcactccacgaccggtgctcgatttagagtgagctcgttgggtttgggggagtcagactcagtcaggacacagcatggacatggacgggtccccgctcagctcctggggcctcctgctgctcgtggcctcccgagggtacgaccaaaagttcggttacgaaccacttacccgaaggtagtaccggaccccgtaacggtttccccttcccccctaccccgtaaccccgtttggttcccgtcgtacctaacgttccggtttaggggtaaacggggaaccggtaaccggggtaaccgttaccgaaaccctacgtttacccggttaccggtttacccggggacccccgggggtaccgtacggttaacccgtaaagggtaacggttttaaaccgtttttaccgggttaacccgggtttcgggggttttaccggggtacccgttttacggggttaaccttaaccggtacgggaaccggtaaacggggaaacccggggtaacccccgggtaaaacccggggggtaaaacccccccgttaaccccccccggttaaacccgtttccccggttaacggtaacctttacgttaaacgttaccggtaccgttaccggttaccccgtttacccgggtttaaacgggtttaccgggttaaccgggttaaacccgggggtttaccggggttaacccccgttacggtttaaacccgggggtaacgtttaccggggaaccgggtacggtaccgggtaacgggttaggtaaccggttaaccgggttaacgggtaaaccgtaaacgttaaaccgtttcccctaaccgttccccgtaaaccgtaccgttaaacccgcgaacccgggttagaacccccggtccgttaacggacccgggtaccgtttccggttaaggttacctttttaggggtttaaaccttttaaccggttaaccctttaacggtttttaacccgtttaacccgacggtaaaacccctttaaggtaaacggttttaaacccgtaacccggggtttacctaaccgggggtttacccgaacccggtttaacggggaacccggttaaaccgggggaacgttagggtcgaaacgttgtaaaccggttgtaccggttaccggtagggacctccgtaaccggactcccggttttatacccgg

SEQ ID NO: 253159 - DNA, 496 bp, Homo sapiens
  misc_feature: GYAE6OF02IH1RE.3.33.C11.1.454.CMB.1.raw
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaactcctgatctatgatgcctccagtttggcagtggggtcccatcaaggttcagcggcagtggatctgggacagaattcactctcaccatcagcagcctgcagcctgattgattttgactaactttattactgaccaactagtaataactacccgcgttgaccgttcggaccaagggaccaagggtggagatcatacgaacttgtggctgcaccatc

SEQ ID NO: 253160 - DNA, 486 bp, Homo sapiens
  misc_feature: GYAE6OF02H0M83.3.33.C11.1.454.CMB.1.raw
tcagagacgcactccacgaccggtgctcgatttagagtgagctcgttgggtttggggagtcagactcagtcaggacacagcatggacatgagggtcccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtggggtcccatcaaggttcagcggcagtggatctgggacagaattcactctcaccatcagcagcctgcagcctgatgattttgctaacttattactgaccaacagtaataatacccgcgttgacgttcggaccaagggaccaagatggagatcatacgaactgtgctgcacta

SEQ ID NO: 253161 - DNA, 500 bp, Homo sapiens
  misc_feature: GYAE6OF02IMR9U.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtggggtcccatcaaggttcagcggcagtggatctgggacagaattcactctcaccatcagcagcctgcagcctgattgattttgctaacttattactgaccaactagtaataatacccgcgttgaccgttcggaccaagggaccaaggtggagatcatacgaacgtgtacggctggctaccatcg

SEQ ID NO: 253162 - DNA, 487 bp, Homo sapiens
  misc_feature: GYAE6OF02IQM91.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaaacctcctgatctatgatgcctcagtttggcaagtggggtcccatcaaggttcagcggcagtggatctgggacagaattcactctcaccatcagcagcctgcagccctgattgattttgctaacttattactgccaacagtataatacccgcgtgacgttcggccaagggaccaaggtgagatcgatacgaatgtggctgcacatc

SEQ ID NO: 253163 - DNA, 511 bp, Homo sapiens
  misc_feature: GYAE6OF02HFQFW.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaacgcccctaacctcctgatctatgatgcctcagtttggcaagtggggtcccatcaaggttcagcggcagtggatcgtgggacagaattcactctcaccatcagcagcctgcagcctgattgtattttgactaactttattactgaccaaactagtactaacgtacccgagttcgacggttccggaccaagggaccaagggtggaagtatcaagtacgagtgtggctaggcctacatcg

SEQ ID NO: 253164 - DNA, 515 bp, Homo sapiens
  misc_feature: GYAE6OF02HFDGP.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaactcctgatctatgatgcctccagtttggcaagtggggtcccatcaaggttcagcggcagtggatcgtgggacagaattcactctcaccatcagcagcctgcagccctgattgtattttgacctaactttattactcgaccaactagttaataactacccgcgtcgtacgttcggacaacgggacctaagggtggagtatacgaagtacgtaatggtacggctcgacactatcg

SEQ ID NO: 253165 - DNA, 491 bp, Homo sapiens
  misc_feature: GYAE6OF02F8S1K.3.33.C11.1.454.CMB.1.raw
  modified_base (481)..(481): a, c, t, g, unknown or other
  misc_feature (481)..(481): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaagcccctaacctcctgatctatgatgcctccagtttggcaagtggggtcccatcaaggttcagcggcagtggatcgtgggacagaattcactctcaccatcagcagcctgcagcctgatgattttgctaactttattactgaccaacagtaataatacccgcgtgacgttcggaccaagggaccaaggtggaagatcaatacgaactgngctgcacatc

SEQ ID NO: 253166 - DNA, 535 bp, Homo sapiens
  misc_feature: GYAE6OF02F9XRA.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctgggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaagcccctaacctcctgatctatgatgcctcagtttgcagtggggtcccatcaaggttcagcgcagtggatcgtgggacaggaattcactctcaccatcagcagcctgcagcctgattgattttgctaactttattactgaccaacagttaataaactacccgacgttacgaccgtttcggaccctaaaggggacccaagggtcgggaacgtatccgaagttacggtaaacttggtcgggtaccttggacctacccgattcccgg

SEQ ID NO: 253167 - DNA, 536 bp, Homo sapiens
  misc_feature: GYAE6OF02JA3GV.3.33.C11.1.454.CMB.1.raw
  modified_base (417)..(417): a, c, t, g, unknown or other
  misc_feature (417)..(417): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgtatctgtaggagacggagtcaccatcacttgccgggccagtcagagtattagtacctggttggcctggtatcagcagaagccagggaaacgcccctaacctcctgatctatgatgcctcagtttggcaaggtgggtcccatcaaggttcagcggcagtggatcgtgggacagaattcactctcaccatcagcagcctgcagcctgatgtattttgacttaactttattactntacacaagtataactaccgtcgtacgtacgttaccggaccgaacgggaccgaacggtaggaggaacgtactacgtaacgtaacgtacggttaggtcgtacgactaccgtactcgttccg

SEQ ID NO: 253168 - DNA, 540 bp, Homo sapiens
  misc_feature: GYAE6OF02GLZJU.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaacgcccctaacctcctgatctatgatgcctccagtttggcaagtggggtcccatcaaggttcagcggcagtggatcgtgggacagaattcactctcaccatcagcagcctgcagcctgattgtattttgctaacttattactgacctaacagtactaactacccgtacgtcgtacggttccggaccgtaacgggacctaagggtcggaaggtattaccgaagttaaccggaacgttcggttacgggccttggacctacccattcccg

SEQ ID NO: 253169 - DNA, 520 bp, Homo sapiens
  misc_feature: GYAE6OF02IJV19.3.33.C11.1.454.CMB.1.raw
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtctccctccaccctgtctgcatctgtaggagacggagtcaccatcacttgccgggccagtcagagtatagtacctggttggcctggtatcagcagaagccagggaacgcccctaacctcctgatctatgatgcctcagtttggcaagtggggtcccatcaaggttcagcggcagtgatctgggacagaatcactctcacatcagcagcctgcagcctgattgtattttgactaacttattactgaccaactagtaactaacgtacccgcgttacgaccgttcggaccgaagggaccaagggtcggaagtactacgaagtaccggaacttggtacggcctaggcctaccgtatccg

SEQ ID NO: 253170 - DNA, 522 bp, Homo sapiens
  misc_feature: GYAE6OF02IQE36.3.33.C11.1.454.CMB.1.raw
  modified_base (440)..(440): a, c, t, g, unknown or other
  misc_feature (440)..(440): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccgagggaaacgcccctaacctcctgatctatgatgcctccagtttggcaagtggggtcccatcaaggttcagcggcagtggatcgtgggacagaattcactctcacatcagcagcctgcagcctgattgtattttgactaactttatacctgaccaacagtaataactacccgngttgacgttcggaccgaagggaccaagggtgggaagtatacgaagtaaccgaacgtggtcggcttacgactaccgtattccg

SEQ ID NO: 253171 - DNA, 586 bp, Homo sapiens
  misc_feature: GYAE6OF02HTWHD.3.33.C11.1.454.CMB.1.raw
  modified_base (273)..(273): a, c, t, g, unknown or other
  misc_feature (273)..(273): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtgggagacagagtcatcatctcttgccgggcaagtcagagtgttagtatttattaaattggtatcagttcaaacagggaaancccctaagctctgatctatgctgcatccagtttacaaagtggggtccatcaaggttcagtgcgagtggatctgggacaggatttcactctcaccatcaagcagtctaacagtcctagaagtattttgactaaactttactaacctggtacctaaacgtagtaagtttaaccaaggttaactttggttaacttttccgtaacttttccgggaccccttaggggaacccttaaaggtcgggaaactaacgttaaccgaaaaccggtaaaccttggtacgggaccttacggaccctaaacccgtcttacttaccgg

SEQ ID NO: 253172 - DNA, 557 bp, Homo sapiens
  misc_feature: GYAE6OF02I3OII.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaacgcccctaacctcctgatctatgatgcctcagttggcaagtggggtccatcaaggttcagcggcagtggatcgtgggacagaattcactctcaccatcagcagcctgcagcctagatgtattttgacttaactttattacctacgaccaaactagttaactaacgttacccggtacgttcggtaccggttacgggaccgtaaaggggaccgtaagggtacggaagtacgtacgaacgttaacggtaacgttggtacggaccgtacggacctacctagttaccg

SEQ ID NO: 253173 - DNA, 512 bp, Homo sapiens
  misc_feature: GYAE6OF02JR5OE.3.33.C11.1.454.CMB.1.raw
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggatcaccatcacttgccggccagtcagagtattagtacctggttggtcctggtatcagcagaagccagggaaacgcccctaaacctcctgatctatgatcgcctccagtttgcaagtggggtccatcaaggttcagcggctagtgatcgtgggacagaattcactctacacatnagcagcctgcagcctnattntatttgacctaatttactactgacctaanagtaactaataacccgngttcgaccgttgaccaacgggacaggtgacggtatacgtataaccgagtggtcgacgtcgctacctatccg

SEQ ID NO: 253174 - DNA, 523 bp, Homo sapiens
  misc_feature: GYAE6OF02FQ765.3.33.C11.1.454.CMB.1.raw
  modified_base (516)..(516): a, c, t, g, unknown or other
  misc_feature (516)..(516): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggcagtcagagtattagtacctggttggcctggtatcagcagaagccagggaacgcccctaactcctgatctatgatgcctccagtttgcaagtggggtcccatcaaggttcagcggcagtggatcgtgggacagattcactctcacctatcagcagcctgcagcctgattagattttcgactaacttattactgaccaatagtactaactacccgtcgtagtacgttcggaccgtaagggaccaagggtcggaagtatacgtaataccgaacgttggtacggacctagacctaccngttaccg

SEQ ID NO: 253175 - DNA, 650 bp, Homo sapiens
  misc_feature: GYAE6OF02J17J4.3.33.C11.1.454.CMB.1.raw
  modified_base (164)..(164): a, c, t, g, unknown or other
  misc_feature (164)..(164): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (498)..(498): a, c, t, g, unknown or other
  misc_feature (498)..(498): n is a, c, g, or t
tcagagacgcactccacgaccggtgctcgatttagagtgagctcgttgggtttgggggaggtcagactcagtcaggacacagcatggacatgagggtcccgctcagctcctgggctcctgctgctctggcctccaggtgccaaatgtgacatccagatgacccngtcctccctccaccctgtctgcatctggtaggagacggatccacctatctacttcggccgggccagtcaagagttattacgaccgttggttcggcctggtatcagtacagaacgccgagggtaaacncccctaacgtccngtaactctaatgactcgcctcgtagtttcgacgtaggtcgggtccattcgaacggttcaacggtcggatacggtagggtacttcgggtacggaagtaacttaacttccgaacgttccttaccaacctagtaccgacgccaacggtctcgaccgtacgccgttgaacttgttacgtttcgaaccttaccgtttanacttaacgacctaaacgttacggttaaacctaaccgtacccggttagtaccggttaccggtaccggaacgtaaaccgggtacttagggtaccggtaacgtactacggttaacaaccggtacgttcggtagccttcggaaccttacggtctcg

SEQ ID NO: 253176 - DNA, 617 bp, Homo sapiens
  misc_feature: GYAE6OF02FMRBO.3.33.C11.1.454.CMB.1.raw
  modified_base (293)..(293): a, c, t, g, unknown or other
  misc_feature (293)..(293): n is a, c, g, or t
tcagagacgcactccacgaccggtgctcgatttagagtgagctcgttggggtttgggggagtcacgactcagtcaggacacagtcatgggacatgagggtccccgctcagctcctggggctcctgctgcttcgtggctcccaggtgtcccaaatgtgactaatccagatgacccagtctccctccaccctgtctgcaggtctggtaggagacggagtcaccatcacttcgccggcagtcagagtattagtaccttggtcggtcctaggtatcgagtcagaagccgagggaacncccctaacctcctagactcgtatgatcggcctccgtagtttggctaaggtggggtcccagtacgaaggttcagacggcaggtcggatcgtgggacagtacttcactctacacctatcgaagcacgtcctagacacgcctagtattgtatttcgaacttaacgtttactacgtacgtaaccaacgtagtaactaaccgtacccggtagttacggtaccggtttacgaacccgtaaaggggaccgtaaggggtacggaacgtacgtacgaaagttaaccggtaacgttcggtaacggtaccgttacggtacctaccgtagttccgg

SEQ ID NO: 253177 - DNA, 604 bp, Homo sapiens
  misc_feature: GYAE6OF02GCYOD.3.33.C11.1.454.CMB.1.raw
  modified_base (276)..(276): a, c, t, g, unknown or other
  misc_feature (276)..(276): n is a, c, g, or t
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtcctccctccaccctgtctgcatctgtaggagacggagtcaccatcacttgccgggccagtcagagtattagtacctggttggcctggtatcagcagaagccaagggaacncccctaacctcctgactctatgatcgcctccgagtttcggactaagggttcgggggtcccagtacgtaagggttcaacggtcggcgaggtgggattcggtaggggaactaaggtaacttccaacttcctaccaacctaatccaaggcacgtccctgacacggtccctagtattgttattttgaccttaactttacttactcgtacctaaactagttaactaacgtaccgtcgtacgtaccggttcggacgaacgggacgaagggtcggaacgtactacgaacgttaccgaacgttcggtacggtacctcggacctacccgtattaccg

SEQ ID NO: 253178 - DNA, 571 bp, Homo sapiens
  misc_feature: GYAE6OF02IJ7LO.3.33.C11.1.454.CMB.1.raw
  modified_base (273)..(273): a, c, t, g, unknown or other
  misc_feature (273)..(273): n is a, c, g, or t
  modified_base (310)..(310): a, c, t, g, unknown or other
  misc_feature (310)..(310): n is a, c, g, or t
tcagagacgcactccacgaccggtgctcgatttagagtgagctcgttgggtttgggggagtcagactcagtcaggacacagcatggacatgagggtcccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagagcagggaaacncccctaactcctgatctatgatcgcctcagtttcggnaaggtgggtcccatcgaaggttcagcgcagtggatcgtagggacagtaattcactctacaccatcagcagcctgcagcctagacttgtattttcgacttaactttattactcgacctaaatagttaactaaacgtacccgacgttacggtaccggttccgggaaccgtaaaggggacccgtaaggggtacgggaagtaacgtaccaaacgttaaccgtaaacgttcgggtacggtccgtacggacctacccgtattaccgg

SEQ ID NO: 253179 - DNA, 591 bp, Homo sapiens
  misc_feature: GYAE6OF02HH3G6.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacttgccgggccagtcagagtatagtacctggttggctggtatcagcagagccagggaacgcccctaactcctgatctatgactgcctcagtttcggactaaggtggggtcccatcgaaggttcaggcggcgaggtggatcgtagggactaggaattccactctcaccatcagcacgcctgcacgcctagatgtattttcgactaacgttttactactagtacctaaacgtacgttaactaacttaccccgtagttacggtaacccggtttaccgggaacccgtaacggggacccgtaaaggggtacggtaaagtacgttacgaacgttaacccggtaagttcggtacggtaccgtacggaccctacccgtagttcccg

SEQ ID NO: 253180 - DNA, 661 bp, Homo sapiens
  misc_feature: GYAE6OF02IA61F.3.33.C11.1.454.CMB.1.raw
  modified_base (63)..(63): a, c, t, g, unknown or other
  misc_feature (63)..(63): n is a, c, g, or t
  modified_base (516)..(516): a, c, t, g, unknown or other
  misc_feature (516)..(516): n is a, c, g, or t
  modified_base (576)..(576): a, c, t, g, unknown or other
  misc_feature (576)..(576): n is a, c, g, or t
  modified_base (644)..(644): a, c, t, g, unknown or other
  misc_feature (644)..(644): n is a, c, g, or t
tcagagacgcactccacgaccggtgctcgatttagagtgagctcgttgggtttgggggagtcngactcagtcaggacacagcatggacatgagggtcccgctcacgctccttcgggcgtccttcgcgtcgctcttcggcttcccacgtgcctaaactgtagacataccagatgaccacgtacctcctccaccctcgtcctcgctactctagtaggaggacggacgtacaccgtactcctacgttttcggccgggcgaacgtccgacgtagttacgttaacgtaccgttggttcggtcgttggtaactcgtcgacgaagaacgcggaacggaaaccgtccctaaccgtccttacgacttacttacgttacgtacgtcgtccttcgtacgttttcggacgtacggttccggtcctacgtcgtacgtacgtcgacgacgacgtcgtacgtacgtacgactaagttacgttacacgttcacctacactacgcgtacgcgtaccgtgaccgaagtcgtagnttacgttactttacgacttaacttaactaactcgacctactacgtaacctaacgtaccgngttaacgacgtacgacgtagacgaagtgaacgtaactcgaacgtacgtaaccgtggtaccgaccgtanaccgttacacgtttacc

SEQ ID NO: 253181 - DNA, 594 bp, Homo sapiens
  misc_feature: GYAE6OF02H3D4W.3.33.C11.1.454.CMB.1.raw
  modified_base (276)..(276): a, c, t, g, unknown or other
  misc_feature (276)..(276): n is a, c, g, or t
  modified_base (387)..(387): a, c, t, g, unknown or other
  misc_feature (387)..(387): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccaagggaacnccccgtaaacctcctgatctatcgatgcctccgagtttggctaaggtggggtcccatcaaggttcagcggcgagtggatctgggacagaattcgactctacaccatcagcngcctgcagcctgatgtattttgactaacttattacgtcgaccctaactacgtaacttaaacttacccggtcgttacgggtaaccgtttaccggggaccgtaaacgggggaccccgtaaagggtagggtaacggaacgttaccgtaaagttaaccggtaaaccgtttacggttcgggtacccgtagtacccggacccgtattacccgg

SEQ ID NO: 253182 - DNA, 529 bp, Homo sapiens
  misc_feature: GYAE6OF02ICMW7.3.33.C11.1.454.CMB.1.raw
  modified_base (339)..(339): a, c, t, g, unknown or other
  misc_feature (339)..(339): n is a, c, g, or t
  modified_base (441)..(441): a, c, t, g, unknown or other
  misc_feature (441)..(441): n is a, c, g, or t
  modified_base (525)..(525): a, c, t, g, unknown or other
  misc_feature (525)..(525): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtagggagacggagtcaccatcacttgccggccagtcagagtattagtacctggttggcctggtatcagcagaagccagggaacgcccctaactcctgatctatgatgcctcctagtttgctaaggtcgggtccatcaagttcagcggnagtggatcgtgggacagtactcactctcacatcagcagctgacacgcctgattgtatttcgacttaacttattactgacctaacaagtactaaactacccgngttacgtacgttaccgggaccaaggggacctaagggtcggaagtactacgaacgtaacgacgttggtaggccgtgacctaccgnttcg

SEQ ID NO: 253183 - DNA, 536 bp, Homo sapiens
  misc_feature: GYAE6OF02II1P0.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccaagggaaacgcccctaaacctcctgatctatgatgcctcagttgcaaggtcgggtccatcaaggttcagcggcagtgatcgtgggacaagtaattcatctacacatcagcacgctgcacgcctgattgtattttgactaatttactactagaccaaatagtaactaacgtaacccgtcgtacgtacgttcgggacctaagggacctaagggtacgaagtatacaagttaaccgaacgttcggtacggacctaggacctaccgagttccg

SEQ ID NO: 253184 - DNA, 538 bp, Homo sapiens
  misc_feature: GYAE6OF02G9ZSE.3.33.C11.1.454.CMB.1.raw
  modified_base (277)..(277): a, c, t, g, unknown or other
  misc_feature (277)..(277): n is a, c, g, or t
  modified_base (421)..(421): a, c, t, g, unknown or other
  misc_feature (421)..(421): n is a, c, g, or t
  modified_base (445)..(445): a, c, t, g, unknown or other
  misc_feature (445)..(445): n is a, c, g, or t
tcagagacgcactccacgaccggtgctcgatttagagtgagctcgttggggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggcagtcagagtattagtacctggttggctggtatcagcagaagccgaagggaaacncccctaaactcctagatctatgatgcctctagtttggcaaggtcgggtcccaatcgaaaggttcaggcggacagtggatcgagggacagaattcactctacacatcagcagcctgacagctgattgtatttgactaattatacngaccaatagtaactaacgtcccgngtacgtacgttcgaacgaacgggtacaaggggtggaaacgtactacgaacgtaaccgtaagtggtcggacttaggaccctacgtatttaccgg

SEQ ID NO: 253185 - DNA, 715 bp, Homo sapiens
  misc_feature: GYAE6OF02HM6DC.3.33.C11.1.454.CMB.1.raw
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatcgacccagtcctccctccaccctgtctgcatctgtaggagacggatcaccatcacttggccggccagtcagatattagtacctggttgcctggtatcagcaagaagccgaagggaaaccnccccgtaacctcctagatctancgatcgcctccgtagtttcggactaagggtcggggtacccaagtcgtaaaggttcgaaggcggacgtaaggtgggaacttccgtaggggaacctaagtaaactttccgaaccttcttacccaaccctagtacccaaggtaccaaccggtcccgttggaccacggtacccgttaggtaacgttggttaactttttcgaaaccttaaactttttaaactttaccgtacgtaaccccgtaaaattaacgttaaacttaaaaccgtacccccgggttacgtttaacgggtaacccggtttaaccgggaacccggtaaacggggtaacccggtaaaggggttcggaaaggtacctaacggtaaacgttaacccgtaaaggttcggtacgggccttacggaacctacccgtagttacccg

SEQ ID NO: 253186 - DNA, 594 bp, Homo sapiens
  misc_feature: GYAE6OF02IHM3R.3.33.C11.1.454.CMB.1.raw
  modified_base (277)..(277): a, c, t, g, unknown or other
  misc_feature (277)..(277): n is a, c, g, or t
  modified_base (350)..(350): a, c, t, g, unknown or other
  misc_feature (350)..(350): n is a, c, g, or t
  modified_base (391)..(391): a, c, t, g, unknown or other
  misc_feature (391)..(391): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacttgccgggccagtcagtagtattacgtacctggttggctggtatcagcagaagcaagggaacncccctaacctctagactctatgatcgcctcgtgttggctaaggtcggggtaccagtacgaaggttcaggcggngacggtgtactcggaggaacagtaacttcgactcacaaccntacagacacgctgcacgtcagtatgttatttgaaccttaattntaccgngaacctaataacgtaacgttaaacgtacccgtggttaaccgtacggttccggaaccgaaacgggggtaccaaaggggttcggaaagtaaccgttaacgaacggttaaccggaacgttcggtacgtaccggtacgtaccgtaccctaagtttccg

SEQ ID NO: 253187 - DNA, 558 bp, Homo sapiens
  misc_feature: GYAE6OF02HAWGH.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccaagggaaacgcccctaacctcctgatctatgatgcctcagtttggacaaggtcggggtcccatcaaggttcagcggcaggtggatcgtagggacagaattcactctcacctatcagcagcctgcagcctgattgtattttgacctaaacttattacctgacctaaactagtaataaacgtacccgtcgttacggtaccgttaccggacccgtaaggggaccgaagggtcggaaggtactacgaacgttaccggaacgttcggtcggtactacggacctaacctagttaccg

SEQ ID NO: 253188 - DNA, 532 bp, Homo sapiens
  misc_feature: GYAE6OF02GKWTF.3.33.C11.1.454.CMB.1.raw
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (391)..(391): a, c, t, g, unknown or other
  misc_feature (391)..(391): n is a, c, g, or t
  modified_base (449)..(449): a, c, t, g, unknown or other
  misc_feature (449)..(449): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttggccgggccagtcagagtattagtacctggttggcctggtatcagcagaagccgagggaaacgcccctaacctcctgatctatgatgcctcagtttggcaaggtcgggtcctatcgaaggttcagcggcagtggatcgnggganagtaattcactctcactatcagcagcctgacngcctagatgtatttcgacttaactttactactcgaccaagtagtaactaacgtaccgngtacgtaccggtcggaccgaacgggacagggtaggagtactacgacgttaacgacgttggtcggcgtcgactaccgattaccg

SEQ ID NO: 253189 - DNA, 518 bp, Homo sapiens
  misc_feature: GYAE6OF02FKUPU.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaacgcccctaacctcctgatctatgatgcctcagtttggcaagtggggtccatcaaggttcagcggcagtggatcgtggacagaattcactctcaccatcagcagcctgcagcctgattgtattttgactaactttatactgaccaagataactaacgtacccgcgtacgtacggttacggaccgaagggaccaagggtcggaagtatacgaagtacgaacgtggtacggtcgtacgccactattcg

SEQ ID NO: 253190 - DNA, 535 bp, Homo sapiens
  misc_feature: GYAE6OF02GJ4TY.3.33.C11.1.454.CMB.1.raw
  modified_base (277)..(277): a, c, t, g, unknown or other
  misc_feature (277)..(277): n is a, c, g, or t
  modified_base (432)..(432): a, c, t, g, unknown or other
  misc_feature (432)..(432): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgcccgggccagtcagagtattagtacctggttgcctggtatcagcagaagccaagggaaacncccctaacctctgactctatgatcgcctcagtttcggctaaggtcggggtcccatcgaaggttcgagcggcaggtggatcgtgggacagtaacttcgactctacacctatcagcacgcctggcagccctgatgtatttcgacttaacttattacngacctaatagtataacgtccgtagtcgacgttacgacgtaacggacgtaggtacggatactcgaacgttacgtaattcggtcgtctacgacctacgtacttcg

SEQ ID NO: 253191 - DNA, 886 bp, Homo sapiens
  misc_feature: GYAE6OF02HINFQ.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccgaagggaacgcccctaacctcctgactctatgatcgcctccgtagttttcggacgtaaagggttcgggggttaccccaagttaccgtaaacgggtttccaacgggccggggtaccgaaggggtttacgggtaacgtttccggttacggggggaaaccgtaacgggttaaaacttttcccgtaaacctttcccgttaacccaaaccccgtaacgtttacccgaaacgggtaccccgaaaccgggttcccccgtttacgggacccgtaaccgggttacccccttaggggttaaactttacgggttttaaacgttttttttccgggaaacccttttaaaaacccgttttttaacctttttaaacccgttacggtaaacccccgttaaaaaccggttaaacgggtttttaaaacctttaaaacccggttaacccccccgggttaccggtttaaccggggtttaaccccgggttttaacccggggtaaccccggtaaaacggggggtaacccccgtaaaaggggggttacgggtaacggtaaaccgttaccgtaaacgttaaacccggtaaacgtttcgggttaacgggccgtttaccggacccgttaacccgtatttacccgg

SEQ ID NO: 253192 - DNA, 521 bp, Homo sapiens
  misc_feature: GYAE6OF02GAZ9V.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttgcctggtatcagcagaagccagggaaacgcccctaacctcctgatctatgatgcctccgagtttggctaaggtcggggtcccagtcaaggttcaggcggcagtggatcgtgggacagtaattcactctacacatcagcagccctgccagcctgattgtattttgactaacttatactcgaccaactataactaacgtacccgcgttcgtacgttcggaccaagggaccaagggtgagtactacgacgtaacgtacgtgtcggactgactacattc

SEQ ID NO: 253193 - DNA, 815 bp, Homo sapiens
  misc_feature: GYAE6OF02F9Q8S.3.33.C11.1.454.CMB.1.raw
  modified_base (274)..(274): a, c, t, g, unknown or other
  misc_feature (274)..(274): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagagcgagggaacncccctaactctgatctatgatcgcctcgtaggtttcggacgtaaggtcggggtacccagttacgtaacggttcgagcgggacaggtcggattcggtaggggactaacggtaacttcctaaccgttcctaccgaacctacgtccaagaccgaacggtcccttacggacccgtacggtacccgtaggtaacgtttacggttaacttttttacggaaccttttaaaaccgttttaaccgttttaaccgttaccggtaaaccccgttaaaacgtaaacccggttttaaaacgtttaaacccggtttaaccccccgggttcgggtttaaacccgggttaaaccccgggtttttaacccggggaaaccccggtaaaaaccgggggggttaaccccggtaaagggggtttacgggggtaaaaccggtaaaccggtttaacccggtaaaacccgggtttaaaccgggttaaaaccggggtttcggggttaaccggggttacccggttaccgggtaaccccgttaaacccggttactttttacccccggg

SEQ ID NO: 253194 - DNA, 607 bp, Homo sapiens
  misc_feature: GYAE6OF02H7K8H.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagagcagggaacgcccctaactcctgatctatgatgcctcgtagtttggacgtaaggtcggggtcccatcgtaaggttcaggcggcaggtgatcgtgggacagaacttcactctacaccatcacgcacgcctgaccgagcctagtacttgttatttgaaccttaactttagttaacctcgtaacctaaacgtacttaacgtaaccgtacccggtacgttaccggtaaccggtttacccgggaaccggtaaacgggtaaccgtaaggggtacggaacgttaacgtaaccgtaacgttaaccgaacggttacggtcggtaccgttacggacctacccgtagtttacccg

SEQ ID NO: 253195 - DNA, 771 bp, Homo sapiens
  misc_feature: GYAE6OF02H8EVQ.3.33.C11.1.454.CMB.1.raw
tcagagacgcactccacgaccggtgctcgatttagagtgagctcgttgggtttgggggagtcagactcagtcaggacacagcatggacatgagggtccccgctcagctccgtggggctcctgctgctctggcctcccaggtgaccaaatgtgacatccagatcgacccagtcctcccctccaccctgtctgcactctgtaggagacggtagtcaccatcacgttcggccggccagtcagtagttatagcgtaggttaatttaagttgtatcgaagaacaaaacgaggaacctacccttaaagtttgattactagtcgtactcgactacttccgtagtttacgacgtaaacgggtcgggtaccctaagttacggtaaacggttacaaaggtcgggaacgtagggttaggtacgttaccgggtagggaaacttcgttaacgttttaccaccgttaccctacgaaccgtagtacgacgtaccgtaacgttaacctaacgtaccgtaccgttagggttaaacgtttgttttaaccgtaacccttaaccgtttttactaacggttaccgtaaacaagtaacgtttaacgtttaaacgttacgtttaccgtttaaggttttaccctttaccgggttaccgttttaccccgggtaccggtaaaccgggttaaccgtaaacgggttaccgtaacgtaacccgttaaacgtaaaccgggttacgtaccgggttacggccttaaccggacctaccgtttaacttcgttaccttccgttacg

SEQ ID NO: 253196 - DNA, 689 bp, Homo sapiens
  misc_feature: GYAE6OF02HUGRN.3.33.C11.1.454.CMB.1.raw
  modified_base (273)..(273): a, c, t, g, unknown or other
  misc_feature (273)..(273): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcacatcacttgccgggccagtcagagtattagtacctggttggcctgtatcagcagagaccagggaacncccctaacctcctagactctatgactcgcctccgtagtttcggacgtaagggtcggggtacctagtacgtaaggttcgaaggccggacgtaggtgggacgtcggtagggaacgtaagtaactttccaaccttcctaccgaacctacgtaccaacggtaccacggtccctaggacctacgccgtagtacgttaggttacttttacggaaccttaaacgtttacttaaccgtacgtaaccctaaacgttaacgtttaaaacgtaacccgttaccccggtacgggtttaccggtacccgggttaacccggggaaccgtaaacggggtaacccggtaagggttacgggaaacgtaccgtaaccggaacgttaaccggacgttacgggtcggtacctacggtacctacccgtagtttaccg

SEQ ID NO: 253197 - DNA, 646 bp, Homo sapiens
  misc_feature: GYAE6OF02I2ETA.3.33.C11.1.454.CMB.1.raw
  modified_base (285)..(285): a, c, t, g, unknown or other
  misc_feature (285)..(285): n is a, c, g, or t
tcagagacgcactccacgaccggtgctcgatttagagtgagctcgttgggtttgggggagtcagactcagtcaggacacagcatggacatgagggtccccgctcagctcctggggctcctgcctgctctggctcccaggtgccaaatgtgacatccagatgacccagtcctccctccaccctgtctgcatctggtaggagacggatcaccatcacgttcggccgggccagtcagtacgtattacgtcctggttggcctggtatcagcagaacgccgaagggaacncccctaactccgtgatctatgatcgcctccgtagtttcggactagggtcggcccatcgaaggttcagcgggcaggtgatcgtagggactagacttcactctacaccatccagacacgcccgtgccgacgccctagacgttgtactttttcgaaccttaaccgtttaatttaccgtacgaccctaaacgtaagtttaaccgtaaaccgttcccggtacggtttaacggtacccgggtttaccgggaccgttaaaccggggaccgttaaaggggtacggtaaacggtaacgttaccgaaacgttaaaccggtaaccggttgggtaaccgggtccgtacggttaccgacccgttacgttacccg

SEQ ID NO: 253198 - DNA, 586 bp, Homo sapiens
  misc_feature: GYAE6OF02IQJ86.3.33.C11.1.454.CMB.1.raw
  modified_base (275)..(275): a, c, t, g, unknown or other
  misc_feature (275)..(275): n is a, c, g, or t
tcagagacgcactccacgaccggtgctcgatttagagtgagctcgttggggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggatcaccatcacttgccgggcagtcagagtattagtacctggttggcctggtatcagcagagccaagggaacncccctaactcctgatctatgatcgcctctaggtttcggactaaggtcggggtcccagtcgtaaggttcaggcggcaggtggatcgtgggactagtacttcactctcaccatcagcacgcctgcagcctagacttgtatttcgaccttaactttctactcgacctaaacgtagttaactaaacgttcccggacgttacggtacccggttaccgggacccgtaaacggggaccctaaggggttcggaaacgtaacgtacgtaacgtaaccggtaacgttcgggtcggtaccttcgacctacccgtattacccg

SEQ ID NO: 253199 - DNA, 578 bp, Homo sapiens
  misc_feature: GYAE6OF02HBWJ0.3.33.C11.1.454.CMB.1.raw
  modified_base (385)..(385): a, c, t, g, unknown or other
  misc_feature (385)..(385): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttggccggccagtcagagtattagtacctggttggcctggtatcagcagaagccaagggaaacgcccctaacctcctgatctatgatcgcctctagtttggcaaggtcggggtcccatcgaaggttcagcggcaggtggatcgtggacagaacttcactctacaccatcgancacgcctgccacgcctgattgtatttcgactaactttattacgtacgacctaatagttaactaaccgtacccgtcgttacggtaccggttcgggaaccgtaacgggaccgtaaggggtacggaacggtaacttaccggaacgttaaccggtaaacttcgggtacggtccgtacggaccctacctacgttaccg

SEQ ID NO: 253200 - DNA, 664 bp, Homo sapiens
  misc_feature: GYAE6OF02I6BDL.3.33.C11.1.454.CMB.1.raw
  modified_base (259)..(259): a, c, t, g, unknown or other
  misc_feature (259)..(259): n is a, c, g, or t
  modified_base (545)..(545): a, c, t, g, unknown or other
  misc_feature (545)..(545): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggatcaccatcacttgccggccagtcagagtattagtaccgtggttggcctggtatcagnagaagcgaagggaaacgcccctaacctcctgactactatgactcgtcctctaggtttcggacgtaacggttcgggggtacccaagttccgaaaggtttcaggccgggcgtaaggtggtagtacggttagggaaccgtaaggtaacttccgaaccttcgtaccaaccctaataccaagtacacgcccgtcgacgacgtccgttagagttacgttagttttaacgacgttaaacctttaagttaacctcggaaccctaaacgtaacgtaacctaaacgttaaccccgngttacggtaacccggttacgggaaccgaacggggtaacccgaagggtacggaacgtacgtaaccgtaacgtaacggtaacgttacggtaggaccgtttacgaccctaccgtacttaccg

SEQ ID NO: 253201 - DNA, 599 bp, Homo sapiens
  misc_feature: GYAE6OF02F9DEH.3.33.C11.1.454.CMB.1.raw
tcagagacgcactccacgaccggtgctcgatttagagtgagctcgttgggtttgggggagtcagactcagtcaggacacagcatggacatgaggggtccccgctcagctcctggggctcctgctgctctggctcccaggtgccaaatgtgacatccagatgacccagtcctccctccaccctgtctgcatctgtaggagacggagtcaccatcacttgccgggcagtcagagtatagtacctggtggcctggtatcagtcagaagccaagggaaacgcccctaaacctcctagatctatgatcgcctcgagtttggacaagttcggggtcccatcgaaggttcagcggacaggtggatcgtagggacagaacttcgactctcaccatcagcagcctgccagcctgatgtattttcgactaacttactaccgtacgacctaaacgtagtaactaaaccgtacccgtacgttacgtaccggtttaccggaacccgtaacggggtacccgtaaggggttacggtaacggtaacttaaccgtaaacgttaaccggtaaaccggttcggtacggtaccgttaggaccctaccgtacgttacccg

SEQ ID NO: 253202 - DNA, 610 bp, Homo sapiens
  misc_feature: GYAE6OF02HA3CW.3.33.C11.1.454.CMB.1.raw
  modified_base (287)..(287): a, c, t, g, unknown or other
  misc_feature (287)..(287): n is a, c, g, or t
  modified_base (376)..(376): a, c, t, g, unknown or other
  misc_feature (376)..(376): n is a, c, g, or t
  modified_base (500)..(500): a, c, t, g, unknown or other
  misc_feature (500)..(500): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatccacttcgcccgggccagtcagagtattacgtaccgtggttcgcctggtactcagcaaggagccgaagggaaaccnccccctaacgtcctagatctatgtactcgtccctcgtagtttcggacgtaagggttcggggaccctagtacgtaaggttcacggcgganaggtggactcgtagggaactaaggtacttcacttcgtaccacctactcgaagccacgtccgtgacctacggtcctagtacttgttacgtttagacttaaactttactactacgacctaaacgtntaacgtaccgtccgtacgttacggtacgtaccggaacgtaagggtaccgtagggtacgaagtacgtacgtaacgttacgagttcggtacgccgtacgcctacgtgttacg

SEQ ID NO: 253203 - DNA, 669 bp, Homo sapiens
  misc_feature: GYAE6OF02IQX2O.3.33.C11.1.454.CMB.1.raw
  modified_base (283)..(283): a, c, t, g, unknown or other
  misc_feature (283)..(283): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcaccatcacttcggccgggccagtcagagtattacgtacctggttcggcctggtatcagcagaacgccgaagggaacncccctaacctcctagactctatgactcgccttccgtagtttcggacgtaacgggtcggggtacccagtcgtaacggttcgaggcggcgtaggtaggtacgtcggtagggaactaaggtaacttccgacttcctaccgaacctactacgacgacctacgtccgtacgaccgacgtcctaggtacttagttatttttacgactttaaactttattaccgtcgtaacctaaacgtaacgttaacttaacccgtacccggtacgttaccgttaccggttccggaaccggtaacggggtacccgaaaggggttcggaaacggtacgttacgtaaacgttaaccggtacgttacgggttaccggaccgttacgaaccctaccgtattcccgg

SEQ ID NO: 253204 - DNA, 794 bp, Homo sapiens
  misc_feature: GYAE6OF02GEJTM.3.33.C11.1.454.CMB.1.raw
  modified_base (351)..(351): a, c, t, g, unknown or other
  misc_feature (351)..(351): n is a, c, g, or t
tcagagacgcactccacgaccggtgctcgatttagagtgagctcgttgggtttggggggagtcgagactcagtcaggacacagcatggacatggacgggtccccgctcagcctccgtggggcctccgtgctcgctcgtggcctcccgaggtcgaccaaatgtgacatccagatcgacccagtccctccctccctaccgttcgtctcgactactcgtaggtaagggacgacgggtactaccaacctactaccgtacgttcgggcccggacctagtcgaggtagttacttacggtaccgttggtacggccgtaggtactcgagtacaaggaacgtaccggaaggggaaacccncccccttaaccgtccgtagtacttaccgtagtacgtacgtccggtccttaccggttaggtttacggacggtaacggggttccggggtacccctaaggttaccggttaaggttccggacggtaccggtacgtagggtttcggtaaccgttcgggtaacggggaacgtaaaggttaaccttcctaacccttccgtacctaaccgtacgtaccgtaacgtaccgacggtcccgtaacggaccgtaacggtcccgttagtaacgtttacgtttaacgttttacgaaccttttaacgtttactaccggtaaccgtaaaccctaaagttacgtaacgttaacccgtccggtaacggttcgtaccggtcgaaccgtacgggacgtagggtagtaacgtactacgtaaagtaccgtagtcggtacgtccgtaccgactaccgtacttccgg

SEQ ID NO: 253205 - DNA, 800 bp, Homo sapiens
  misc_feature: GYAE6OF02HV2VH.3.33.C11.1.454.CMB.1.raw
tcagagacgcactccacgaccggtgctcgatttagagtgagctcgttgggggtttggggagtcgaggactcagtcaggacgacagcatggacatgacggtcccgctcacgcctcctgggccttcctgctgctctggctcccgaggtgccaaatgtgacatccagactcgaccgagtctcctccaccctgtctggccatcgtagtacggagacgtagtcgacctatcacttcggccgggaccagtacgtaggttagttagttacgtaccgtaggttacggtccgtaggtacgtacgacgtcgtacggtaacggaccgaagggtaaaccgtacccccgtaaaccgtacccgtacgtaaccgttccgttaacgtacggtacttccgtaccgtacgtacggtttacggaccgtacggttcggggtaccccaagtacgtaaacggttcgtaacgggtcggtacgtacggtacggtacgttcggtagggtaactaacgtaacgttaccgtaccgtccgtacgaacccgtacgtacgaacggtaccgtaacggtccgttacgtaaccgtacggttaccgttaagtacgttaacgttaacgtttacgtaacttaaacgttttactttaacgttcggtaaccgtaacgttaacggtaaccgtaaaccggtaccgtaacggttcggtaaccggttaccgggtaaccgtaaccggggtacgtaacggggtacggtacggttaaccgtaccgtaacgttaaccgtaacgttcggttacggtcccgtaccgtacccggtacctacgttaaccg

SEQ ID NO: 253206 - DNA, 563 bp, Homo sapiens
  misc_feature: GYAE6OF02I18KY.3.33.C11.1.454.CMB.1.raw
  modified_base (275)..(275): a, c, t, g, unknown or other
  misc_feature (275)..(275): n is a, c, g, or t
  modified_base (346)..(346): a, c, t, g, unknown or other
  misc_feature (346)..(346): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctcaccctgtctgcatctgtaggagacggatcaccatcacttgccgggccagtcagagtattagtacctggttggcctggtatcagcagaagccaagggaaacncccctaacctcctgatctaatgatgcctcagtttgctaagtgggtccatcaaggttcagcgcagtgatcgngggacagaatcactctcaccatcagcagcctgcagcctagattgtattttcgacttaactttatactgacctaaactagtaacttaacgtacccgagtacgtaccgtttacggaccgtaaaacggggaccctaagggtacgggaacgtacgttaacgaacgttaaccggaacgttacgggttcggaccgttacggaacctaaccgtaagtttcccgg

SEQ ID NO: 253207 - DNA, 770 bp, Homo sapiens
  misc_feature: GYAE6OF02JKUCS.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttggccgggccagtccagagtattagtaccgtggttggcctggtatcgagcagacgccgaagggaaacgcccctaaacctccgtagacttctaactgatcgccctctacggtttggacctaaggtcgggggtacccagtacgtaaaggttcgacggcggacgtaggtacggagttcggtacgggaacgtaacggtaacgttaccaccttccgtacaaccctattccgaacgccgacgtacccttacggaccgtaacggtccttacgggtattacggtttactttttacggaaccctttaaacgtttttaaacgtacccgtttaacgtaaccccgtaaacgttaacggtttaaacctttaaaccggttaaccccccgggtaccgggttttaaccgggtaacccggtttttaaccccggggaacccggtaaacccgggggttaacccgtaaaggggttacggggaaacgttaaccgttaacgtaaccggttaaacggtaaccgttacggggttacggtaccggtaacccggtttacccgaaacccgttcgtttaaccgg

SEQ ID NO: 253208 - DNA, 690 bp, Homo sapiens
  misc_feature: GYAE6OF02IJTJY.3.33.C11.1.454.CMB.1.raw
tcagagacgcactccacgaccggtgctcgatttagagtgagctcgttgggtttggggggagtcagactcagtcaggacacagcatggacatgagggtccccgctcagctcctggggctcctgctgctctggcctcccaggtgccaaatgtgacatccagatgacccagtcctccctccaccctgtcctgcatctgtaggagacggagtcaccatcacttcggccgggccaagtccagagttatttacgtaccgttggttcggtccttggtatcagcagaagccgaagggaacgcccctaaacctcctagtactctatgactcgccttacgtacgtttggactaagggttccggggtacctacgttacggaacggtttcgacggcggacgtaggtacggtagtcggtagggaactaacggtaaattccactacctacacctacgtacgaacgtcacgtcctacgcacgtcgtacgtagttacgttattttacgacttaaacgtttacttaaccgtaccgtaaccctaaagttaacgtaaacttaaaccgttacccgggtacgttaaccggtaaccggttacccgggaaaccggtaaccggggtaaccgtaagggggtaccggtaaggacttaaccgaaagttacccggaagttcgggtacggtacctaccggtaccgtaccttattcccgg

SEQ ID NO: 253209 - DNA, 700 bp, Homo sapiens
  misc_feature: GYAE6OF02GELZ9.3.33.C11.1.454.CMB.1.raw
  modified_base (312)..(312): a, c, t, g, unknown or other
  misc_feature (312)..(312): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggatccaccatctacttcggcccggccagtcagtagtattacgtaccgttggttcgcgttggtatcagcagaacgaccgaagggaaccgacccctaacctcctagtatctangtatcgcctacgtgtttcggacgtagggtccggggtacctagtacgtaacggtacgacggcggcgtaggtggtacgtcggtacgggaactaagtattccgtaccttccgtaccacctactacgaacgccgtacgtcccgttacgccgtaccggtccgttacgtagtttcgggtttaactttttcggaacctttaacgttttacttaccgtacgtaacctaacgtaaccgttaacgtaaccgttacccggtacgttaaccggtacggttacccgggaaccgtaacggggtaaccgtaagggtacggaaaccgtaccgttaacgtaaccggttaaaccgggtacggtttcggtaacgggttcctacccggtaccctaacgttccgttacg

SEQ ID NO: 253210 - DNA, 648 bp, Homo sapiens
  misc_feature: GYAE6OF02I0CWW.3.33.C11.1.454.CMB.1.raw
  modified_base (642)..(642): a, c, t, g, unknown or other
  misc_feature (642)..(642): n is a, c, g, or t
tcagagacgcactccacgaccggtgctcgatttagagtgagctcgttgggtttgggggagtcagactcagtcaggacacagcatggacatgagggtccccgctcagctcctgggctcctgctgctctggctcccaggtgccaaatgtgacatccagatgacccagtcctccctccaccctgtctgctatctttaggagacagacgtcaccatccacctcggccgggaccagtacaaagtatagtaactcgttgcctggtactcagacaaagaccaggcagacgaccccaagcctaccttatctctagactcggacctaccttaattcgaccacgacggttcggggtaccccaaccgtaacgttccgaacgtccggactaggtggacttcgtagggaactaggtacgtttaccgaccttactacccgaaccgtactaccgtacgccgtacgtcccgtacggcctaacggcccgtaggaaccgtacgttcgggtaacgaacccttaaacgtttactaaccgtacgaacccaacgtaagtactaggtaattacgtttagtacggtaacggttcgaccggaacgtaccgtaaggtaactaagtaaactaccgtaaaacgtacgttaggcgtacgtcgactaccgtnttaccg

SEQ ID NO: 253211 - DNA, 597 bp, Homo sapiens
  misc_feature: GYAE6OF02HBL27.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtaccgtggttcggcctggtatcagcagaagccgaagggaacgcccctaacctcctgactctatgatcgtcctcgtagttcgctaggtcgggtacctatcgtaagttcagcgcgtagtggatcgtaggacaagtacttcgactctacactacgtcgacgtcacgtcccgtagacgacgtcctagagttcgttatttcggacttaacgtttacttacgtacgaacctaagtacgtaacgtaaccgtacccgtaggttaccggtacgtaccggaaccgaacgggtaccgtaagggtacggaacgtagtaccgtaacgtaaccgtaacgttggtacggtcgttacggacctaccgtagttcccg

SEQ ID NO: 253212 - DNA, 832 bp, Homo sapiens
  misc_feature: GYAE6OF02GM6U2.3.33.C11.1.454.CMB.1.raw
tcagagacgcactccacgaccggtgctcgatttagagtgagctcgttgggtttgggggagtcagactcagtcaggacacagcatggacatggacgggtccccgctcagctccgtggggcctcctgctgctcgtggcctcccgaggtcgaccaaatgtgacatccagatcgaccctagtcctcccctacccacctgtctgacatctggtaggagacggatccacctactctacgtcggccgggaccagtacagtaacgtagttacgtaccgttgggttcggccgttaggtactcgacggtacaaggaaccgtccggaaacggggaacccttacccctaacccgtcgtacggacttaccgtaagtacgtactaccggtacccttaccgtaggttacggaccggtaacgggtccggggtaccctagtaccggtaacgggttccaacgggtcggtacgtagggtaggtaaccgttcgggaacggggtaactaacggttaacgttccaaccgtttacccgtaacctaacccgtataaccgaacccggtacgtaacccggtcccgttaacggccgtaaccggtcccgtaggttaaacgtttacggtttaacgttttaccggaaaacccttttaaacgttttaccgtaacccggttaccctaaaccggtaaaacccggttaaggtttaaaccttaaccccggttaccgggttaccggttaccgggaccggttaaccgggaaccggtaacgggtaccggtaaggggtacgaaccgtataaaccggtaacgttacgggtaacgtcgggtaccgtacgtacctaccggtacctacgtttccg

SEQ ID NO: 253213 - DNA, 682 bp, Homo sapiens
  misc_feature: GYAE6OF02JU6OB.3.33.C11.1.454.CMB.1.raw
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccgaggtgaccaaatgtgacatccagatcgacccagtcctccctccaccctgtctgctatctaggtaggagacggatccacatcacgtcggcccggcaagtcaagtactattacgtaccgttgggttcgtccgtaggtactcgaagtacacgaacgccgaagggaacctaccccttaacccgtctagtaactgtaactggactccgcctcgtaagttcggacgtaaggtcgggtacccagtacgtaacgtcgagcggtctagtcggactccgaggtaactatacgtccactcgtacactactcganactacgtcgtcgaccgtacgtaccgtntaggttacgtttacgttacgtaacttaacgttttcgtaacctaacggtaaccctaaacgttaaacgttaacgttaacccggtaacccgttaggtaccggtaaacccggttacccgggaaccggtaaccgtacggggtaacggtaaccggaaggtttaccaacggtaacgttaaccgtaacgttggtaaccgtcgtaacgtaccctacgttatcccg

SEQ ID NO: 253214 - DNA, 728 bp, Homo sapiens
  misc_feature: GYAE6OF02JVL0M.3.33.C11.1.454.CMB.1.raw
  modified_base (140)..(140): a, c, t, g, unknown or other
  misc_feature (140)..(140): n is a, c, g, or t
  modified_base (169)..(169): a, c, t, g, unknown or other
  misc_feature (169)..(169): n is a, c, g, or t
  modified_base (302)..(302): a, c, t, g, unknown or other
  misc_feature (302)..(302): n is a, c, g, or t
  modified_base (609)..(609): a, c, t, g, unknown or other
  misc_feature (609)..(609): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtnaccaaatgtgaccatccgagatcgacccngtcctccctccaccctgtctgactatctgtaggagacggatccacctatccacgttcggcccgggaccagtccaggtacgttattacgtaccgtggttcggacctggtatcgagtcagagccgaagggaaccnccctaacctctcgattactagtgacgtaccgccgttaccgtagtttccggaacgtacgggttaccggggttacccagttaccggtaaacggtttccgacgggtaccgggtacctaaggggttacggttaaccgtacggttaacggggaactaacgttaacgtttaccctactacccgttacgaaccgtttacgtacccgaaggtccccgtacggttacccgtacgtacccggacgttacccgttaaggtaccgttaggtttacctttcgaaccgtttaactttaacgtcgttaccgacggttaaacnctttaaacgtaacccgtacgtccgttaaggtacccgtacgaacgtaacgggtacgaggttacggaacttacacgttaccgaagtaccgttggcgtaccgtaggccttaccgtattccgg

SEQ ID NO: 253215 - DNA, 573 bp, Homo sapiens
  misc_feature: GYAE6OF02JWYKU.3.33.C11.1.454.CMB.1.raw
  modified_base (259)..(259): a, c, t, g, unknown or other
  misc_feature (259)..(259): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttcgccggccagtcagagttatagtacctgggttgccgtggtatcngcagaacgcgaagggaaccgccctaacctccgtagactctagtgactcgtccctacgtgtttggacgtaggtcggggtaccagtcgaaggttcacggcggntaggtgacgtgtacggacagtacttcacctcncactatcagcagccgcgcncgtctagctagttacttcgacttaacttagtacctgaaccaatagtaactaaccgtaccggtacgtcggtaccgttacggaccgtaagggtacctagggtacgaagtactactaacgtaaccgtaccggttagggaccgtcgtaccgactacacctttacgg

SEQ ID NO: 253216 - DNA, 713 bp, Homo sapiens
  misc_feature: GYAE6OF02HWKLU.3.33.C11.1.454.CMB.1.raw
  modified_base (319)..(319): a, c, t, g, unknown or other
  misc_feature (319)..(319): n is a, c, g, or t
tcagagacgcactccacgaccggtgctcgatttagagtgagctcgttggggtttgggggagtcagactcagtcaggacacagcatggacatgagggtccccgctcagctcctggggctcctgctgctctggctcccaggtgccaaatgtgacatccagatgacccagtctccctcaccctgtctgcatctgtaggagacggatcacctatccacttggccgggccagtccagagttaattaggtaccttggttcggccttggtatcagccgagaagccgaagggaaacgccccgtaaacctcctagactctatgtatcncccttactgtttggctaagggtcggggtacccagtacaaggttccgagcgggctaggtggacttcgtagggaacaggtaaacttccgtactctaccaacctatacacggtccaacggtcttagggaccctagggtaccttaggtaacttcggtttaatttttcggtaaaccgtttaaaacctttacgttttaacccgtcggtaaaaccctaaacgttaacggttaaacttaaaccgttaccccgggtacgttaaccggtaacggttacccgggaaccgtaaccgggggtaacccgtaaaggggtcgggtaaaacggtccgttacggtaaaccgttaaaccggttaacggttcggtacgggtacccttacgggaacctaaccgtaacgtttccgg

SEQ ID NO: 253217 - DNA, 841 bp, Homo sapiens
  misc_feature: GYAE6OF02F16M4.3.33.C11.1.454.CMB.1.raw
  modified_base (234)..(234): a, c, t, g, unknown or other
  misc_feature (234)..(234): n is a, c, g, or t
tcagagacgcactccacgaccggtgctcgatttagagtgagctcgttgggtttgggggagtcagactcagtcaggacacagcatggacatgagggtccccgctcagctcctgggctcctgctgctctggctcccaggtgccaaatgtgacatccagatcgacccagtcctcccctccaccctgtctgctatctgtaggagacggatccacctataccgtaccttcggcccgggntaaagtcagtagttattagcgtaaggttaatttaaattggtactacaagaaccaaaaaccggagggtaaaaccgtacccccttaaagttttacgacttactacgtgtcctgactacttccgtaggttactaacggtaaaggttcccgggtacctaagtacgtaaggttacaagttagggacgtaggttacggacttcgggtaacggtaacgtaagttagtttcctaaccgttccttacccgaaccgtattaccgtaacgtaccgtaaacgttaccgtacgtaacctaccggttaaacggttaaacgttttaaccttaccggtttaaaccttaaaaccgttttaccgtttaacccgttaacgtaaaccgtaacgtttaaaccgggttaaacggttttaaacctaaggttttaaccccggtttagtttttaaccgtttaaccgtttacccgttttaccgggtaaacccgtttacgggtaaaaccgtaacgggttaccggtaaaccgtaaccggtttaaaccgtaaaaccggttacggttaaccggtaggtaacccgtacgttacccgtaaaccgttaccgttttccgtacggttttacccgtaaccccg

SEQ ID NO: 253218 - DNA, 668 bp, Homo sapiens
  misc_feature: GYAE6OF02IIK4Z.3.33.C11.1.454.CMB.1.raw
  modified_base (513)..(513): a, c, t, g, unknown or other
  misc_feature (513)..(513): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
  modified_base (550)..(550): a, c, t, g, unknown or other
  misc_feature (550)..(550): n is a, c, g, or t
tcagagacgcactccacgaccggtgctcgatttagagtgagctcgttgggtttgggggagtcagactcagtcaggacacagcatggacatgagggtcccgctcagctcctgggctcctgctgctcgtggctccaggcgacaaatgtgacatccagactcgaccctagtcctccctcgaccgtgtctagcctaagtctaggtaggaacgacgattacaccagtactaacgttcggccgggacctaaggttccaaagggaagttaatttaaccggtaccgttgggtacggtccgttagggtacttacgtagaccgtagaaacggtacgaaaggggaaacctaaccccgttaaaccctccttaggtaactaacgttaacacggttaataccgcgttaaacccgttgtttaacgggcgaaaggttcggggttacccaattaccggtaaacgttcgaacgcggtacgaagttaggacgtacggtcgaagtaagaacttcgacttacgcaacgatacgncgagcaganccgntacgntacgtnttgaactagttancgtaacactaacgactaaacgtcgtaacgtacgttcgtaacgacggtagacggtaaccgagtacggacgtaatcaaacgtaagtacgagttacggcctaaggtaccacggtacttacg

SEQ ID NO: 253219 - DNA, 582 bp, Homo sapiens
  misc_feature: GYAE6OF02F5YW1.3.33.C11.1.454.CMB.1.raw
  modified_base (208)..(208): a, c, t, g, unknown or other
  misc_feature (208)..(208): n is a, c, g, or t
  modified_base (279)..(279): a, c, t, g, unknown or other
  misc_feature (279)..(279): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgctaaatgtgacatccagatgacccagtcctccctccaccctgtctgcatctgtaggagacggatcacntcactgaccggaccagtcagagtattacgtacctggttggcctggtatcagcaagaagccgaagggaaacncccccgtaaacctccgtgaatctaatgaatcgcctcgtagtttggacgtaaggtcggggtcccatacgaaggttcagcggcagtggatcgaggacagtaactcactctacacctatcacgcacggccctgcacgtcctagtagttgtattttcgaacttaacgtttacttactacgaacccaataggttaaactaaccgttaccccgagttcgtaaccggttaccggaccgaaacgggtaccaaggggtacggaagtaagtacaacgtaacgaacgtggtcggtactgtacccactattaccg

SEQ ID NO: 253220 - DNA, 627 bp, Homo sapiens
  misc_feature: GYAE6OF02FVC13.3.33.C11.1.454.CMB.1.raw
  modified_base (216)..(216): a, c, t, g, unknown or other
  misc_feature (216)..(216): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggcctcccgaggtgaccaaatgtgacatccagatcgacccagtcctccctcccaccctgtctgcctatctggaggagacggatccacntcacgtcggccggcagtcagtacgttattcgtacgtggttcgcttggtatcagcagagaccaaggaacncccctaactcgngactctatcgatcgccctacgtaggtttcggacgtaggtcggggtcccagttaccggtaggttaccgaggcggacgtagtggtactggacgggtacaagtacttaccacgtactaccactactcacgactacgtcctgacgtacgaccgtgtacgttacgttatttcgaaccttaagtttaaccttcgaccgtaactaactacggtttaactaacccgtccgtacgtacgaccggtttaccggaacgtaacgggaccgtagggtacgacgttaacgtacgtaaccgtacgtacgtacggtacggtaccgtaccgaccacgtacgttaccg

SEQ ID NO: 253221 - DNA, 674 bp, Homo sapiens
  misc_feature: GYAE6OF02G3C44.3.33.C11.1.454.CMB.1.raw
  modified_base (205)..(205): a, c, t, g, unknown or other
  misc_feature (205)..(205): n is a, c, g, or t
  modified_base (280)..(280): a, c, t, g, unknown or other
  misc_feature (280)..(280): n is a, c, g, or t
  modified_base (555)..(555): a, c, t, g, unknown or other
  misc_feature (555)..(555): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatcgtgacatccagatcgacccagtctaccctccaccctgtctgcatctgtaggagacggngtcaccatcacttcgccgggaccagtcagagtattagtacctggttgctggtatcagcaagacgcgaagggaacncccctaactcctagactctagtgatcgcctctaggtttcggacgtaacggttcggggtacccagttaccgaacgggtttccaacggggccggtacgtagggttacgggacgttacgggtagggggaacctaaggttaaactttacccgtaactttacccgtacccaaaccgtacttaccggaacggtcccgtaacggtccccgttaagacccggaacggtcccgttaaggtacgttaggtttacttttacggaacctttaacctttacgtttacnccgtaactaacgtacgttaactaccgtacccgtagtacgtaccgttacggaccgtaacgggactagggtacggactactacgaacgttaacgcgtacggtcgactacgactacgcttcg

SEQ ID NO: 253222 - DNA, 557 bp, Homo sapiens
  misc_feature: GYAE6OF02GIBSY.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtccaccatcacttgccgggccagtcagagtattagtacctggtggcctggtatcagcagagccagggaaacgcccctaacctcctgatctaatgatcgcctacctagtttcggacaacggtcgggggtcccattcgtaaacggttcaggcggcaggtggactcgtggggaacctaagaacttcgaactctacaaccctatcagccagcctgcacgcctagattgtattttgactaacttacttactcgaccaacgtagtaataactacccgtacgtacgtaacgttcggaccaagggacctaagggtaggagaataccgaataaccgagtcggtcggactagcctacctattcc

SEQ ID NO: 253223 - DNA, 706 bp, Homo sapiens
  misc_feature: GYAE6OF02HLZET.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccgaggtcgaccaaatgtgacatccagatcgacccagtcctcccctccaccctgtctgcatctgtaggagacggagtcaccatcacgttcggccggccagtcagtagtagttacgtaccgtggttcgtcgtggtactcacgacaagaacgaccgaaagggaaccgaccccttaacctccgtagacttactagtcgactcgcctacgtaggtttcggacgtaacggtccggtaccagtacgtaacgtcgaggcggacgtggtggacgtggtaggacgtaagtactccgtactcctaccgacctacgtacgacgaccgacgtaccgtgaaccgtcgtaccgtgtaacgttgttaacgtttcgtaaaccttaactttacttaccgaacgttaacccgtaaattaacggtttaacctaaccggttacccgggaaccgtttcgggtaacccgttaaccggggaaccggtaaccgggtaacggtaacgggtacggtaaaccggtacctaacggtaaaccgtaccggtaaacgttcgggtaccggtaccggtacccggaacccttaccgtagtttacccg

SEQ ID NO: 253224 - DNA, 715 bp, Homo sapiens
  misc_feature: GYAE6OF02JRU2P.3.33.C11.1.454.CMB.1.raw
  modified_base (673)..(673): a, c, t, g, unknown or other
  misc_feature (673)..(673): n is a, c, g, or t
tcagagacgcactccacgaccggtgctcgatttagagtgagctcgttgggtttgggggagtcagactcagtcaggacacagcatggacatgaggtccccgctcagctcctggggctcctgctgctctggctcccaggtcaccaaatgtcgacatccagatcgacccagtcctccctccacctgtctagcctatccgtggtaggagacgggactcacctatccacttcggacccgggccagtcgaaggtagttacttacggtaccgtgggttcggcccgttaggtacttcgacggacgtagaacggacccggtaagggaaacccggtccccccttaaaaccgttcccggtagtacttaccgtacgtacggtactccggtccctttaccgtacggttttcggaaccggttaacgggtccggggtacccctaaggttaccgtaacggttccgacggtccggtaggtaacggtcggacgttacggtacgggtaactacggtaaccttcgtaaccttcccgtacaaccgtataccggacttacgaccgtacgtacgtacgaacgttcccgtagtacgttattacgtttacgaccttaatttcgtacgtcaaccgtaactagtaacttaccgtccgtactcggtacgtaaccgggacgaacggtacgtaggccggtaancttacgataccgtagtcggtacgacctcgtacaccgtgtccg

SEQ ID NO: 253225 - DNA, 703 bp, Homo sapiens
  misc_feature: GYAE6OF02J1U96.3.33.C11.1.454.CMB.1.raw
  modified_base (139)..(139): a, c, t, g, unknown or other
  misc_feature (139)..(139): n is a, c, g, or t
  modified_base (324)..(324): a, c, t, g, unknown or other
  misc_feature (324)..(324): n is a, c, g, or t
tcagagacgcactccacgaccggtgctcgatttagagtgagctcgttgggtttgggggagtcagactcagtcaggacacagcatggacatgagggtccccgctcagctcctggggctctgctgctctggctcccaggtnccaaatgtgacatccgagatcgaccctagtcctccctccaccctgtctgctatctggtaggacgacggtactcacatctacgttcggcccgggctagacagtagtattacgtaccgtggttcggcctggtactcgagacaagtaacggccgaacgggaacctacccctaactccgagtactctangtactcgacctcgtaggttcggacgtacgggtcggtaccagtaccgtagtcgacggcggtacgaggtgcgtacggtagtaactaagtaacttccgacttcctaccgactagtccggaactcccgtagtcgacgtaccgcgttaccggtagtagtttacgtttaacgttacgtaaccctttaaacgtttctaaacccgttcgtaactaaacgtttaccggttaaacctaacccggtcccgggttaaagttccccggttaaccgggtaaaccgggaaccccgttagggggaaccgttgggtaacgtaaaccgtacctacgtaaacggtaaccgttcggtacggacccgttcgaccgtaaccgttacgttaccgttacccgg

SEQ ID NO: 253226 - DNA, 709 bp, Homo sapiens
  misc_feature: GYAE6OF02J1NSD.3.33.C11.1.454.CMB.1.raw
  modified_base (432)..(432): a, c, t, g, unknown or other
  misc_feature (432)..(432): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggcctcccaggtgccaaatgtgacatccagatcgaccagtcctccctccaccctgtctgcatctggtaggaggacggagtccaccactcgacgttcggaccggccacgtcaagtagttacttacgtacgttgggttacgccgtggtactcgacgtacgaagaacgaccgaagggaaacctaccccttaaccgtcctagtactactagtagatcgtacctcgtagttacgagtaacggtcggaccagtacgacggtcgaggcgagaggtagacgtgacggacagtaacgtctactactacactanacgacgacacgtctcgaccgtacgccgtagtacgttacgtacgtttacaccgtttaaactttaccgtaccgtacgtaacccgtaagttacgttaaaccgtttaaccgaccccgtttaagggccggtttaaacccggtaccgggttaacccgggaacgggttaacccggtaagggttaaccgggtaacttaaccggttaacctaaacgggtttaacccggtaacgggtttacggtccggtacccgttaaccgtacccggttaacccttacgtttaccg

SEQ ID NO: 253227 - DNA, 654 bp, Homo sapiens
  misc_feature: GYAE6OF02ISW7N.3.33.C11.1.454.CMB.1.raw
tcagagacgcactccacgaccggtgctcgatttagagtgagctcgttggggtttgggggagtcagactcagtcaggacacagcatggacatgagggtccccgctcagctcctggggctcctgctgctctggctcccaggtgccaaatgtgacatccagatgacccagtcctcccctccaccctgtctgctatcctggtaaggagaccggatcaccataccacttcggccggacagtacagagttattacgtaccgtggttcggccgtggtactcgacgcgagaacgaccgaacgggaaaccgtacccctaacctccgtagtactactagtagacgtcgccctcgtacggtttagacgtaacggtcggggtacccagtacgtagtacgaggacgcgagtgtacgtcgtacggataagtacttacgactactacacacgtacacgactacgccgtcacgtacgtccgtagtacgttagttacgtttaacgtacttaactttaccttacgtactaaccctaagtactaacgtaacgttacccgtacgttacgtaccggtaacccgaacggtaaccgggtacgtaagggtacggaagttaactacgtaaccgtaccggtaacgttcggttacggaccgtacggaacctacgtacttcg

SEQ ID NO: 253228 - DNA, 781 bp, Homo sapiens
  misc_feature: GYAE6OF02GKXB2.3.33.C11.1.454.CMB.1.raw
  modified_base (167)..(167): a, c, t, g, unknown or other
  misc_feature (167)..(167): n is a, c, g, or t
tcagagacgcactccacgaccggtgctcgatttagagtgagctcgttgggtttgggggagtcagactcagtcaggacacagcatggacatgagggtccccgctcagctcctgggctcctgctgctctggcctcccaggtgaccaaatgtgacatccagatcgacccngtcctccctcccacctgtctcgctatctaggtaggacgacggagtccaccagtcctacgttcggcccggacctagtcgagtagtagttacgtaccgttgggttcgccgttaggtactcgacggctaaggaacggaccggaaacgggaaacccgtaccccttaaccgtcctaggactttacgtaagtgtaacgtccgtacccgttcggtaaggtttcggtacgtaacgggttcgggtaaccccgtaattaccgggttaacggtaccgacgggtccggacgtaaggtacggtaacgttcggtaagggactaacggtaccgttaccgtaccttacgacccgtaccctaacgtaccgtacgaccgtaccgtaccgtacggtactaccgtacgtacgttacgttacgtttacgttacgttaaccttaaccgtttaacgttaccgtaccgtaaccgtaaacgtaacgtttaccgtaacccgttacccggtaccgttacgtaacccggggggggttaccaaccgggtacggtaccggtacgggtacggtaacgtacgttaccgtaacgtaccgttaaggtcggtaaccggtccgtaaccggtacctacctacggtttaccg

SEQ ID NO: 253229 - DNA, 725 bp, Homo sapiens
  misc_feature: GYAE6OF02I28KB.3.33.C11.1.454.CMB.1.raw
tcagagacgcactccacgaccggtgctcgatttagagtgagctcgttgggtttgggggagtcagactcagtcaggacacagcatggacatgagggtcccgctcagctcctggggctcctgctgctctggcctcccgaggtgccaaagtgtgacatccagatcgacccagtcctccctccaccctgtctcgctatctggtaggaggtacggacgtcaacctatccgacgttcggcccgggacctacgtacagtagttattacgtacgtggttcgcgtggtatcgagacaagaacgaccgaacgggaacctcccctaaccgtctacgactacgtagtcgactcgtcctacgtaggtttcgacggtaacgggttccggggtaccctaacgttaccgtaacggttaccgacgggtccggtaacggtacggtaggtacgttcggtacgggaacgtaacgtaacttcctaaccgttacctaccgtaactacgtacgtaacgaccgtacggtccgtacgccgtacgtaccgttagtagttacgtttctttaacggtaaccttaactttaacgtaccgtaacgtacgtaaacttacgtaacttaacccggtaccggttaacgtaccgttaaccgggtaccggaacgggtaaccggtaccgtaggggtaacgaacggtacctaacgtaacgtacgttaacgtcggtacgtaccgcggtacctacgtcgttaccg

SEQ ID NO: 253230 - DNA, 712 bp, Homo sapiens
  misc_feature: GYAE6OF02JW1OP.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggcctcccaggtcgaccaaatgtgacatccagatcgacccagtcctcccctccgaccctgtcctgctactcgtagtaggagacggactcaccagtcctacgttcggacccgggcctaagtccgagtacgttattacgtaccgtgggttcggccgtaggtatcagtcaaggaacgccgaaggaaccgcccctaaccgtcctagtactactagtagtacgtacctcccgttactaggtttcgaacgtacgggtccggtacccagtacgtaacggttcgaggtaccgctagggtcgtagtcggtacgggaatagtaacgttaccacttaccgtacgacctagtaccgacgtccgaaccggtccttacggacgtacgtaccgtagtacgttacgttacgtttacgaccgtttaacctttacgtaccgttaacgacctaaacggtaacgttaaccgttaaacccgtacccggttacgttaccgggttaaacccggtccgggtaacgtaaccggggtaccgtaagggtacgtaacgtactaaccgagttaaccgtacgtacggtacgtcgacgtaccttacgtcttaccg

SEQ ID NO: 253231 - DNA, 748 bp, Homo sapiens
  misc_feature: GYAE6OF02F1PIP.3.33.C11.1.454.CMB.1.raw
  modified_base (502)..(502): a, c, t, g, unknown or other
  misc_feature (502)..(502): n is a, c, g, or t
tcagagacgcactccacgaccggtgctcgatttagagtgagctcgttgggtttgggggagtcagactcagtcaggacacagcatggacatgagggtccccgctcgagctccgtggggctcctgctggtctctggctcccgagggtcgccaaattgtcgacatccgagtactcgacccagttcctccctccgaccctgtctcgctatcgtaggtacggagacggtgtaccaaccattaccgaacgttcggaccccgggtactaggtaccgaggtacgttaagtttacggtaaccgttgggtttccggtaccgttagggttaactccgacgtacgaaggaaacgtcccgaaaggggaacctaccccctaaaccgttccgtacggtaacttccgttaagaccgtaactccggtacccgttaccgtaggtttaccggacgtaacgggttccggtaccctaagtaccgtaaggttcgaacgcggagtaggtggtactcggtacgganaacgtacttcgacttctacacgtactcgacgcgtacgtcgtacgccggtaagtcccgtagtacggttccgttactttacgaaccttagtttaccgtacgtaccgaacctaacgtacgttaactaaccggttaccgtcgtaccgtaccggtaccggtaacgtaaccggtacgtaaggtacgtaagtaacctacgaaaccggttaacgaccggttacggacggttacctacggactaaccgtcttacg

SEQ ID NO: 253232 - DNA, 675 bp, Homo sapiens
  misc_feature: GYAE6OF02I9EDZ.3.33.C11.1.454.CMB.1.raw
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctcccctccaccctgtctgcatctggtaggacgacggagtcaccatcacttcgccgggccagtcagagtattagtacctggttggcctggtatcgagcagaacgccgaacgggaaacgaccccctaaacctcctagacttctatgtaatgccctcctaggtttggacgaaggtcgggggtcccagtaccgtaaaggttccgaggtccggacgaggtggactcggtagggacaagtaacttcaaccttcctacccaaccacttccgaacgacgacgtacccgtcggccacggccctagttaagttacgttacgttttacgtaaccttaaacttttaccttaacgttccggaaaccctaaacgtaacggttaaacttaaacccgttaccccgggttacgtaccgggttaacccggttccgggaacccggtaaacgggtacccggtaagggtcgggtaaagtactacgtaacgtacgaacgttggtacggcctacgacctacgacttccgg

SEQ ID NO: 253233 - DNA, 843 bp, Homo sapiens
  misc_feature: GYAE6OF02JFYJ3.3.33.C11.1.454.CMB.1.raw
tcagagacgcactccacgaccggtgctcgatttagagtgagctcgttggggtttgggggagtcagactcagtcaggacacagcatggacatgagggtcccgctcagctcctggggctcctgctgctctggctcccaggtgccaaatgtgacatccagatgacccagtcctccctcccaccctgtctgcatctaggtaggagacggagtccaccatctacgttcggcccggggaccagtcaggtagttacttacgtaccggttggttcggccgttagggtattacacggacgaaggtaacggaccggaaacggggtaacccgtacccccgttaaaccctcccgtaggtaacttaccgttaacgtcggtacgttaccggtaccccgtttaccggtaacgggtttttacgggaacccggttaaacggggttccccggggggttaccccaacgtttaccggtaaaccgggtttaccgtaacgggccgggtaccggtaaggggttacggttaacgttacgggtacggggtaaaccgtaaggttaaactttacccgaccctttaccgtacctaaccctacgtaccgaacgtaccgtcggtaccgtcggtacctaacggtacccgtaggttcgttacggttttactttaccggtaacttaacttttacggttaccttcgaaaccttaacgtaacttaacgttaaaccgttcccggtacgttaccggttaacggttacccggaacgggttaccggaccgggtaagggtacggtaacggtactaacggtaactaaccgggttacgttcgggttacggtacccgtacggtaaccgtacccgttagttacccgg

SEQ ID NO: 253234 - DNA, 668 bp, Homo sapiens
  misc_feature: GYAE6OF02GB354.3.33.C11.1.454.CMB.1.raw
tcagagacgcactccacgaccggtgctcgatttagagtgagctcgttgggttgggggagtcagactcagtcaggacacagcatggacatgagggtccccgctcagctccgtggggctcctgctgctctggctcccaggtgccaaatgtgacatccagatgacccagtcctccctccaccctgtctgcatcgtggtagggacgacggtagtccaccatcgacttcggcccgggtcagtcagtagttattacgtaccgttgggttcggccttaggtactcgaagacgaagaacggccggaaaggggaaaccgtccccctaaaccgtccgtagacttactagtgatccgacctcgtaggtttcggacgtagggttccggggtacccaagtcgtaaacggttcgacggtcggactaggtcggactcggtagggaactagtaactctactcacctaaccatccgaagcgtacgcctcgactacgcgtagagttagttactttacgactttaactttacgtacgtacgtaaaccgtaagtacgttaacgtaacccgttaccggtcgttacgtaccggttaccggaaccggtaacgggaccgtagggtacggaacgtaactacgtaaaccgttacggaacgttggtaccggtacgtcgaaccctacgtacgttcg

SEQ ID NO: 253235 - DNA, 748 bp, Homo sapiens
  misc_feature: GYAE6OF02IT5WL.3.33.C11.1.454.CMB.1.raw
  modified_base (163)..(163): a, c, t, g, unknown or other
  misc_feature (163)..(163): n is a, c, g, or t
  modified_base (730)..(730): a, c, t, g, unknown or other
  misc_feature (730)..(730): n is a, c, g, or t
tcagagacgcactccacgaccggtgctcgatttagagtgagctcgttgggtttgggggagtcagactcagtcaggacacagcatggacatgagggtccccgctcagctcctgggctcctgctgctctggctcccaggtgccaaatgtgacatccagatgaccngtcctccctccaccctgtctgctatctggtaggacgacggacgtcaccatctacttcggccggaccagtcagtagttattacgtaccgtggttacggctaggtactacgacgtacaaggaaccgtaccgaaacggggaaaccctacccccgttaaccgtccttaacggaacttacgttaacgtggtaacctaccggtacccttttaccggtacgggtttaacggacgtaacgggttccggggtaaccctagtacggtaacgttccgagggtccggtacgtaggttcggaagttccggtaggggtaacctaagtaacgtttcccgtaaccgtcctaacccacccgtaaattacccgtacgacgtaaccggttccctacggaccgtaaccggtcccctaaggttacgttagttacccgttttacgaacctttaaccgtttaacttccgaccgtaaccgtaataaccgttacgttaacctacccgggtacttacgggtaccgttaccgacggtaaccgggacgtacgggacgtagtaccgtaactacgtaaccgtattacgggtcgtacngtactaccgtagttaccg

SEQ ID NO: 253236 - DNA, 567 bp, Homo sapiens
  misc_feature: GYAE6OF02FKK1H.3.33.C11.1.454.CMB.1.raw
  modified_base (200)..(200): a, c, t, g, unknown or other
  misc_feature (200)..(200): n is a, c, g, or t
  modified_base (409)..(409): a, c, t, g, unknown or other
  misc_feature (409)..(409): n is a, c, g, or t
  modified_base (428)..(428): a, c, t, g, unknown or other
  misc_feature (428)..(428): n is a, c, g, or t
tcagagacgcactccacgaccggtgctcgatttagagtgagctcgttgggtttgggggagtcagactcagtcaggacacagcatggacatgagggtccccgctcagctcctgggctcctgctgctctggctcccaggtgccaaatgtgacatccagatgactcagtctccctccacctgtctgcatctgtaggagacggngtcaccatcacttgccggccagtcagagtattacgtaccttggtgcctggtactcagcagaagccgaacgggaacaccccgtaaacctccgtagactctatgatcgcctctagtttggacgtaaggtcggggtaccatcgaaggttcgaggcggcgaggtggtatcgtagggactaacgattcactcaccacatcacgcagccgtgacncgccgtgactgttactttnactaacttacttacgctaacaacgtactaacgtaacgtaccgtacgttacgtacggttcgaccgtaacgggaacgtaaggtaggacgtaactacgtaaccgtaagtaacgttggtacggtacgtcgtaccgtacgtacg

SEQ ID NO: 253237 - DNA, 621 bp, Homo sapiens
  misc_feature: GYAE6OF02GU11L.3.33.C11.1.454.CMB.1.raw
  modified_base (616)..(616): a, c, t, g, unknown or other
  misc_feature (616)..(616): n is a, c, g, or t
tcagagacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacggagtcacatcacttcgccggcagtcagagtatagtacctggtcgcgtggtatcagcagaacgcgaagggaacgcccctaacgtccgtagactctatgatcgtacctccgtaggtttcggacgtaacggtcggggtaccctaagtccgtaaggttacgacggtcgacgtaggtcggagttcggtagggaactacggtaacttaccgacttcgtacacctatcgtaacgacgtacgtccgtagaccgtacgtccgtgtagttacgttacgttttacaccgttaaactttaccttacgtacacccgtaagtacgttaaactaaccggttaccgtacgttaggtaccgttccgaacggtaacggaccgtaggtacggaacgtagtacctagtacgtagtcgtcggcacggcctaccgtnttacg

SEQ ID NO: 253238 - DNA, 638 bp, Homo sapiens
  misc_feature: GYAE6OF01CLR91.33.52.E08.1.454.CMB.1.raw
  modified_base (568)..(568): a, c, t, g, unknown or other
  misc_feature (568)..(568): n is a, c, g, or t
tcagtacacacactcacgaccggtgctcgatttagtcgagctctcagagaggtgccctagccctggattccaaggcatttccacttggtgatcagcactgaacagagaggactcaccatggagttggggctgtgcttgggttttccttgtttctgtcctagaaggtgtccattctgttgtgcagctggtggaggtcggggggaggcgttgggtaccggccgggggggtctcgtaagactctcctgtgcagcctccggaatcagattccaccagctttggccttcacgtcgggtcccgccgaggcctccgtggggaaggggctgggagtcggctgtcattatgtcttcgtgggaggtgagtcgggtcgtcgtcttcgtacgcggtactcgtggtggacgggcctattcgagtctaccttccgaagacgaccaacgccaaacacctccagcactcctaccagtatacggacctaaccgtggaccgaagacccggccggaaacgtaccgggacttaagttaacgttacgttaacgtgtacggaccgaaactaaccggttaacccgtttaanacggtacctaagggtaaccttccggggtacggggtacgggtcggtcgggtcccgtcccgggcccccgggg

SEQ ID NO: 253239 - DNA, 779 bp, Homo sapiens
  misc_feature: GYAE6OF01AUTMH.33.52.E08.1.454.CMB.1.raw
  modified_base (303)..(303): a, c, t, g, unknown or other
  misc_feature (303)..(303): n is a, c, g, or t
tcagtacacacactcacgaccggtgctcgatttagtcgagctctcagagaggtgccctagccctggattccaaggcatttccacttggtgatcagcactgaacagagaggactcaccatggagttggggctgtgctgggttttccttgtttctgtcctagaagtgtccattctgttgtgcagcgtggtggaggtcggggggaggtcgttgggtaccggccggggggtctcgtaagactctcctgtgcacgcctaccggaatcagtattcaccagtctttggcctttcaccgttcggggtcccnccgaggtccgtccgttggggaacgggggtctgggaggtcggcgtggtacagttagtcgtcgtttcgtggtgggttgtacgttgggtcgtccgttcttcgtaccggcggtacttcgtggtacgggacggggtccgtagttccgacggtcctaaccgtttaccgaggtaaccgaaccgaacccgaccctaaaaccctaacccgttacccctacgtacctaacgttcccgtaccgtaacggtaacgtacccgggtaaaacctaacccggtacggaccggtaaaccgggacccgggtaccgggaacccgtaaccggggaacctttaacgttaacgttaacgtttaccgttaggtcccgtaaacggtaaccgtaaccggttaaacccgtttataaccggtcgtaaccgggttacggttcccggggttccgggggttacggggaccgttccggggtcccgttccccggggtacccccggggg

SEQ ID NO: 253240 - DNA, 540 bp, Homo sapiens
  misc_feature: GYAE6OF01DRZGY.21.53.E09.1.454.CMB.1.raw
  modified_base (377)..(377): a, c, t, g, unknown or other
  misc_feature (377)..(377): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaagggctggagtgggtctcatatattagtagtagtggtagtcccgtatactacgcagactctgtgaagggccgattcaccatcgccagggacaacgccaaagaactcacagtatctgcagatgaaatgcctgagagccgaggactcggccgtgtattacngtgcgagagatcccggcgatgagtggcgacggcgtggtactactttgattacgtgggccgagggaacccgtggtcaccgtctcctcacgcctccaccaacggcccactccggtccgttccccctggccgccctcgcctccgacggacgcaccctccgacgacg

SEQ ID NO: 253241 - DNA, 578 bp, Homo sapiens
  misc_feature: GYAE6OF01BIDA9.21.53.E09.1.454.CMB.1.raw
  modified_base (418)..(418): a, c, t, g, unknown or other
  misc_feature (418)..(418): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgaggggaagggctggagtgggtctcatatattagtagtagtggtacgtccgtatactacgcagactctggtgaagggccgattcaccatcgccgagggaccaacgccaagaactcacaagtatctgacagatgaaatgcctagagacggccgaggactcggccgtgttattacgtgtgcgagagtacgtcccggngagtgagtcggcggacggctaggtactacgttagtacgttacggtcggggaccgacgggtaacccgttggtcctaccgtcctcctcgacgtccctaccaccgacggcccacgtcccggtacccgttcccccgcggcccgcccgtcgcctccgacggaccg

SEQ ID NO: 253242 - DNA, 545 bp, Homo sapiens
  misc_feature: GYAE6OF01CL51D.21.53.E09.1.454.CMB.1.raw
  modified_base (448)..(448): a, c, t, g, unknown or other
  misc_feature (448)..(448): n is a, c, g, or t
  modified_base (520)..(520): a, c, t, g, unknown or other
  misc_feature (520)..(520): n is a, c, g, or t
  modified_base (540)..(540): a, c, t, g, unknown or other
  misc_feature (540)..(540): n is a, c, g, or t
tcagtcgtcgctcgcacgaccggtgctcgatttagagagagtgtgttgggtttgggctgagctgggtttccttgttgctattataaaaggtgtccagtgtcaggtgcagttggtggagtctgggggaggcttggtcaagcctgggagggtccctgagactctcctgtgcagcctctggattcaccttcagtgactactacatgggctggatccgccaggctccgaggggaaggggctggagtgggtctcatatattagtagtagtggtaagtcccgtatactacgcagactctgtgaagggccgattcacatcgccagggacaacgccaagaactcacagtatctgcagatgaaatagcctgagagcccgaggactcggccgtgtattactgtgcgagagactcccggacgaatgatggcgacggctaggtactactttgattaacgngggaccacgggaccctggtcaccgtctcctcacgcctccaccgaacggcccacgtccggtaccttcccccgnggcccgtaccctgcctccgnggacg

SEQ ID NO: 253243 - DNA, 567 bp, Homo sapiens
  misc_feature: GYAE6OF01EDCAT.21.53.E09.1.454.CMB.1.raw
  modified_base (335)..(335): a, c, t, g, unknown or other
  misc_feature (335)..(335): n is a, c, g, or t
  modified_base (397)..(397): a, c, t, g, unknown or other
  misc_feature (397)..(397): n is a, c, g, or t
  modified_base (537)..(537): a, c, t, g, unknown or other
  misc_feature (537)..(537): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgagggaaggggctgggagtgggtctcatatattagtagtagtggtagtcccgtatactacgcagactctgtgaagggccgattcaccatcgccagggacaacgccaagaactcacagtatcngcagatgaatagcctgagagccgaggactcggcgtgtattactggtgcgagagactcccggngactgagtggcgacggctggtacttactttgtattacgtgggccgagggaacccgtggtccacccgtctcctcacgcctacccaccgaacgggccctagtccggttcccgttcccccgtcggcccgtccccgtcgtcccncccgtacggacgccacccgtccggagaccg

SEQ ID NO: 253244 - DNA, 602 bp, Homo sapiens
  misc_feature: GYAE6OF01AF06H.21.53.E09.1.454.CMB.1.raw
  modified_base (341)..(341): a, c, t, g, unknown or other
  misc_feature (341)..(341): n is a, c, g, or t
  modified_base (405)..(405): a, c, t, g, unknown or other
  misc_feature (405)..(405): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgaggggaagggctggagtgggtctcatatattagtagtagtggtagtcccgtatactacgcagactctgtgaaggccgattcaccatcgccagggacaacgccaagaactcacagtanctgcagatgaatagcctgagagccgaggactcggcgtgtactactgtgcgagagacgtcccggngatgatgggcgacggcgtggtacttacgtttgactttacggtcggggtaccgaacggggtaaccccgttgggtcctaccccggttcctcccgtcacgtcccctacccgaacccgtaacgggtcccacccgtccggttccccggttcccccgttccccggcccggtccccgtcccgtcccgtcccgtccggtaaccgg

SEQ ID NO: 253245 - DNA, 537 bp, Homo sapiens
  misc_feature: GYAE6OF01DZ7VR.21.53.E09.1.454.CMB.1.raw
  modified_base (384)..(384): a, c, t, g, unknown or other
  misc_feature (384)..(384): n is a, c, g, or t
tcagtcgtcgctcgcacgaccggtgctcgatttagagagagtgtgttgggtttgggtttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccagggaaggggctggagtgggtctcatatattagtagtagtggtagtcccgtatactacgcagactctgtgaagggccgattcaccatcgccagggacaacgccaagaactcacagtatctgcagatgaatagcctgagagccgaggactcggccgtgtattactgtgcgagngatcccggcgatgatggcgacggctggtactactttgattacgtgggccagggaaccctggtcaccgtctcctcagcctccaccaacgggcccatccggtccttcccccgtggccgcccgtcgcctccacggacgcacccttccgagcgaccg

SEQ ID NO: 253246 - DNA, 559 bp, Homo sapiens
  misc_feature: GYAE6OF01DXB09.21.53.E09.1.454.CMB.1.raw
  modified_base (405)..(405): a, c, t, g, unknown or other
  misc_feature (405)..(405): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgagggaaggggctggagtgggtctcatatattagtagtagtggtagtcccgtatactacgcagactctgtgaaggcgattcaccatcgccagggacaacgccaaagaactcacagtatctgcagatgaatagcctgagagccgaggactcggcgtgtattactgtgcgagagacgtcccggngatgagtggcgacggctggtactactttgattacgtgggccgagggtaacccgtggtccaccgtctcctcacgccctccaccgaacgggccccacgttcccgggttacccttccccccgtcgggcccgtccccgtgcccgtccgacgggtaccg

SEQ ID NO: 253247 - DNA, 547 bp, Homo sapiens
  misc_feature: GYAE6OF01DPQS3.21.53.E09.1.454.CMB.1.raw
  modified_base (405)..(405): a, c, t, g, unknown or other
  misc_feature (405)..(405): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgagggagggctggagtgggtctcatatattagtagtagtggtagtcccgtatactacgcagactctgtgaagggccattcaccatccgcagggacaacgccaaagaactcacagtatctgcagatgaatagcctagagagccgaggactcggccgtgtattactgtgcgagagagtcccggngatgagtggcgacggctggtactagtttgattacgtcggggccacgggaaccctggtaccaccgtctcctcgacgccctccaacccgaacgggcccacgttcccggtccttcccccgcgtcccgccctgcctccgaggtccg

SEQ ID NO: 253248 - DNA, 530 bp, Homo sapiens
  misc_feature: GYAE6OF01B9XIL.21.53.E09.1.454.CMB.1.raw
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
  modified_base (407)..(407): a, c, t, g, unknown or other
  misc_feature (407)..(407): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (493)..(493): a, c, t, g, unknown or other
  misc_feature (493)..(493): n is a, c, g, or t
  modified_base (526)..(526): a, c, t, g, unknown or other
  misc_feature (526)..(526): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctgggagggtccctgagactctcctgtgcagcctctggattcaccttcagtgactactacatgggctggatccgccaggctccgagggaagggctggagtgggtctcatatattagtagtagtggtagtcccgtatactacgcagactctgtgaaggccgattcaccatcgccaggacaacgccaagaactcacagtanctgcagatgaatagcctgaganccgagactcggccgtgtattactgtgcgagagatcccggcgatgatggcgacggntggtactactttgattacgtgggcagggaaccctggtcncccgtacncctcagccctcaccgagggcccatccggtccttccccgnggcccgccctgccctccgaggacgccacctcgngacg

SEQ ID NO: 253249 - DNA, 547 bp, Homo sapiens
  misc_feature: GYAE6OF01D5Z6P.21.53.E09.1.454.CMB.1.raw
  modified_base (542)..(542): a, c, t, g, unknown or other
  misc_feature (542)..(542): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaaggggctggagtgggtctcatatattagtagtagtggtagtcccgtatactacgcagactctgtgaagggccgattcaccatcgccagggacaacgccaagaactcacagtatctgcagatgaatagcctgagagccgaggactcggccgtgtattactggtgcgagagatcccggcgatgatggcgacggctggtactactttgattacgtgggccagggaaccctggtcaccgtctcctcacgcctccaccaacgggcccacgtccggtccgttcccccgtggcccgtcccgtcgccctaccgacggacgaccaccctccgngaccg

SEQ ID NO: 253250 - DNA, 548 bp, Homo sapiens
  misc_feature: GYAE6OF01BC8I1.21.53.E09.1.454.CMB.1.raw
  modified_base (394)..(394): a, c, t, g, unknown or other
  misc_feature (394)..(394): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaaggggctggagtgggtctcatatattagtagtagtggtagtcccgtatactacgcagactctgtgaagggccgattcaccatcgccagggacaacgccaagaactcacagtatctgcagatgaatagcctgagagccgaggactcggccgtgtattactgtgcgagagatcccggngatgatggcgacggctgggtactactttgattacgtggggccagggaccctggtccaccgtctcctcacgccctccaccgaacgggcccctagtccggtcccttcccccgtggcccgcccctcgccctcccgacggacgccaccctccgagacg

SEQ ID NO: 253251 - DNA, 569 bp, Homo sapiens
  misc_feature: GYAE6OF01AQG3O.21.53.E09.1.454.CMB.1.raw
  modified_base (423)..(423): a, c, t, g, unknown or other
  misc_feature (423)..(423): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (547)..(547): a, c, t, g, unknown or other
  misc_feature (547)..(547): n is a, c, g, or t
  modified_base (552)..(552): a, c, t, g, unknown or other
  misc_feature (552)..(552): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgaggggaaggggctggagtgggtctcatatattagtagtagtggtagtcccgtatactacgcagactctgtgaagggccgattcaccatcgccagggacaacgccaaagacctcacagtatctgcaagatagaatcgcctggaagacgcccgaggaccgtcgggccgttagtattacgtgtggcgagacgacgtcccggngatggagtcgggacgcggcgtaggtacttacgtttgtacttacgtcggggaccgacggggtaaccctggtaccaccgtctcctcncnccctaccaccgacggcccagtcccgtcccgtccccgnggccncccgtgcctccgagccg

SEQ ID NO: 253252 - DNA, 538 bp, Homo sapiens
  misc_feature: GYAE6OF01C6U8T.21.53.E09.1.454.CMB.1.raw
  modified_base (458)..(458): a, c, t, g, unknown or other
  misc_feature (458)..(458): n is a, c, g, or t
  modified_base (500)..(500): a, c, t, g, unknown or other
  misc_feature (500)..(500): n is a, c, g, or t
  modified_base (523)..(523): a, c, t, g, unknown or other
  misc_feature (523)..(523): n is a, c, g, or t
  modified_base (534)..(534): a, c, t, g, unknown or other
  misc_feature (534)..(534): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgagggaaggggctggagtgggtctcatatattagtagtagtggtagtcccgtatactacgcagactctgtgaagggccattcaccatcgccaggacaacgccaagactcacagtatctgcagatgaatagcctgagagccgaggactcggcgtgtattactgtgcgagagacgtccggcgatgatggcgacggctggtactacgtttgattacgtgggacagggaaccctggtccaccgtctccncacgcctaccaccgaacgggcccacgtcggtcccttccccgnggccgccctgcctaccgaggacnccaccgtccgngacg

SEQ ID NO: 253253 - DNA, 624 bp, Homo sapiens
  misc_feature: GYAE6OF01EKB65.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgaggggaagggctggagtgggtctcatatattagtagtagtggtagtcccgtatactacgcagactctgtgaagggccattcacatcgcaggacacgccaagactcacagtatctgcagatagaatacgcctaggagagaccggaggactcgggccgttagttacttacgtggtgacggagagacgtcccggagagtggagtgggaccgacgggtcgttaggtacttacgtttgaacgtttaccggtcggggacccgaacggggtaaccccgttgggtaccctacccggtcctccctcgaccgtccctacccgaacccggtaaccgggcccctacggttcccggttacccttccccccgcgggtccccgtccccgttacggcccgtcccgacgggtacccg

SEQ ID NO: 253254 - DNA, 549 bp, Homo sapiens
  misc_feature: GYAE6OF01CBQZC.21.53.E09.1.454.CMB.1.raw
  modified_base (344)..(344): a, c, t, g, unknown or other
  misc_feature (344)..(344): n is a, c, g, or t
  modified_base (406)..(406): a, c, t, g, unknown or other
  misc_feature (406)..(406): n is a, c, g, or t
  modified_base (543)..(543): a, c, t, g, unknown or other
  misc_feature (543)..(543): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgagggaaggggctggagtgggtctcatatattagtagtagtggtagtcccgtatactacgcagactctgtgaaggccgattcaccatcgccagggacaacgccaaagaactcacagtatcngcagatgaatagcctgagagccgaggactcggccgtgtattactgtgcgagagagtcccggngatgagtggcgacggcgtggtacttactttgattacgtgggccgacgggaccctggtccaccgtcctcctcgacgccctacccaccgaacgggcccacgttccggtcccttcccccgcggtcccgccctgcctccgnggaccg

SEQ ID NO: 253255 - DNA, 552 bp, Homo sapiens
  misc_feature: GYAE6OF01BG0LE.21.53.E09.1.454.CMB.1.raw
  modified_base (395)..(395): a, c, t, g, unknown or other
  misc_feature (395)..(395): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgagggaagggctggagtgggtctcatatattagtagtagtggtagtcccgtatactacgcagactctgtgaagggccgattcaccatcgccagggacaacgccaagactcacagtatctgcagatgaatagctgagagccgaggactcggccgtgtattacgtgtgcgagagacgtcccggngagtgatggcgacggctggtacttacgtttgattacgtggggacccagggaaccctggtccaccgtctcctcacgccctaccaccgacggccctagtcccgtcccttcccccgtggcccgcccctcgccctccgaggacgaccacccgtccgagacg

SEQ ID NO: 253256 - DNA, 541 bp, Homo sapiens
  misc_feature: GYAE6OF01AUGM3.21.53.E09.1.454.CMB.1.raw
  modified_base (403)..(403): a, c, t, g, unknown or other
  misc_feature (403)..(403): n is a, c, g, or t
  modified_base (435)..(435): a, c, t, g, unknown or other
  misc_feature (435)..(435): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctggggggaggcttggtcaagcctggagggtccctgagactctcctgtgcagcctctggattcaccttcagtgactactacatgggctggatccgccaggctccgaggggaagggctggagtgggtctcatatattagtagtagtggtagtcccgtatactacgcagactctgtgaaggccattcacatcgcagggacaacgccaagactcacagtatctgcagatgaatagcctgagagccgaggactcggccgtgtattacgtgtgcgagagactcccggngatgatggcgacgcgtgtactattgattacgngggccacgggtaccctggtccaccgtctcctcacgtccctaccgaccgacgggcccacgttcccggtccttcccccgtcggtcccgcccgtgccctccgaggaccg

SEQ ID NO: 253257 - DNA, 729 bp, Homo sapiens
  misc_feature: GYAE6OF01EJQGR.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctgggagggtccctgagactctcctgtgcagcctctggattcaccttcagtgactactacatgggctggatccgccaggctccgagggaagggctggagtgggtctcatatattagtagtagtggtagtccgtatactacgcagactctgtgaagggccattcacatcgccagggacaacgcaagaactcacagtatctgcagatagaaatagcctggaagacggcccggaagggaccgtcgggcccggttgtaacgtttactggttaggccgaaggaacgaacgtccccgggacgtagttggaagtcgggaccggaaccgggtcgttacgggttaaccttacgttttaggtaacgtttaccggtacggggggaccccggtaaccgggggtaaacccccgttcgggttaccccgtaacccggttcccgttaccccgttaccgaacccggtacccccgtaacccccgtaaaccccgggtaaaccggggaccccccgtaacggtttccccgggttcccccgtttaccccccccggtcggggtccccgtacccccgttaccggtccccgttaccccgaacggggtaacccg

SEQ ID NO: 253258 - DNA, 605 bp, Homo sapiens
  misc_feature: GYAE6OF01DY14E.21.53.E09.1.454.CMB.1.raw
  modified_base (400)..(400): a, c, t, g, unknown or other
  misc_feature (400)..(400): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctctggattcaccttcagtgactactacatgggctggatccgccaggctccgaggggaaggggctggagtgggtctcatatattagtagtagtggtagtcccgtatactacgcagactctgtgaaggcgattcaccatcgccagggacaacgccaaagactacacagtatctgcagatgaatacgcctgagagccgaggactcggccgtgtacttactgtgcgagagacgtcccggngtatgaagtcggacggacggcgtggttacttacgtttgtactttacggtcgggaccgaacgggaacccgttggtacctaccggtccttcccgtacgacgtccctacccaacccggaaccgggtccccacgttcccggttcccgttcccccgtgggcccgtccccgttcgccctccgacggaccgacccgacccgtccgaggaccg

SEQ ID NO: 253259 - DNA, 540 bp, Homo sapiens
  misc_feature: GYAE6OF01BCMIG.21.53.E09.1.454.CMB.1.raw
  modified_base (534)..(534): a, c, t, g, unknown or other
  misc_feature (534)..(534): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccaggggaaggggctggagtgggtctcatatattagtagtagtggtagtcccgtatactacgcagactctgtgaagggccgattcaccatcgccagggacaacgccaagaactcacagtatctgcagatgaatagcctgagagccgaggactcggccgtgtattactgtgcgagagatcccggcgatgatggcgacggctggtactactttgattacgtggggccagggaaccctggtcaccgtctcctcagcctccaccacggcccacgtccggtccttccccgtcggccgccctcgcctcccgaggacgccacccgtccgngcgccg

SEQ ID NO: 253260 - DNA, 585 bp, Homo sapiens
  misc_feature: GYAE6OF01DE8QY.21.53.E09.1.454.CMB.1.raw
  modified_base (397)..(397): a, c, t, g, unknown or other
  misc_feature (397)..(397): n is a, c, g, or t
tcagtcgtcgctcgcacgaccggtgctcgatttagagagagtgtgttgggtttgggtttccttgttgctattataaaaggtgtccagtgtcaggtgcagttggtggagtctggggggaggcttggtcaagcctggagggtccctgagactctcctgtgcagcctctggattcaccttcagtgactactacatgggctggatcccgccaggctccgaggggaagggctggagtgggtctcatatattagtagtagtggtagtcccgtatactacgcagactctgtgaagggccgattcaccatcgccaggacaacgccaagaactcacagtatctgcagatgaaatagcctgagagccgaggactcggccgtgtattactgtgcgagagactcccggngatgagtgggcgacgggccttagggtacttaccgtttagatttacggtggggacccgacggggtaaccctggtaccacccggttctccctcacgccctccgaaccgaacgggccccacgtcccggtccccgttcccccgtggccctccccgtcgtccctcccggacggacgccacccgccggagaccg

SEQ ID NO: 253261 - DNA, 556 bp, Homo sapiens
  misc_feature: GYAE6OF01ELGN5.21.53.E09.1.454.CMB.1.raw
  modified_base (438)..(438): a, c, t, g, unknown or other
  misc_feature (438)..(438): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgagggaaggggctgggagtgggtctcatatattagtagtagtggtagtcccgtatactacgcagactctgtgaaggccgattcaccatcgcagggacacgccaagactcacagtatctgcagatgaatagcctgagagccgaggactcggccgtgtattacgtgtgcgagagacgtcccggcgatgagtggcgacggcgtaggtacttacgtttgtacgttacgnggggaccgacgggtaccgtcggtaccaccgttctcctcacgccacaccgaacgggcccacgtccggttcctccccgtggcccgtcccgtcgcctccgaggacgccaccgtccgagacg

SEQ ID NO: 253262 - DNA, 577 bp, Homo sapiens
  misc_feature: GYAE6OF01AZTHT.21.53.E09.1.454.CMB.1.raw
  modified_base (337)..(337): a, c, t, g, unknown or other
  misc_feature (337)..(337): n is a, c, g, or t
  modified_base (401)..(401): a, c, t, g, unknown or other
  misc_feature (401)..(401): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattcaccttcagtgactactacatgggctggatccgccaggctccgaggggaaggggctgggagtgggtctcatatattagtagtagtggtagtcccgtatactacgcagactctgtgaagggccgattcaccatcgccagggacaacgccaagaactcacagtatcngcagatgaatagctgagagccgaggacgtcggcgtgtattacgtgtgcgagacgacgtcccggngatgagtggcgacggcgttggtacttactttgtattacggtcgggcgacgggaccctggtccaccgtctcctcgacgcctcccaaccgaacgggccctacgtccggttccccttcccccgtcggcccgtccccgtcgccgtcccgacggtacgccctacccgtccggagcgacccg

SEQ ID NO: 253263 - DNA, 582 bp, Homo sapiens
  misc_feature: GYAE6OF01CQCWP.21.53.E09.1.454.CMB.1.raw
  modified_base (406)..(406): a, c, t, g, unknown or other
  misc_feature (406)..(406): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggagcttggtcaagcctggagggtccctgagactctcctgtgcagcctccggattcaccttcagtgactactacatgggctggatccgccaggctccgaggggagggctggagtgggtctcatatattagtagtagtggtagtcccgtatactacgcagactgtgtggaagggccattcaccatcgccaggacaacgccaagaactcaacagtatctgacagatgaatacgctagaagacgccgaggacctcgggccgttagttattacgtggtgcgaagagacgtccggngatgacgtggcgacggtctaggtacttacgttagacttacggtcgggacgacggtacccgtggtaccaccgtcctacctcgacgtcctaccaccgaaccggtcctacgtccgtcccttccccgtggccctccccgtcgcccgtcccgaggtaccgaccacccgtccgagcgtaccg

SEQ ID NO: 253264 - DNA, 623 bp, Homo sapiens
  misc_feature: GYAE6OF01BLUN1.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaaggggctgggagtgggtctcatatattagtagtagtggtagtcccgtatactacgcagactctgtgaagggccgattcaccatcgccagggacaacgccaaagactcacagtatctgcagatagaatacgcctagagacgccggaggacgtcggcgttgtattacgtgtcgcgtagacgtacgtcccgggcgacgtgacgtgggcggtacggtcgtgggttacttacgtttggtattacggacggggaccaacggggtaacccgttgggtcccaccggttcctacccgtccacgccctacccgaacccgaaccgggtcccctaacggttcccggttaccccgttccccccgtacggggtcccctccccgtcggtcccttcccggagggtaccccg

SEQ ID NO: 253265 - DNA, 639 bp, Homo sapiens
  misc_feature: GYAE6OF01CM6L2.21.53.E09.1.454.CMB.1.raw
  modified_base (331)..(331): a, c, t, g, unknown or other
  misc_feature (331)..(331): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtggggggaggcttggtcaagcctgggagggtccctgagactctcctgtgcagcctctggattcaccttcagtgactactacatgggctggatcccgccaggctccgagggagggctgggagtgggtctcatatagttagtagtagtggtagtccgtatactacgcagactctgtgaagggccattcaccatcgaccaggacacgacaagactcacatanctgcagatagaatagctagagacgcgagctcggctgtattactgtgacgagacgcgtcccggacgtatggagtcggccggacggtcgttacgggtaaccttaagtttcgtaacgtttaccggtcgggggacccgaaccgggggtaaaccccgttcggtacccgtaccccggtttcctccccttaccgaacgtcccctacccgaacccgaaacggggtccccaaccggttcccggtccccttccccccgtggaccccgtccctccggacctcccgacgggtacaccccgtacccgtcccggaagacccg

SEQ ID NO: 253266 - DNA, 610 bp, Homo sapiens
  misc_feature: GYAE6OF01BFSPW.21.53.E09.1.454.CMB.1.raw
  modified_base (414)..(414): a, c, t, g, unknown or other
  misc_feature (414)..(414): n is a, c, g, or t
  modified_base (560)..(560): a, c, t, g, unknown or other
  misc_feature (560)..(560): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgaggggaaggggctgggagtgggtctcatatattagtagtagtggtagtcccgtatactacgcagactctgtgaagggccgtattccaccatcgccagggacaacgccaaagaactcacagtatctgcagatgaatagcctagacgacgccggaggacctcggccgtgttacttacgtggtgacgagagtacgtcccgggngagtgagtcgggacgacggcgtagggttacttacgtttgtacgtttacggtcggggaccgaacgggtaacccgtcgggtccacccgttcctcccgtcacgccctaccgaccgaacgggtccctacgtcccggtcccgttcccccgnggtccccgccctcgcccgtacccgaggaccaccgacccgtcccgagaccg

SEQ ID NO: 253267 - DNA, 627 bp, Homo sapiens
  misc_feature: GYAE6OF01AQ66W.21.53.E09.1.454.CMB.1.raw
tcagtcgtcgctcgcacgaccggtgctcgatttagagagagtgtgttgggtttgggttttccttgttgctattataaaaggtgtccagtgtcagttgcagttggtggagtctggggggaggcttggtcaagcctggagggtccctgagactctcctgtgcagcctctggattcaccttcagtgactactacatgggctggactccgccaggctccgaggggaaggggctgggagtgggtctcatatattagtagtagtggtagtccgtatactacgcagactctgtggaaggccgattcaccatcgcgaggacaacgaccaagactcacagtatctgacagatagaatagccgtaggagacggaccggaggaccgtccgggtccgtaggttactttaacgtggtaggacggtaagacgacgtcccgggagagttgagtcgggccgacgggtcgtacggttacttacgttagtacgtttacggcggggccgtaacgggtaccgttcggaccgtaccgttcctccgtacacgtccctaccgaccgacggccctacgtccggttccccttccccgcggcccgtccccgtcgccgtaccgacggtacccgacccacccgtccggaggaccg

SEQ ID NO: 253268 - DNA, 546 bp, Homo sapiens
  misc_feature: GYAE6OF01E4CD6.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaaggggctggagtgggtctcatatattagtagtagtggtagtcccgtatactacgcagactctgtgaaggccgattcaccatcgccagggacaacgccaagaactcacagtatctgcagatgaatagcctgagagccgaggactcggccgtgtattactgtgcgagagagtcccggcgatgagtggcgacggctggtacttacgtttgattacgtggggccgacgggaaccctggtcctaccgtctcctcacgccctccaccgacggcccacgtcccggtccttcccccgtcggtcccgccctgcctcccgaggtaccg

SEQ ID NO: 253269 - DNA, 679 bp, Homo sapiens
  misc_feature: GYAE6OF01A4ZXO.21.53.E09.1.454.CMB.1.raw
  modified_base (281)..(281): a, c, t, g, unknown or other
  misc_feature (281)..(281): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggactccgcaggctcgagggaagggctggagtggtctcatatattagtagtagtggtagtcccgtatactacgnagctctgtggaagggccaattccacgatcgaccgaggacaacgccaaagactcacagtactctcgacagtagtagaactacgccgtagacgaacggtccggaaggaccgttcgggtaccgttagttaacgtttacgtggtacgtacggaagaacgacggttcccgggacgtaagtggtaacgtcgggaacgtaccgggtcgttacgggttaacctttacgtttaggtaacgtttaaccgggtcggggtaacccgtaaacgggggtaaccccgttagggtaccctaaccggttacccgtaccgtaccgaccggtcccgtacccgaaccggtaaccgggccctacggtcccggttacccttcccccgtcggcctaccccgtcgacgtcccgaggtacccg

SEQ ID NO: 253270 - DNA, 548 bp, Homo sapiens
  misc_feature: GYAE6OF01D5XQW.21.53.E09.1.454.CMB.1.raw
  modified_base (433)..(433): a, c, t, g, unknown or other
  misc_feature (433)..(433): n is a, c, g, or t
  modified_base (471)..(471): a, c, t, g, unknown or other
  misc_feature (471)..(471): n is a, c, g, or t
  modified_base (529)..(529): a, c, t, g, unknown or other
  misc_feature (529)..(529): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattcaccttcagtgactactacatgggctggatccgccaggctccgaggggaagggctggagtgggtctcatatattagtagtagtggtagtcccgtatactacgcagactctgtgaagggccgattcaccatcgccagggacaacgccaagactcacagtatctgcagatgaatagcctgagagccgaggactcggccgtgtattactgtgcgagacgagtcccggcgatgatggcgacggctggtacttactttgattacgngggcacgggaccctggtccaccgtctccgtcacgtccnccaccgacggcccagtccggtcccttccccgcggtcccgccctcgcctccgacggacnccgaccctccgagcgaccg

SEQ ID NO: 253271 - DNA, 670 bp, Homo sapiens
  misc_feature: GYAE6OF01EXZK7.21.53.E09.1.454.CMB.1.raw
  modified_base (252)..(252): a, c, t, g, unknown or other
  misc_feature (252)..(252): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtcgtgggggaggcttggtcaagcctgggagggtccctgagactctcctgtgcagcctctggattcaccttcagtgactactacagtgggctggatcccgccaggctccgaggggagggctgggagtgggtctnatatattagtagtagtggtacgtcccgtatactacgcagactctggtgaaggggccctattccaccagtccgaccgaaggggaaccaaccggacccaaagaacctcaacagtactctgacaagtatagaatacgcctaggagacgccggaaggaccgtcgggccgttagtacttacgtggtacggacggaaggacgtaccgtcccggagtagtgacggtcgggacggtaccggtcgtttacggtactttacgtttgtaacgtttaccggaccgggggtacccgaaccgggttaacccgtcggtaccctacccgtcgttccctcgaccgtcccctaccgaacccggtaacgggccctacgttcccgggttaccccttccccggcggtacccccgtcctacgccccgtccgaaggacccg

SEQ ID NO: 253272 - DNA, 590 bp, Homo sapiens
  misc_feature: GYAE6OF01A4CSM.21.53.E09.1.454.CMB.1.raw
  modified_base (403)..(403): a, c, t, g, unknown or other
  misc_feature (403)..(403): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgaggggaagggctggagtgggtctcatatattagtagtagtggtagtcccgtatactacgcagactctgtgaagggccgattcaccatcgccagggacaacgccaagactcacagtatctgcagatgaatagcctagagacgccgaggacctcggccgttagtattacgtgtgcgagacgacgtcccggngatgagtgggcgacggcgttacggtacttacgtttagtagttaccggtcggggtaccgaacgggtaacccgtgggtacctaccgtcctcctcgacgccctaccgaccgacgggaccctacgtcccgtccgttcccccgtggcccgtccctcgccctaccgacggacacccgacccgtccgaagaccg

SEQ ID NO: 253273 - DNA, 644 bp, Homo sapiens
  misc_feature: GYAE6OF01EEN95.21.53.E09.1.454.CMB.1.raw
  modified_base (181)..(181): a, c, t, g, unknown or other
  misc_feature (181)..(181): n is a, c, g, or t
  modified_base (592)..(592): a, c, t, g, unknown or other
  misc_feature (592)..(592): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtggggggaggcttggtcaagccgtggagggtccctgagactctcctgtgcagcctctggattcaccttnagtgactactacatgggctggactccgcaggctaccgagggagggctggagtggtctcatatattagtagtagtggtacgtccgtatactacgcagactctgtgaaggcattcacatcgcgaggacaacgccaaagactcacagtactctagcaagactagaaatacgccgtagacgacggtccgaaggtaccgtcggtaccgttagtaacgtttcgtaggtcgacggaagacggaccgtccccgggagtagtacggagtcgggaccggtaacggtcggttaggttaacctttaggtttagtacgttacggtcgggaccgtaacgggtacccgtcggtacctacccgtccgtacctacgaccgccctacccgaccgaaccggccctacggtcccgttccccgttccccggnggcccctccggtcgtacccgaccgtacggacgtacccaccgtcgacggtacg

SEQ ID NO: 253274 - DNA, 599 bp, Homo sapiens
  misc_feature: GYAE6OF01EAXNU.21.53.E09.1.454.CMB.1.raw
  modified_base (381)..(381): a, c, t, g, unknown or other
  misc_feature (381)..(381): n is a, c, g, or t
  modified_base (401)..(401): a, c, t, g, unknown or other
  misc_feature (401)..(401): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctctggattcaccttcagtgactactacatgggctggatccgccaggctccgagggaaggggctggagtgggtctcatatattagtagtagtggtagtcccgtatactacgcagactctgtgaagggccgattcaccatcgcagggacaacgccaagaactcacagtatctgcagatgaatagcctgagagccgaggacctcggccgttgtattacgngtgcgaggagacgtcccggngagtgagtgggcggacggcgtgggttacttacgtttgtatttacggtcggggccgaacgggtaacccgtggtacctacccgtcctccctcacgccctcccgaacccgaacgggcccctacgtcccggttcccctttcccccggtggcccgtccccgtcgccctacccgacgggaccacccaccccgtccgaggaccgg

SEQ ID NO: 253275 - DNA, 669 bp, Homo sapiens
  misc_feature: GYAE6OF01BE7YL.21.53.E09.1.454.CMB.1.raw
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattcaccttcagtgactactacatgggctggactccgccaggctccgaggggagggctggagtggtctnatatattagtagtagtggtacgtccgtatactacgcagactctgtgaagggccatcaccancgcagggacaacgcaagactcacagtatctgcagatagaatgctagagacgccgaggactcgggcgtagtatacgtggtcgacggagagtaccgtcccggtcgagtcgagtcgggacgacgggtcgttcgggttaaccttacgtttagtagtttaccggtcgggggtacccgtaacggggtaaccccgttcggtacccgtaacccggttcccgtaccccgtaccgtaaccgtccccgtaccccgaacccgaaaccggggtcccctaaccgttcccggttaccccgttccccccggtcggccccgtaccccgtcgaccccgtaccgaaccgggtaccgacccgtaccccggaccgaacggacggtaccccg

SEQ ID NO: 253276 - DNA, 659 bp, Homo sapiens
  misc_feature: GYAE6OF01E5CUJ.21.53.E09.1.454.CMB.1.raw
  modified_base (236)..(236): a, c, t, g, unknown or other
  misc_feature (236)..(236): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctcggattcaccttcagtgactactacatgggctggatccgccaggctccgagggagggctggagtgggtctnatatatagtagtagtggtagtcccgtatactacgcagactctgtgaagggccgattcaccatcgcgagggaccaacgccaaagactcaacagtatctagcagatgaactagcctaggacgaggcccgaggacctccgggtcgtagttaacttacgtggtacgacggaagacgacgtcccgggagtagtagagtcgggacggtacgggtcgttagggtacctttaacgtttgtacgttacggtcgggggaccgtacggggtaacccgtgggtacccgtaccggttcctcccgtacgtaccgaccctacccgaaccgaaccgggtccctaaccgttcccggtaccccgtttcccccggcggtccccggccccgtcgacccgtccggaacggtaccgtacccgacccgtccggaacggcgtacccg

SEQ ID NO: 253277 - DNA, 772 bp, Homo sapiens
  misc_feature: GYAE6OF01EY6D4.21.53.E09.1.454.CMB.1.raw
  modified_base (447)..(447): a, c, t, g, unknown or other
  misc_feature (447)..(447): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctgggagggtccctgagactctcctgtgcagcctctggattcaccttcagtgactactacatgggctggatccgccaggctccgaggggaaggggctgggagtgggtctcatatattagtagtagtggtagtcccgtatactacgcagactctgtagaaggccgattcaccatcgcagggacaacgcaagaactcacagtactctgacagatgaatagcctggagacgacccggaaggaccgtcgggtcccggttagttaacgtttacgtggtacggcggaacggtacggtaccgttaccccgggnggtaagtcggacggttacggggcccggtaaacgggtccgttacgggtttaaacctttaaccggttttaggtaacggttttaaccgggtaccggggggtaccccggtaaaccggggggttaacccccgttcggggttaaccccgtaccccgggttaccctttaccccgtacccggtaacccgtcccccgttaaccccgaaacccggtaacccgggggtaccccctaaccgggtttccccgggtttccccccgtttacccccccggttccgggggtacccccgttcccccgttacggacccccgttaccccggacggggtaaccccg

SEQ ID NO: 253278 - DNA, 607 bp, Homo sapiens
  misc_feature: GYAE6OF01ANOS3.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgaggggagggctggagtgggtctcatatattagtagtagtggtagtcccgtatactacgcagactctgtgaagggccgattcaccatcgccagggacaacgccaagaactcacagtatctgacagatgaatgcctgagacgccgaggaccgtcggccgttgtattacgtgtgcgagagacgtcccggagatgacgtgggaccgacgggcgttacggtaacttacgtttagtaacgtttacggtacggggtacccgtacggggtaacccgttcggtacccgtacccgttccgtccctccgacgtccctacccgacccgaccgggtcccacgttcccggttcccttccccccgtcggcccgtcccctagcccgtccgcggtacccg

SEQ ID NO: 253279 - DNA, 823 bp, Homo sapiens
  misc_feature: GYAE6OF01B82S4.21.53.E09.1.454.CMB.1.raw
  modified_base (333)..(333): a, c, t, g, unknown or other
  misc_feature (333)..(333): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtcgtgggggaggcttggtcaagcctgggagggtccctgagactctcctgtgcagcctctggattcaccttcagtgactactacatgggctggactcccgccaggcctaccgaggggaaggggcgtagggaggtgggtctcaagtatagttaggtagttagtgggtactcccgtatacgtacgcaagactctgtaggaacgggccattccaaccntccggaccgaagggaaccaacgaccaaaacgaacctacgaacagtatcgtagacaagagtaagaattacgcccgtagaacggacgtacggaacggacggttccgggcgtttagttattacgtaggtcggtacggaaggacggtaccggtacccggtacggtagtaggtaggttaccgggaccggtaccgggtacgttacgggtttaaaccgtttacgtttagttaacggtttaaccgggtccggggggtaacccggtaaacccgggggttaaccccggttccggttaaccccgttaccccggttccccgttacccgtaacccgtacccgtaccccgtaacccggaaacccccgggtaacccgggtaccccccttaacgggtttccccccgggttccccccggttttaccccccccgggtcccgggtacccccgggtacccccgtttaccccgggcccccggttaacccggggaacccggtaaccccccgg

SEQ ID NO: 253280 - DNA, 523 bp, Homo sapiens
  misc_feature: GYAE6OF01B4O3H.21.53.E09.1.454.CMB.1.raw
  modified_base (399)..(399): a, c, t, g, unknown or other
  misc_feature (399)..(399): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (493)..(493): a, c, t, g, unknown or other
  misc_feature (493)..(493): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctctggattcaccttcagtgactactacatgggctggatccgccaggctccgagggaggggctgggagtgggtctcatatattagtagtagtggtatcccgtatactacgcagactctgtgaaggccgattcaccatcgccagggacaacgccaaagactcacagtatctgcagatgaatacgcctgagagccgaggactcggccgtgtacttacgtgtgcgagagacgtcccggngatgatggcgacgcgtggtactacttgattacgcgggaccagggacctggtcacccgtctccnacncctcaccgaggcccagtcgtcctcccgngccgcctgcctcgagacncnccnccgnacg

SEQ ID NO: 253281 - DNA, 654 bp, Homo sapiens
  misc_feature: GYAE6OF01EW7AO.21.53.E09.1.454.CMB.1.raw
  modified_base (325)..(325): a, c, t, g, unknown or other
  misc_feature (325)..(325): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacagtgggctggactccgccgaggctccgaggggaagggctggagtggtctcatatagttagtagtaggtggtacgtccgtatactacgcagactctgtgaacggccgattcaccatcgcgaggacaacgcaagacncacagtatcgtgacagactagaatcgccgtagacgagcgaggacctcggcgttagtattacgtgtcgacgacgacgtacgtcccggagagtacggtagtcgggaccggacggtacgttacggttacttacgtttacggtacgttacgggtacgggtacccgtaacgggtaacccgttcggtacccgacccgttccgtaccctccgaccgtacccctacccgaaccggaaccgggtccctaaccggttcccggttaccccgttcccccggtcggcccgtccccgtcgcccgtaccgacgggaccacccgacccgtccggacggtaacccg

SEQ ID NO: 253282 - DNA, 690 bp, Homo sapiens
  misc_feature: GYAE6OF01AI9P3.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgagggaaggggctggagtgggtctcatatattagtagtagtggtagtccgtatactacgcagactctgtgaaggccgatcacatcgcaggacacgccaagactcacagtatctgcagatagaatacgcctgagacgccgaggtactcggccgtgtacttacgtggtacgcgagagtacgtcccgggtagagtacggagttcgggccggtacgggtcgttacggggttaacttacggttttaggtacgtttaaccgggtcgggggtacccgtaaccggggtaacccgttggttaccccgacccggttcctaccccgttccgaccggttaccccgtaccgaacccgggtaaccgggtccccttaccgggttaccccggttcccccgtttacccccggtcgggaccccgttccccgttacggtccccgttaaccggaacgggttacccaccccggtaaccctcccgggaaggtaccccgg

SEQ ID NO: 253283 - DNA, 886 bp, Homo sapiens
  misc_feature: GYAE6OF01CDO8N.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtcgtggggggaggcttggtcaagcctgggagggtccctggacgactctcctgtgcacgcctccggattcaccttcagtcgactactacagtgggctggactccgccaggctccggaaggggacgggtctgggaggtggggtcggtaccgttaagttaacgaaaagggaacgactaacgagttaacaggtacaagtaacgtacggcgtcgtcgtaggtaagaaaggtacggtttccaacgtacgtcaacgtaaagaggtaacttgtaacttaaacgaaaacgtaacctactaaccggtagttaaccgtccgtaagaaaccgtaaaggtacgaaaaccgtaccggtaacggtaaaacggaaaaacccggggaccgtaaccgtaaccccgggttacgtttagtttaaacgtttaggttacgggtaaacgggtaaagtaaaaccgaaaggtacgggtaggttacggtagggttagggtacggtacggtacggtttacggaacgtaccgttagtaggtcgttaggtcccgttagtagttacgtacggtacgggttaccgggggaacccgtaaggggtaacccttagggtacccggtacccttacggttaacccgttcgtaccgaacccggtacccgttacccaaaacccgggttacccggaccccgtttaccggttacccccggttcccccgtcccccggggttcccgtaaacccgggttccccccttaacggccccggttaaaccgggccccgggttaccgtaacccggttaacccccggg

SEQ ID NO: 253284 - DNA, 671 bp, Homo sapiens
  misc_feature: GYAE6OF01A358I.21.53.E09.1.454.CMB.1.raw
  modified_base (239)..(239): a, c, t, g, unknown or other
  misc_feature (239)..(239): n is a, c, g, or t
  modified_base (424)..(424): a, c, t, g, unknown or other
  misc_feature (424)..(424): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattccaccttcagtgactactacatgggctggactccgccaggctccgaggggagggctggagtggtctnatatattagtagtagtggtacgtccgtatactacgcagactctgtgaagggccatcaccatcgccagggacacgcaagactcacagtactctgacagtatacgaatacgcctaggagacggccgaggaccgtcgggtccgtagttattaccgtggtacggacggaagacggtaccgtccccgggngtagttcggagtcgggaccggacggtcgttacggttaacttagtttacgtacgttaccgggtcggggacccggacgggtaaccccgtcggtacctacccggttcctccgtaccgtacccgtacccctaaccgaccccggtaaccgggacccctcggttccccgttccccttcccccggtcgggccccgtccccgtcgtccccgaccggtaccggccgtacccgaaccccgtcggaacgccgacccgg

SEQ ID NO: 253285 - DNA, 644 bp, Homo sapiens
  misc_feature: GYAE6OF01C89IO.21.53.E09.1.454.CMB.1.raw
  modified_base (358)..(358): a, c, t, g, unknown or other
  misc_feature (358)..(358): n is a, c, g, or t
  modified_base (395)..(395): a, c, t, g, unknown or other
  misc_feature (395)..(395): n is a, c, g, or t
tcagtcgtcgctcgcacgaccggtgctcgatttagagagagtgtgttgggtttgggttttcttgttgctattataaaaggtgtccagtgtcaggtgcagttggtggagtcgtgggggaggcttggtcaagcctggagggtccctgagactctcctgtgcagcctcggattcaccttcagtgactactacagtgggctggatcccgccaggctccgaaggggagggctggagtggtctacatatattagtagtagtggtagtccgtatactacgcagactctgtaggaacggccgtattcacagtccgaccaaggggaacaacgcctaaagaactcacagttacactgcagtaatgaanacgcctagagaacgtccggagacgtcggccgttagtntttaactggtagcgaagtagacgtcccggacgaacgtgagtggcgacggtcgtaggttacttactttaggtacgttacggtcgggtaccgtacgggaaccgttcggtaccgtacccgtccttccgtcaccgtcctacccgaccgaacgggccaaccgttcccggttacccgttacccccggtcggaccccggtccccgttcgtcccgttaccgaccggacgcccgtacccgtaccggcgtacgacccgg

SEQ ID NO: 253286 - DNA, 611 bp, Homo sapiens
  misc_feature: GYAE6OF01ESE0C.21.53.E09.1.454.CMB.1.raw
  modified_base (382)..(382): a, c, t, g, unknown or other
  misc_feature (382)..(382): n is a, c, g, or t
  modified_base (434)..(434): a, c, t, g, unknown or other
  misc_feature (434)..(434): n is a, c, g, or t
  modified_base (588)..(588): a, c, t, g, unknown or other
  misc_feature (588)..(588): n is a, c, g, or t
tcagtcgtcgctcgcacgaccggtgctcgatttagagagagtgtgttgggtttgggctgagctggtttcttgttgctattataaaaggtgtccagtgtcaggtgcagttggtggagtctggggggaggcttggtcaagcctgggagggtccctgagactctcctgtgcagcctctagattccaccttcagtgactactacagtgggctggatccgccaggctccgaggggaagggctggagtggtctcatatattaggtagtagtggtagtcccgtatactacgcagactcgtgtgaagggtcccattccgacctatccggaccagggaaccaaccggaccaagaactcacgaagtatcgtagcagatagaatagcctgagngaccgaggtctcggcgttatattacgtgtgacgagacgacgtccggcgtagngagtggccgacggctggtacttacgttgattacgggtacggggacctaacgggtacccgtgggttcctaacccggtcctacccgacgacgtccctaccccgaaccggtaaccgggcccctacgttccggtccccgttcccccgacgggtccccncccgtacgtctcccgaggacccg

SEQ ID NO: 253287 - DNA, 595 bp, Homo sapiens
  misc_feature: GYAE6OF01DW3TW.21.53.E09.1.454.CMB.1.raw
  modified_base (181)..(181): a, c, t, g, unknown or other
  misc_feature (181)..(181): n is a, c, g, or t
  modified_base (242)..(242): a, c, t, g, unknown or other
  misc_feature (242)..(242): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
  modified_base (560)..(560): a, c, t, g, unknown or other
  misc_feature (560)..(560): n is a, c, g, or t
tcagtcgtcgctcgcacgaccggtgctcgatttagagagagtgtgttgggtttgggttttccttgttgctattaataaaaggtgtccagtgtcaggtgcagttggtggagtctgggggagcttggtcaagcctgggagggtccctgagactctcctgtgcagcctcgtggacttcaccttnagtgactactacagtgggctggactccgccgaggctcgaggggaagggctggagtggtctnaatatagttagtagtagtggtacgtccgtaatacctacgcagactcgtgtagaaggccattcacatcgcgaggacaacgcaagactcacagtanctagcaagntagaatacgcctaggagcgacggagacgtcggcgtagtattacgngtgacgagagacgtccggagtagngagtcggacgtacggcgtagtaacgttagtttagaagttaccggacgggaccggtaacggacccgtggtaccaccgtcctccgacaccgtacctaccgaaccggaacgcccgtacgtacccgttcccgtcccgtcggcccgtcccncgtcctacccgaggacgaccaccgtcgagaaccgg

SEQ ID NO: 253288 - DNA, 676 bp, Homo sapiens
  misc_feature: GYAE6OF01C0WSZ.21.53.E09.1.454.CMB.1.raw
  modified_base (388)..(388): a, c, t, g, unknown or other
  misc_feature (388)..(388): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtggggggaggcttggtcaagcctggagggtccctgagactctcctgtgcagcctccggattcaccttcagtgactactacagtgggctggactccgccaggctccgaggggagggctggagtggtctcatatattagtagtagtggtacgtccgtatactacgcagactcgtgtggaaggccgattcaccatccgccgagggacaacgaccaagactcacgatactcgtgacagatgaatacgctagagagccgaggaccgtcggcgtgtattcgngtgacgagacgacgtccggacgtagtgagtggaccggacggtcgttacggtaccttacgtttaggtaacgtttaccggacggggtacccgtaacggggtaacccgttcggtacccgtacccgttacccgtcccgttacgacccgtacccctacccgaacccgtaaccgggaccccgtaccgtccccgggttacccccgttacccccggtccgggcccccgtcccgttccggtacccgttacccggacgggtaccgacccgtaccccgtaccggacggacggtacccgg

SEQ ID NO: 253289 - DNA, 734 bp, Homo sapiens
  misc_feature: GYAE6OF01A921X.21.53.E09.1.454.CMB.1.raw
  modified_base (289)..(289): a, c, t, g, unknown or other
  misc_feature (289)..(289): n is a, c, g, or t
tcagtcgtcgctcgcacgaccggtgctcgatttagagagagtgtgttgggtttgggctgagcgtggtttctgtagctattataaaaggtgtccagtgtcaggtgcagttggtggagtctgggggaggcttggtcaagcctggagggtccctgagactctcctgtgcagcctctggattcaccttcagtgactactacatgggctggactccgccaggctccgaggggaaggggctggagtgggtctcatatattagtagtagtggtagtcccgtatactacgcagactntgtgaaggccgatcacatcgcgaggacacgcaagactcacagtatctgacagtatagaatagcctaggagacgaccggaggactcgggccgttgttacttacgtggtagcgaaggagtacgtcccgggatagtaggacgtcgggacgtaccgggtcgttacgggttaactttaccgttttaggtaacgtttaccgggtacgggggtacccggtaaaccgggggttaaccccgttacggggttacccctaccccggttacccgttaccccgttacccggtaacccgtacccccgttaaccccgaaaccccgggtaaacccggggggtacccccttaacccgggtttcccccggggtttcccccctttccccccccgggttccggggttccccccgtccccccggttaccggtcccccgtaaccccgggtaaccggggtaaccccgg

SEQ ID NO: 253290 - DNA, 940 bp, Homo sapiens
  misc_feature: GYAE6OF01DDC06.21.53.E09.1.454.CMB.1.raw
tcagtcgtcgctcgcacgaccggtgctcgatttagagagagtgtgttggtttggtttccttgttgctattataaaaggtgtccagtgtcaggtgcagttggtggagtcgtgggggaggcttggtcaagcccgtggacgggtccctggagactcctcctgtgcgacgtccctcgtggacttccaccttcagtcgaacctacgtacagtcgggctaggactcccgccgaagggcctaccggaagggggaacgggggcttaggggaggttcgggtcctaactaagttaagttagttaacggtaaggttaggtagggtacgttacccgtaattaccgtacgcacgactgtggtaggacgggccattccacagtccgcgaaggaccaaccgaccaaagacctacaacgtagtactcgtagacaagacgtaagtaactaacggtccctagggaaaccgacggacccgggtaaaggcccggttaccgggtacccgttagtttaaaccgtttacggaggttaggaccggtaaaggtaaccggtaccgtaccccgggacgtaagtcggggtaacgtcggggaaccgggtacgggtacggttaaccgggttaaccgtttaaccgtttacgggttaaccggttaccgggtaaccggggtacccgggtaaacccgggtaaccccggttaccgggttaccccggtaacccccgggtttccccttaacccggttacccgtaaccccggttacccccgtaaccccggtaacccccggtaaaccccggggtcccccttaacccggggtttccccccgttaaccccccgggtttccccccggtaccccgggtccccccggttccccgttaccccgggtaccccggttaacccccggaccggggttaaccccgacccccgttaacccccgggtaacccccggtaagggtaaaccccgg

SEQ ID NO: 253291 - DNA, 660 bp, Homo sapiens
  misc_feature: GYAE6OF01BYZN6.21.53.E09.1.454.CMB.1.raw
  modified_base (283)..(283): a, c, t, g, unknown or other
  misc_feature (283)..(283): n is a, c, g, or t
  modified_base (329)..(329): a, c, t, g, unknown or other
  misc_feature (329)..(329): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccgaggggaagggctggagtgggtctcatatattagtagtagtggtacgtccgtatactacgcagactctgngaacggcgattcaccagtcgaccgaggacaaccgacaaagactcanagtactcgtgacagaatgaaatacgtcctaggaagtagaccgtaggaccgtcggccgtagttacttctaggtgccggaaggaacgccggtacccgggcggtagtacggaagtcgggaccggtacggtcgttacggttactttaacgtttggtaacgtttacggtcggggtacccgaaggggtaaccccgtgggttaccacccggttctcccgtacgactcccgtacccaccgaaccgggccctagttcccggttccccgttcccggcggttcccgcccggtcgccgtacccggacggacccgtaccgacccgtcgggaaccgtcgaacccg

SEQ ID NO: 253292 - DNA, 748 bp, Homo sapiens
  misc_feature: GYAE6OF01B1VS0.21.53.E09.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtggggggaggcttggtcaagcctggagggtccctgagactctcctgtgcagcctccggattccaccttcagtgactactacatgggctggatcccgcaggctaccgaggggaagggctggagtggtctnatatattagtagtagtggtacgtccgtatacctacgcagactcgtgtagaacggcctattccaccactccggacagggaccaacgccaacgaacctcacagtatcgtgctaagatagaactacgctagagacgccgagaccgtcggaccgtagtagttacgtgtcgacgtagaccgacgtacccggacgtacgtaggaggtcgggacggtacgggtaccgttacggttaaccgtttaacgtttacggtaacgtttacgggtaccgggggtacccggtaaaccgggtaacccggttcgggtacccttacccggttccgttacccgtccgtacccgtaccccgtaacccggacccgaaaccggggtacccctaaccggttcccccgggtttaccccgttcccccgggttcccgggtaccccggtccccgttcccgggtaccccgttacccggtaaccgggtacccggaccgtaaacccccgttacccgaaccgggtaccggaaccccgg

SEQ ID NO: 253293 - DNA, 731 bp, Homo sapiens
  misc_feature: GYAE6OF01DPRJQ.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtggagtctggggggaggcttggtcaagcctgggagggtccctgagactctcctgtgcagcctctggattcaccttcagtgactactacatgggctggatcccgccaggcctccgaggggagggctggaggtgggtctcatatattaggtagtaggtggtagtcccgtatacctacgcagactcgtggtggaacgggccgactttccaccagtccggccgaggggaaccaaccgaccaaacgaacctccacagtatcagcagaatgaaatcgcctagagagccggaaggcgtccgggtcgtagttacttcgtgtcggacgaggtaacgacggtcccgggacgtagtacggtaggtcgggaccgtaccgggtcgttaccgggtttaacgtttaccgttttacgtacggttttaacccgggtcgggggtaccccgggtaaccgggtaaccccgggtttcgggttacccctaaccccggtttccgtaccccgttccgacccgttaccccctaccccgaacccggaacccggtccccgtaccggttccccggttacccccgtttccccccgtacgggtcccccgttaccccgtccgtcccgtcccggaccgggtaaccccgg

SEQ ID NO: 253294 - DNA, 634 bp, Homo sapiens
  misc_feature: GYAE6OF01ATOLF.21.53.E09.1.454.CMB.1.raw
  modified_base (386)..(386): a, c, t, g, unknown or other
  misc_feature (386)..(386): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgaggggaaggggctgggagtgggtctcgatatattagtagtagtggtagtcccgtatactacgcagactctgtgaaggccatcaccatcgcaggacacgccaagactacacagtatctgactagatagaatacgcctgaagacgccgaaggactcggccgtgtaactttacgngtcgacggagacgacgtcccgggcgatggagtacgggcggacggacgttaggtaactttacgtttagtacgttaccggtggggaccaacgggaacccgttcggtaccgtacccgtcctaccctccgtaccgaccctacccgaacccgaacgggtcccctacgtacccggttcccgttaccccccgtcgggcccgtccccgtcgcccgttacccgacgggacgacccaccccggtcccggaaggtaccg

SEQ ID NO: 253295 - DNA, 676 bp, Homo sapiens
  misc_feature: GYAE6OF01EYSM6.21.53.E09.1.454.CMB.1.raw
  modified_base (350)..(350): a, c, t, g, unknown or other
  misc_feature (350)..(350): n is a, c, g, or t
  modified_base (455)..(455): a, c, t, g, unknown or other
  misc_feature (455)..(455): n is a, c, g, or t
  modified_base (625)..(625): a, c, t, g, unknown or other
  misc_feature (625)..(625): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattccaccttcagtgactactacatgggctggactccgccaggctccgaggggagggctggagtggtctcattatattagtagtagtggtacgtcccgtataccgtacgcagtctctggtggaagggcctattccaccatccgaccgagggacaaccgaccaagacctacactagtactcngcaagtatacgaatacgcccgtaggaggacgccggaacggaccgtccgggtcgttagttaacttacgtggtacgacgaggacgtcgtacccgggacgtagtaggnggttcgggaccggtacggtcgttacggttaccttacgtttaggtaccgtttacgggccggggtaacccgtacgggtacccgtcgggtaccctaccgtcctacccgtcaccgccctacccgaccgtaaccggccctacgttcccggttcccttcccccggtcggtaccccncccgtcgcccgtaccggacgcccgaccctacccgtaccggacgccgacccg

SEQ ID NO: 253296 - DNA, 674 bp, Homo sapiens
  misc_feature: GYAE6OF01A74MQ.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctggagactctcctgtgcagcctccggattcaccttcagtgactactacagtgggctggatccgccaggctccgaggggagggctggagtgggtctcatatattagtagtagtggtacgtcccgtatactacgcagactctggtggaacgggccgattcaccctatccgaccgaggggaccaaccgccaaaagaacctcacgtagtatctagcagatagaatcgcctagacgacgccggagaccgtcgggccgttagttacttacgtggtcgacgtagacgcgtcccggacgagtgagtcggacggacggcgttaggtaccgtttacgtttagtacgttacggtcgggaccgaaccgggtaacccgtcgggtcctaccgttccgtcccgtacgtaccgccctacccgacccgaaccgggcccctacgttccccggttacccgttccccccgtcgggtaccccgtccccgttccggccgtacccggaaccgggtaccgtaccctaccccggtaccggtacggaaccgtacccg

SEQ ID NO: 253297 - DNA, 818 bp, Homo sapiens
  misc_feature: GYAE6OF01CINM3.21.53.E09.1.454.CMB.1.raw
  modified_base (177)..(177): a, c, t, g, unknown or other
  misc_feature (177)..(177): n is a, c, g, or t
  modified_base (250)..(250): a, c, t, g, unknown or other
  misc_feature (250)..(250): n is a, c, g, or t
tcagtcgtcgctcgcacgaccggtgctcgatttagagagagtgtgttgggtttgggctgagctgggttttccttgttgctattaataaaaggtgtccagtgtcaggtgcagttggtggagtcgtgggggagcttggtcaagccgtggagggtccctgagactctcctgtgcagcctntgattcaccttcagtgactactacagtgggctggactccgcgaggctcgaggggaagggctggagtggtctanatatattaggagtaggttggtacgtcccgtaatacgtacgcaagactctaggtacgaacgggcctaattccgaacctagtaccggaccgaaagggaaccaaaccggaccaaaacgtaacctaccgaacgaagttatcctgactaaagataagaaatacgaccgtaggaacggacgaccgggaaggccgtaccgggttacgttatttaacgttacgttaggtaggacggtaagacggtaacccgttcccgggaagtaaggtacggtaggtacggggtaccggaacgggtacgtttacgggttaaacctttacgttttaacggtaacgtttaacccgggtaccggggtaccggtaaaacccggggttaaccccgttacgggttacccgtaaccccgtttccgtaaccccgttaccgaacccgttccccgttaacccccgaaaccccgggtaaaccggggtaccccccttaaccgggttacccccgggtttaccccccgtttacccccggtaccggggtcccccggtaccccgttaccggtaccccgtaacccgggaacggtaaacccccg

SEQ ID NO: 253298 - DNA, 732 bp, Homo sapiens
  misc_feature: GYAE6OF01BEXBL.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtggagtctgggggagcttggtcaagcctggagggtccctgagactctcctgtgcagcctctggatcaccttcagtgacctactacatggctggactcccgccgaggcctaccgaggggaacggggctcggagtcgggtctcattagtattagtagtagtggtacgtcccgtatacgtacgcagactctggtacggaaggcccgtatttccgacccagtccgaccgaaggggaaccaaccggacctaaagaaccttccaaccgagttaactcgtacgccaagtagtagaaatacgcccgtaggaagtacgaccggaggtaccgtccgggtaccgttgtaattaccgtggtagacggagtacggaactcccgggtacgtaacgtagagggtcgggtcccggaacggtccgttaaggttaccctttacgtttcggttaacgttaccggggtaccgggcccggtaaccgggtaccccggttcggtacccgtaaccccggttcctacccgtcccgaaccgtccccgtacccccgaacccggacccggtacccgtacgttccccgggttcccccttaccccccggtggccccctacccggtccgcccgttccggacggtacccg

SEQ ID NO: 253299 - DNA, 871 bp, Homo sapiens
  misc_feature: GYAE6OF01CXAGV.21.53.E09.1.454.CMB.1.raw
  modified_base (235)..(235): a, c, t, g, unknown or other
  misc_feature (235)..(235): n is a, c, g, or t
tcagtcgtcgctcgcacgaccggtgctcgatttagagagagtgtgttgggtttgggtttccttgttgctattataaaaggtgtccagtgtcaggtgcagttggtggagtctgggggagcttggtcaagcctggagggtccctgagactctcctgtgcagcctctggtacttcaccttcagtgactactacagtggctggactccgcaggctccgagggagggctggagtggtctnatatagttagtagtagtggtacgtccgtatacgtacgcagtacttcgtaggtaggaacgggcgtacttaccgacctacgttccggaccgaagggaacccaaccggaccgtaaacggtaaccttacaaccggtagttaaccgttcgtacgtaccgtaagtacgttagaaacgtacgtaccgtaaggacggtaacgtcccgggtaaggaccggttaccgggtccgttttacggttacgtttaccggttacggtacggaccggtaacgggtaaccggtaccggttaccccggggtagtaacgggttcggaacggttccggggaccgggtaaaccggttcgttacggggttaaaccttttacggtttacggaacgttttaccggggtacccggggtaccgttaaacccggggttacccgttccgggttaaccgtaccccggtttaccccgttaacccgttacccgacccgggttaacccccttacccggaaacccgggtaaccggtcccccgtttaacggggtttcccccggttacccccctttccccggggacccggttccccgtcccccggttacggtacccccgttacgggaacccgttacccggaccccgttacccggtaacccgaacgggtcccg

SEQ ID NO: 253300 - DNA, 799 bp, Homo sapiens
  misc_feature: GYAE6OF01C72IN.21.53.E09.1.454.CMB.1.raw
  modified_base (538)..(538): a, c, t, g, unknown or other
  misc_feature (538)..(538): n is a, c, g, or t
  modified_base (777)..(777): a, c, t, g, unknown or other
  misc_feature (777)..(777): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtcgtgggggagtcttggtcaaggcctgggacgggtccctgacgtacctctcctgtgcacgtcctcgtggtattccacctttcagtcgactactacagtcgggctaggactcccgccaggcctaccggaggggaacggggtctgggagttcgggtccttagtatttagttaagttaaggtaacgttaggttcggtaacgtaccccggttaataccgttaaccggctaacggtaccttaccttaggtacgggtaacgggggtccctaacttttaccgaacccttaagtcccgggaccccgaaacggggaaccaaccggaacccgaaaacgtaaccctaccgaacctaggttacttccggtagtccaaggtaataacggtaatacggtaccgtggacggtaaccgcccgggaaacgggtccnccgggttaccgttaggttacttacggtcggttacgaccggtaagacggtaccgtcccgggtacgtaagttcgggtaacgtcgggtaccggtacggtcgtacgggtttaacttacgtttacggtacgtttaccgggtcggggtaccgaccggggtaaccgttccggtaccgtacccgtcgtcctacgccgtacccgaccgacgtacggcccgtacgttcccgtcccttccccgcggtccncccgtcgccctcgtcggacccg

SEQ ID NO: 253301 - DNA, 730 bp, Homo sapiens
  misc_feature: GYAE6OF01BBFLR.21.53.E09.1.454.CMB.1.raw
  modified_base (211)..(211): a, c, t, g, unknown or other
  misc_feature (211)..(211): n is a, c, g, or t
  modified_base (341)..(341): a, c, t, g, unknown or other
  misc_feature (341)..(341): n is a, c, g, or t
tcagtcgtcgctcgcacgaccggtgctcgatttagagagagtgtgttgggtttgggttttccttgttgctattataaaaggtgtccagtgtcgaggtgcaggttggtggagtctgggggaggcttggtcaagcctggagggtccctgacgactctcctgtagcagcctctggattcacctttcagtgacgtactacagtgggctggatccncaggctcgaggagggctggagtgggtctcagtatattagagtagtggtacgtccgtatactacgcagactgtgtgaacggcctagttcaccagtcgcgtaggactaacgccaagaactcacagtactcgngacagatgaactacgaccttggaacgtacggccgtaggaccgttcggcccgttgtaaccttttacgtcggtacggaccggaaggtacgtacgttaccccgggaggtaacgtacggtaagttacggggacggtaaccgggtcgttaacgggttaccgtttacggtttacggtaacgtttaccggtcggggtacccgtaacgggtacccgtttcgggtaaccgtaccccgtaccgttacccgtacgtacgtaccccgttaccgaacccggtaacggacccttacggttaccccggttaccccgttcccccggttggacccccggtcccgtacggtacccgtaccggtaacggaccgtacccgtaacccgttaacccgggcgtaaacccggg

SEQ ID NO: 253302 - DNA, 736 bp, Homo sapiens
  misc_feature: GYAE6OF01ES7MJ.21.53.E09.1.454.CMB.1.raw
  modified_base (408)..(408): a, c, t, g, unknown or other
  misc_feature (408)..(408): n is a, c, g, or t
tcagtcgtcgctcgcacgaccggtgctcgatttagagagagtgtgttgggtttgggttttccttgttgctattataaaggtgtccagtgtcaggtgcagttggtggagtctggggggaggctttggtcaagcctgggacgggtccctgagacctctcctgtgcagcctctggacttccaccttcagtgactactacatgggcctggactcccgcaggctccggaggggacgggctgggagtgggtctacagttattagttaggtagttagtgggttactcccgtatacctagcagtactctgtgaaggcattcacatcgcagggacaacgcaagacctcacagtatctaggcagtatagaatacgccgtaggagagccgaggacctcggtaccgtgtattacctggtncggagagacgtccgacgaatgagtcggacggacggtctacggttacttacgtttacgagtttaccgggtacgggtaccccggtaacgggtaacccgttacggtcccgtaacccggtttcccttaaccgtcctaacccgggtaccccttacccggaacccgaaaccgggggttcccctacgggttaccccccgggttttcccccttcccccgggttcccggggtaccccccgttcccccgggttacggcccccggttaaaacccccggttacggggaccccgaaccccgtttaaaccccccgggttaccgggaaccggtaaaccccggg

SEQ ID NO: 253303 - DNA, 834 bp, Homo sapiens
  misc_feature: GYAE6OF01CTZHR.21.53.E09.1.454.CMB.1.raw
  modified_base (182)..(182): a, c, t, g, unknown or other
  misc_feature (182)..(182): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggagcttggtcaagcctggagggtccctgagactctcctgtgcagccctcggattccaccttcagtnactactacagtgggctggactccgccaggcctccgaaggggacgggctaggagtgggtctacattactagttagtagtaggtggtacgtccgtatactacgcagtacttcgtaggtaggaacgggtccattaccaacccgatccggaccgaggggtaaccaacggccaaagacctacaacgtagttaactcgtagactaggtatacggaacttacggccgttaggaacggtaccggcccggtaaggtacccgttccgggaccggtttagttaacgtttacgtaggtcgaccggtaagtaccgtaccgtccccgggagtaacgttaggaacgggttcgggaacccggtaggtaccgtttaggttacctttagtttacggtaacgtttccggaccggggtacccgtaaccgggtacccgttggttaaccccggaccccgtttaccgtacccgaccgtccgtacccccgtaacccggtaacgggaaacccccgggtcccgttacccggtttaccccgggttcccccctttaccccccggggtacgggtaccccccgtcccccggttacggtacccccggttaaacccgggtaccggggtaccgttaaccccccgtaccccgggtaacccggttacgaacccggggttaaaccccc

SEQ ID NO: 253304 - DNA, 1199 bp, Homo sapiens
  misc_feature: GYAE6OF01B418E.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtgggagtcggtgggggaggtcgttggtacaagtccgtggggaccgggttccctaggacgtaccttccttccgttggtcgacgacgtcccttcgtaggtactttacccttacctttacgtaggttacgtaaccttaaccgttaacgtagggttcggggtcgttacgggtaaccgttccccggaccggacgggtcccgtaccggggaaagggggggaacgggggtcggtaggggtacggggttcggggttcctacgttaagttaagtttaaggttttaaggttaagggttaggttacggggtttaacccggtttaccccgtttaaacgttaacccgttaccggaccgtaacggttaacccgtttcggttacggggttaacgggggaacccgggggtacccgttaaccgttttaccccgaaacccgttaacggttcccccggaaccccggggaaaccgggggaaaacccgaaacccggaacccgaaaaacggttaaccctaaccgtaaaccgtaacgtttaaccgttcggttacggaaccgtaaaggttaaacgttaaacggtaaacggttaccggtacccggttaagggaaacggggtaaccccggggacccgggtaaaccgggtcccggggtttacccggggttacccggtttaaggttttaaccgtttacggtgggttaccgggaacgggtaaacgggaccgttaacccccgggtaccccggggaattaacgggttacggtacgggtcccggggtaacccggggtaacccggtttacggtttaaccggtttttaaacccgtttttacgggttttaaacgggttaacccgggtttaacccggggggcccggggtaaaccccggttaaaccccgggggttacccccgtttacgggttacccccgttaccccggtttccccgttcccggaaacccgttccccgggtaacccccaaccccgggaaacccggggtaccccggtttacccccttcccgggggtttttccccccggtttccccccccgttacccccggggaccgggtccccccgtttaccccggttaccggccccccggttaaacgggcggg

SEQ ID NO: 253305 - DNA, 996 bp, Homo sapiens
  misc_feature: GYAE6OF01E5HWX.21.53.E09.1.454.CMB.1.raw
  modified_base (987)..(987): a, c, t, g, unknown or other
  misc_feature (987)..(987): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtgggggaggcttggtcaagccctggacgggtccctgacgactctcctgtgcagcctgtggacttccaccgttcagtcgaccttactacgagtcgggctacggactcccggaccgacgggtccgtacccgggaagggggaacgggggtccgtaggggtacggttcgggttacctacgtaattaagtttaaggttttaaggttaacgggttaacgggtttaccgggttaaccggttacccccgtttaaacgtaacccgttaaccgggcctaaacggttacccgtttacggttaggggtaacgggaaacccgggggtaccctaaaccgttacccgaaccccgtacgttaaccccggacccgggtaaaccggaaacccgaaacccgaaaccgtaaaccgtaaccttaccgaacggtaaacctttagtaccgtacgaacgttaaacggagttaacggtaaacgttacccggtacggtaacggaaaccgggtacccgggtacccgggttaacccggggtacccgtcccgggttaaccgttttacggtaaccttttacggccgggacgaaccggggttaacgacggtaccccggtacccggggtaagtacgtaggtaacccgggttccgggaaccggttccgggttaacgtttaaccggtttaaccgttacgggttttaacgtacccgggtttaccgggcccgggtaaccccgggttaccgtaacccggttcccgtacccgtaaccccgtccgtaacccgtaccgacccgttaccccgacccgtaacccggtaccgttaccccgtcgtacccccgttccggtccccgtacggccccgtcccgtacgaccccgtacgtacggacccgaccctacccggaccgnggtacccgg

SEQ ID NO: 253306 - DNA, 765 bp, Homo sapiens
  misc_feature: GYAE6OF01D8TK0.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcacctttcagtgactactacatgggctggatccgccaggctccgagggaaggggctgggagtgggtctcatatattagtagtagtggtagtcccgtatactacgcagactcgtgtgaaggaccgattccaccagtccgcagggacaacgccaaagactcaacagtaactctgacagtactagaatacgcctaggaaggacgtaccggaggtacctccgggtaccggtagttacgtttacgtggttggaccggaaggacgtaccgtacccgggccgtaagtacggacggttagggccggtaaccggggtcttacggggttaaccttttacggtttacggttaacgtttacccgggttacggggggacccccgtaaacggggggtaacccccgttacgggggtttccctaaccccggttaccccgttcccttcccgtaaccggtacccccgtttaaccccgaaaccccggtaaccccggggaccccgtaaccgtttccccgggttaccccgtttaccccccccgggtccggggtccccggcccccgtttcccgggtaaccccttccccggaaaggggttcccccgg

SEQ ID NO: 253307 - DNA, 723 bp, Homo sapiens
  misc_feature: GYAE6OF01CV1TC.21.53.E09.1.454.CMB.1.raw
  modified_base (669)..(669): a, c, t, g, unknown or other
  misc_feature (669)..(669): n is a, c, g, or t
  modified_base (711)..(711): a, c, t, g, unknown or other
  misc_feature (711)..(711): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtggggggaggcttggtcaagccgtgggagggtccctggagactctcctgtgcacgcctctggattccaccttcagtgactactacagtgggctggactcccgccgaggcctccggaaggggaacggggctaggggaggttcgggtctcattatagttagtagtaggtggtacgtcccgtaatactacgcagactcgtggtaggaagggcctattcaccatccgacgaagggaacaacgccaaagaactcaactagtactcagacagaatagaaatacggacctagggacgacggtccggaacgggaccgtccgggaccggttataacgtttacgtggtaggacgaaggacgaccggtcccggagtagtacggaggtacgggacgggaaccgggtcggttacggttaaccgtttacggtttacggttaacgttacggggtaccggggtaccggaaaccggggtaacccgttcgggtaaccctacccggtcctaccctaccgacgtccccaccgaaccggaccgggaccctaccggttcccggtaccccgttccccggnggccccgtccctcggcccaccggtacggacgccccgtaaccncccggagacccg

SEQ ID NO: 253308 - DNA, 920 bp, Homo sapiens
  misc_feature: GYAE6OF01ATHU5.21.53.E09.1.454.CMB.1.raw
  modified_base (208)..(208): a, c, t, g, unknown or other
  misc_feature (208)..(208): n is a, c, g, or t
  modified_base (400)..(400): a, c, t, g, unknown or other
  misc_feature (400)..(400): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtcgtggggggaggcttggtcaagcctgggagggtccctgagactctcctgtgcagcctctggtattccaccttcgagtcgactactacngtgggtcgtgggactccgccgagtccgtaccggaggggaacgggcgtggaggttcgggtctactatagtttagttaggaggtaggtaggtacgttccgtactactacgcacgacttctggtacggaacgggtcgtacttccaccacgtccgaccggagggacctaaccgaccaaacgtacctacactaagtntactagacagtaatacgaaacgtcgacgtggaacggacggccggtacggtacccggttacggtaccgttaagttacctttacggtcggtaggtaccggaacggtaccggtacccgggtacccgggtacggtaaagttcggggaacggttacggggtacccgggtaagggttacccggtttaaccggtttaaccggttttaacgtttttaccgggtaaaacgggttttccggggaacccgggggggttaacccgggtaaaccgggttaaccccccgggtttaggggtaaccccgtttccccgtacccgggtttaccccctaccggtaaaccccgttccccccgggaaaaccccccggtacccggggtttaaacccggggaccccccgggtttacccctttcccccgggggtttaccccccccggttaccccccccgggttacccggggccccccggtttaaaccccccggttggtttaaccccccgggggttacccctaacggggggttaaaaccccccgg

SEQ ID NO: 253309 - DNA, 732 bp, Homo sapiens
  misc_feature: GYAE6OF01EZ33H.21.53.E09.1.454.CMB.1.raw
tcagtcgtcgctcgcacgaccggtgctcgatttagagagagtgtgttgggtttgggctgagctgggtttccttgttgctattataaaaggtgtccagtgtcaggtgcaggttggtggagtctgggggaggtcttggtcaagcctgggacgggtccctgagactctcctgtcgcagcctctggtattctaccttcagtgactactacgagtcgggctggactccgccaggctccggaggggaaggggtctgggagtggtctcatagtattagtagtaggtggtacgttcccgtaataccgtacgcacgtactcgtggtaggaacgggtccgattccaccgagtccgtaccggaacgggaccgaacgaccaaagtaacctacacagttaacgtcgtgacgaagagtacgaaatacggcgtacggaggtaacgaccggagtaccgtcggtaccgtagttacgttacgtggtggacgaggaacgtcggtaccggagtacgtaggtacgtacgggccggtacgtaccgtacgtttacgtttacgttgtaacgttcggtaccggggaaccgttaaccggggtaccgttaccggtccgttaacccgtcccgttcctaccggtaccgtaccccgtacccgaaccgggtaacccgggtcccgtaaccggtttcccggttccccccgttccccggacccggtcccgtccccggtaccgtacccgtccggtaccgggaccccg

SEQ ID NO: 253310 - DNA, 656 bp, Homo sapiens
  misc_feature: GYAE6OF01BNRB5.21.53.E09.1.454.CMB.1.raw
  modified_base (242)..(242): a, c, t, g, unknown or other
  misc_feature (242)..(242): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattcaccttcagtgactactacagtgggctggactccgccaggctccgaggggaagggctgggagtgggtctnatatattagtagtagtggtactcccgtatactacncagactntgtgaaggccgattcaccatcgcagggacaacgccaagacncacagtatcngacagatgaatgccgtagaggagcccggaggaccgtccgggccgtagtacgttacgtggcggacgtaggaacgacgtccccgggagagtagagtggcggacgtcgtacggttactacggtttacagttacggtcgggacgtaacgggtacccgtcggtacccgtccgttcctccgtacgtaccgtacccgtacccgaccgtaaccgggtccctacggttcccgggtaccctttacccccggtcgggtccccgtacccggtccggtcccgtacccggtaccgggaccgtacccggtacccctaccggaccggtacgacccgg

SEQ ID NO: 253311 - DNA, 673 bp, Homo sapiens
  misc_feature: GYAE6OF01BSN7P.21.53.E09.1.454.CMB.1.raw
  modified_base (592)..(592): a, c, t, g, unknown or other
  misc_feature (592)..(592): n is a, c, g, or t
  modified_base (656)..(656): a, c, t, g, unknown or other
  misc_feature (656)..(656): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtggggggaggcttggtcaagcctggagggtccctgagactctcctgtgcagcctctggtacttcctaccttcagtgactactacagtgggctggactccgccacggcctaccggagggggaaggggctgggtaggtcgggtctcgtattatagttagtagtaggtcggtacgtcccgtataccgtacgcacgactcgtggtaggaagggtccgtattaccaccgtacgtcccggaccgaacgggaaccgtaaaccgaccaaaacggtaacctaccgaactacgttactcgtacgagaacgtagtagaaatccgacgtagagacgacggtacgaccggtcggcgttacgtacttacgtgcgtagacggtacgtaccgtacggacgtagtacggtagtcgggacgtaacggtctcggttacttacgttgtaacgtcgggtacgggcgaacggtaccgtcgtacctccgtctcctcgactccnccgaccgcggacctccgtccgtcccgttcccgcgccggtcccgcgtccgaccgtaggccacccnccggtccgaggtacccg

SEQ ID NO: 253312 - DNA, 638 bp, Homo sapiens
  misc_feature: GYAE6OF01D3AWL.21.53.E09.1.454.CMB.1.raw
  modified_base (304)..(304): a, c, t, g, unknown or other
  misc_feature (304)..(304): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtggggggaggcttggtcaagcctggagggtccctgagactctcctgtgcagccctccggattcacctttagtgactactacatgggctggatccgccaggctccgaggggaaggggctggagtgggtctcatatattagtagtagtggtacgtcccgtatactacgcagactctgtgaaggccgattcaccntcgccagggacaacgccaagaactcacagtatctgcagatagaatagcctgagacgcgaggactcggccgttgtacttacgtgtgacgagagtacgtcccgggagagtgagtcggggccgtacgggcgttagggttaacctttacgttttggactttaccgggtcgggggacccgaacggggtaaccccttgggtaccctcccgttcctccctccgtacgtcccctacccgaaccgaccgggccctacgttcccgtcccttcccccgtcggccccgtcccgtcgcccgtacccgacggaccgtcctaccccgtaccggacgaccggcaacccgg

SEQ ID NO: 253313 - DNA, 768 bp, Homo sapiens
  misc_feature: GYAE6OF01D7J0J.21.53.E09.1.454.CMB.1.raw
  modified_base (575)..(575): a, c, t, g, unknown or other
  misc_feature (575)..(575): n is a, c, g, or t
tcagtcgtcgctcgcacgaccggtgctcgatttagagagagtgtgttgggtttgggttttccttgttgctattataaaaggtgtccagtgtcaggtgcaggttggtggagtcgtggggggaggcttggtcaagccgtgggaggggtccctggacgactcttccgtgtgcacgcctcgtggtacttcctaccttcaggtcgaccttactactagtgggtcgtcggactcccggccgtaagggcctaccgggaagggggtaagggggcgttgggggtaggttcgggtcctagtaattaagttaagttaggttaaggttaggtacgggttaaccggttacccgttaacttaacgtaccgacgacgtaaccttcgtaggtacggaacgggtccgttactaccgacctcgtacccggaccgaacgggaccgaaccgaccgaaacgtacctacacgtaagtactcgtacgacgaagcgtaagtaacgtacgtaccgtaggaggtaccgggaccgtacgggtaccgttccgggacgtttacgttagtttaccgtggtcggacgagtacgcggtaccggtagngtacggtagcgggcggtacgtcggttacgttacgttcgttacgttagttacggtccgggtaccggaccggtaccgtacgtaccgtccgtaccgtccacgtaccgcctaccgaccgtccgtaccctacggtcccttcccgtccggtaccgcccgtccaccgtcgtaccggacgcctaccgccgtcgacgaccgg

SEQ ID NO: 253314 - DNA, 989 bp, Homo sapiens
  misc_feature: GYAE6OF01CHNRA.21.53.E09.1.454.CMB.1.raw
tcagtcgtcgctcgcacgaccggtgctcgatttagagagagtgtgttgggtttgggtttccttgttgctattaataaaaggtgtccagtgtcaggtgcagttggtggagtcgtggggggaggtcttggtcaaggccgtgggacgggtccctggagactctcctgtcgcagtcctcgtggacttccaccttcgagtcgtaactactacagtgggctggactccggaccgaggccgtacggaaggggacgggtcgtagggtacggttcggtacctagtaattagttaagtttaaggttaggtacggttacgggttaccgttaccccgttaagtaaccgtaccgacgtaacgtaccgttcgttaggtaacggaacgggggtcccttaattccccgaaccgtagtcccggaaccggtaacggaaccgaaacccgacccgaaaacgtaacctcaacgttaaggtacttcggacgaacgtaagaacgtagaaacgtacgcgtaggaaacgtccggaaccggtaacggtaccgttcgggttaacccgttagttaaccgtttagtacgggtacggtaaccggttaacgggaccggtaaccgggtaccccggggtacggtaacgggttaacggtacgggttacggggaacccggtaccgggttacgggttaccgggttttaaacccgttttacggttttaacgggtaccggttttaaccggggacccggggttaaccgggtaacccgggtaacccggttaccggttaccccgtacccgttacccgttaccccgtaccggtacccgtaccccgaaccccgggtaacccgggtaacccggtaaccccgttaccccgggtttccccgggttacccccccggtttaacccccgggtcccgggtccccccgttaccccgggaccccggttaccccgggttaaccccgggacggtacccccggtaaccccggtaacccccggacgggaacccggtaaccccggg

SEQ ID NO: 253315 - DNA, 682 bp, Homo sapiens
  misc_feature: GYAE6OF01DYF7C.21.53.E09.1.454.CMB.1.raw
  modified_base (269)..(269): a, c, t, g, unknown or other
  misc_feature (269)..(269): n is a, c, g, or t
  modified_base (529)..(529): a, c, t, g, unknown or other
  misc_feature (529)..(529): n is a, c, g, or t
  modified_base (659)..(659): a, c, t, g, unknown or other
  misc_feature (659)..(659): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtggggggaggcttggtcaagcctggagggtccctgagactctcctgtgcagccctccggtattccaccctttcagtgactactacagtgggctggactcccgcaggcctccggaggggagggctggaggtcgggtcgcgtatacgaaggaagctaanagttacagtacagaagtacggcgcgttcgtagtaaggaaaggtacgttccacctatctacgaaagagtagtagaattaacgaaaacgtactactacgtagttactacgtagaactaaagtacaaacgacgaaccgtaacggaaaaacggacggtaaccgacggtcgttagttaacgtttagttacggtaaggtaaagaaacgtaaaaggtggttaggaggtttggtacgggttaggtagtcgttaggtacactagtagtntcgtcttagtagtacgttaggtcgggacgggcggtaacggtaatacgtcggtacccgtacgttctcgtacgacctcccgaccaccggaccggtcctaccggtcccgttccctccggaccgccctcccgtncccgtacgacgcgcccgtaccgg

SEQ ID NO: 253316 - DNA, 796 bp, Homo sapiens
  misc_feature: GYAE6OF01A5HZK.21.53.E09.1.454.CMB.1.raw
  modified_base (237)..(237): a, c, t, g, unknown or other
  misc_feature (237)..(237): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtgggggaggcttggtcaagcctggagggtcctgagactctcctgtgcagccgtcgattcaccttcagtgactactacagtgggctggactccgccaggctccgaggggagggctggagtggtctnatatattagtagtagtggtacgtccgtatactacgcagacttcgtggtaggaacgggcctattaccaccgtacgtcccgaccggaaacgggggaaccaaaaccggacccgtaaaacggtaaccttaccgaaaccgtaacgttactaccgttacggacgtaaggtaagttaacgtaacgttacggtaccgttaagggaagaccgggaccggttaacggggaacccggttccggggttacgttacgtttaacgtttacggtggtacggaccgggaagacggtaccgtcccggtagtaaggttacggacgttcgggacggtacggtaccgtttacggttaacgtttacgtttacggtaacgtttacgggaccggggtccggtaaccgggtacccgttcggtacccgtaccccggttcctcccgtaccgtaccgtcccctaaccgaacccggtcccgggtaccctaccggttcccgttacccccgttcccggccggtcccgtccctcgtacccgtacccggtacggtaccgacccgttaacccggacgacggtccgaacccgg

SEQ ID NO: 253317 - DNA, 645 bp, Homo sapiens
  misc_feature: GYAE6OF01DB2B1.21.53.E09.1.454.CMB.1.raw
  modified_base (367)..(367): a, c, t, g, unknown or other
  misc_feature (367)..(367): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctggggggaggcttggtcaagcctgggagggtccctgagactctcctgtgcagcctctggattcaccttcagtgactactacagtgggctggactccgccaggctccgaggggaagggctggagtggtctcatatattagtagtagtggtacgtccgtatactacgcagtactctgtacggaagggcctagttcaacctagtccgaccgaagggaccaacgaccaaaagacctacacagtacttcgngcaagatagaatggcctaggacgacggccgagggactccgggcgttagtacttacgtgtcggacgagacgacgtccggagtagtcgagtcgggcggacggtcgttagggttacttacgtttagtaacgtttacggcggggaccgtacggggtaccccttggtccgtacccggtcttcccgtccgaccgtccccgtacccgaaccggaccggtaccctcgttccccggttccccttcccccggacggtcccgtaccctcggaccctcggacggtacccg

SEQ ID NO: 253318 - DNA, 692 bp, Homo sapiens
  misc_feature: GYAE6OF01B0KKL.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggactccgccaggctccgaggggaaggggctggagtgggtctcatatattagtagtagtaggtacgtccgtatactacgcagactcgtgtggaacggccgtaacttccaccactccggaccgaagggaaccaacgaccaaacgaacctaccactaagtactcgtgacaagtatagaatcgccgtagacgacgccggacgaccgtacggcgttagtattacgtggtacgacggagagtaccgtcccggacgtataggacgtcgggacgaacgggtccgttacggttactttacgtttaggtacttacgggtcgggaaccggtaaccgggtaacccgttcgggtaccttaccggttaccttcccgaccgtaccctaccccacccgaacccgggaacccggtacccgtaccgttccccggttcccgttcccccggcggtccccgcccgttcgtaccgtacccgtacggaccgtaccccgaaccgccgtaacggacccg

SEQ ID NO: 253319 - DNA, 736 bp, Homo sapiens
  misc_feature: GYAE6OF01B0IK6.21.53.E09.1.454.CMB.1.raw
  modified_base (193)..(193): a, c, t, g, unknown or other
  misc_feature (193)..(193): n is a, c, g, or t
  modified_base (657)..(657): a, c, t, g, unknown or other
  misc_feature (657)..(657): n is a, c, g, or t
tcagtcgtcgctcgcacgaccggtgctcgatttagagagagtgtgttgggtttgggctgagctgggttttccttgttgctattaataaaaggtgtccagtgtcaggtgcagttggtggagtcgtggggggagcttggtcaagcctgggaggtccctgagactctcctgtgcagcctctggtacttccaccttnagtgactactacagtgggctggactcccgcacggctccggaggggagggctgggaggtgggtctctattatagttaggtagtaggtcggtacgtaccgtatacgtacgacacgtactcgtggtacggaacggtccgtattaccaaccgtagtcccggaccggaacgggaaccaaccggaccaaacgaacctccaacgtacgttaactcgtaggacgagtagttaacggaactacggccgtaaggaacgaccggaccggtacgggtaccgtccgggtaccgttagttacgttacgtcgggtaggacggtaagacggtacccgtacccgggaggtagttcggacggtcgggaccggtaaccggttcggttaacgtttaccggtttacgttacggttacggttacgggttaccggggacccggtaaccgggtacccgttcggtaccctccgttcctccaccgtaccncccgtaccgaccggacccggtcctaccgttcccggttcccttcccggcgccccggtacctcgccgtaccggcgtacccg

SEQ ID NO: 253320 - DNA, 787 bp, Homo sapiens
  misc_feature: GYAE6OF01A0TYX.21.53.E09.1.454.CMB.1.raw
  modified_base (189)..(189): a, c, t, g, unknown or other
  misc_feature (189)..(189): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtggggggaggcttggtcaagccctgggagggtccctgagacctctcctgtgcagcctctggacttccaccttcagtnacctactacagtggcgtggaccgtccgccgtaggcctaccggagggggaacggggtcgtgggacgggtggtctactagttatagtttaaggtagtaggttggtaccggttaccctataccgtacgacgtagacttcgtaggtaggaacggcccgtattccaccgtacgtccggaccggaacgggaaccaaccgtacccaaacgaacctaccaacgtagtactccttgacgaacgtatagaactacgcgtagaggacgcggacggtaccgtcggtacgtagtaacgttcggtcgtcgacggacgtacgtccggacccggtagacgtgtacggtaccgggacggtaccgggtacgtttaacggtaccgttttacgttaggtaccgttaacggggtccgggacccgggtaaccgggtacccggttccggtacccgttaccccggttccctacccgtcgtacccgtacccgtacccggacccggtacccggtaccccgtaccggttcccccgtaccccgttcccccggtacccggacccgtcccctacggtcccctacgggacccgtaccccgcccgtaacccgtccggaacggtaccccgg

SEQ ID NO: 253321 - DNA, 651 bp, Homo sapiens
  misc_feature: GYAE6OF01EGMZQ.21.53.E09.1.454.CMB.1.raw
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
tcagtcgtcgctcgcacgaccggtgctcgatttagagagagtgtgttgggttgggctgagctgggttttccttgttgctattataaaaggtgtccagtgtcaggtgcagttggtggagtcgtgggggagcttggtcaagcctggagggtccctgaagacttctcctgtgcagcctctggattccaccttcagtgacgtactacagtcgggcctggactccgccaggcctacggaagggaaggggctagggagtgggtctcaattatattagtagtagtggtacgtcccgtatacctacgcagctntgtgaaggccgtattcgaccntccgcgagggaccaacgcaagactcacagtacncngcagacgtagaagtagcctaggaacgtcgccgaggtccgtccggtcgtagttattcgtggtcgacgtaagtacggacgttccccgggagtacgtagtacgtcgggtacgacggtcgtacggtttacttaacgtttggaacgtttacgggtcggggaaccccgtaacggggtaacccgtcgggttacccgtacgttcccgtacctcgtaccgccctaacccgaaccgaaccgggaccctacggtcccgttcccgtacccgtcggcccctccgtcgtcctcccgagtccccg

SEQ ID NO: 253322 - DNA, 585 bp, Homo sapiens
  misc_feature: GYAE6OF01BKCBB.21.53.E09.1.454.CMB.1.raw
  modified_base (158)..(158): a, c, t, g, unknown or other
  misc_feature (158)..(158): n is a, c, g, or t
  modified_base (335)..(335): a, c, t, g, unknown or other
  misc_feature (335)..(335): n is a, c, g, or t
  modified_base (388)..(388): a, c, t, g, unknown or other
  misc_feature (388)..(388): n is a, c, g, or t
  modified_base (500)..(500): a, c, t, g, unknown or other
  misc_feature (500)..(500): n is a, c, g, or t
  modified_base (555)..(555): a, c, t, g, unknown or other
  misc_feature (555)..(555): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtncagcctcgtggattcacctttcagtgactactacagtgggctggatcccgcaggctaccgagggaagggctggagtgggtctcaattatacttaggtagtagtggtacgtcccgtatactagcagactctgtgaaggcattcacatcgcagggcacgcaagactcacagtatctagnagatagaatacgcctgacgtaacgcgaaggacgtccggccgttgtacttacgnggtgcgaagagtacgtcccggagtactggacgtggcgaacggtcgtaggtaccttacgtttgacgttacgcgggacacgggtacctcggtacctaccgttctcctacgaccncccgtaccaaaccccgggtgtccctacgtaccgtccctcccgcggcccaccgtcncccgtacgaggacccactacccgcgcgacg

SEQ ID NO: 253323 - DNA, 874 bp, Homo sapiens
  misc_feature: GYAE6OF01C266F.21.53.E09.1.454.CMB.1.raw
  modified_base (113)..(113): a, c, t, g, unknown or other
  misc_feature (113)..(113): n is a, c, g, or t
  modified_base (278)..(278): a, c, t, g, unknown or other
  misc_feature (278)..(278): n is a, c, g, or t
  modified_base (860)..(860): a, c, t, g, unknown or other
  misc_feature (860)..(860): n is a, c, g, or t
tcagtcgtcgctcgcacgaccggtgctcgatttagagagagtgtgttgggtttgggtttccttgttgctattataaaaggtgtccagtgtcaggtgcagttgggtggagtcgnggggggagtcttggtcaagccgtgggacgggtccctggacgctcctcctgtcgacacgtcccgtccggtaattcctaacccttcaaggttacgaaccttaccgtaacaggttcggggctagggtacctcccggccgacgggcctaccggaagggggtaacggggntaggggagttcgggtcctagtaattaattaagtttaggtaggtaggttcgggtaaccgttccctaagttacgtaccgcgtaacgtacctcgtagggtagggaaccgggtacctacttcccaaaccgtacgtcccggaacccgggaacgggaaacccaaaccgaccgaaaactaacgtcccgaaacgttaaggtctaccgtaaggacaaggtaataacggtaattaccggacgtaaggacggtaacggaccgggtaacgacccggtcgggtaccgttagtagttaccggtggtacgacgtaagccggtaaccggtccggagtagtaggtaacggcgggtaccgtggtacggttaaccgttacgtttaactcgggttaaacgtttccgggaaccggggtacccggtaacggtacccggtaccgggttaccctccgttacccgtcctacccgtccgtaaccccctaaccggtacccggtaaccgtcccggttaaccccttccgggttccccgttccccggtccggtaccccggttcccgcccggttaccgtaacccggaccgggtaacccctcggtaccccgacncggtaccgacccgg

SEQ ID NO: 253324 - DNA, 734 bp, Homo sapiens
  misc_feature: GYAE6OF01CRTFD.21.53.E09.1.454.CMB.1.raw
  modified_base (163)..(163): a, c, t, g, unknown or other
  misc_feature (163)..(163): n is a, c, g, or t
  modified_base (190)..(190): a, c, t, g, unknown or other
  misc_feature (190)..(190): n is a, c, g, or t
  modified_base (285)..(285): a, c, t, g, unknown or other
  misc_feature (285)..(285): n is a, c, g, or t
  modified_base (664)..(664): a, c, t, g, unknown or other
  misc_feature (664)..(664): n is a, c, g, or t
  modified_base (725)..(725): a, c, t, g, unknown or other
  misc_feature (725)..(725): n is a, c, g, or t
tcagtcgtcgctcgcacgaccggtgctcgatttagagagagtgtgttgggtttggtttccttgttgctattataaaggtgtccagtgtcaggtgcagttggtggacgtcgtgggggagcttggtacaagcctggacggtccctgagactctctgtgcagcctntggattcgaccttgagtgactacgtanagtggctggaactccgcgacggctccgaggggaggtctgggtagtggttctacattagtattaggtagtagtggtactacccgttatacgtacgngacgtcttcgtaggtggacgggtacctattaccgactaacgtcccgaccggaagggaacctaaaccgggtacccaaaggtaacctccgtaaccgtaagttccttaccggttaaggacccttaaggactaggttaaacgccgtaccgttaaggacggtaccgaccgggtacggtcccggtacggtaccggttagttaaacgttcgtgacggacgtaacggtaccgtacgttccgggatacggtagtcggtacgccggtaggtaccgttcggttaacctttgttaccgtaaacggtttccggacgggcccgtaaacgggtaccccttggtacctacgtcccttaccgccgacccgttccgaccgtaacgcccggttacccncggtacccgttcccgcccgtggccccgtccggtatcccgtacggacgacctcctacccggngtcggaccg

SEQ ID NO: 253325 - DNA, 532 bp, Homo sapiens
  misc_feature: GYAE6OF02H3YDI.21.53.E09.1.454.CMB.1.raw
  modified_base (495)..(495): a, c, t, g, unknown or other
  misc_feature (495)..(495): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaaggggctggagtgggtctcatatattagtagtagtggtagtcccgtatactacgcagactctgtgaagggccgattcaccatcgccagggacaacgccaagaactcacagtatctgcagatgaatagcctgagagccgaggactcggccgtgtattactgtgcgagagatcccggcgatgatggcgacggctgggtactactttgattacgtggggccagggaacctggtcaccgtctcctcacgcctccaccaagggcccatccggtccttccccnggccgccctgcctccgaggacgccacctccgagacgg

SEQ ID NO: 253326 - DNA, 538 bp, Homo sapiens
  misc_feature: GYAE6OF02GLPH7.21.53.E09.1.454.CMB.1.raw
tcagtcgtcgctcgcacgaccggtgctcgatttagagagagtgtgttgggtttgggctgagcgtggtttcgtgtaggctattaataaaaggtgtccagtgtcaggtgcagttggtggagtctgggggaggcttggtcaagcctggagggtccctgagactctcctgtgcagcctctggattcaccttcagtgactactacatgggctggatccgcaggctccgagggaaggggctggagtgggtctcatatattagtagtagtggtagtcccgtatactacgcagactctgtgaagggccgattcaccatcgccagggacaacgccaagaactcacagtatctgcagatgaatagcctgagagccgaggactcggccgtgtattactgtgcgagagatcccggcgatgatggcgacggctggtactactttgattacgtggggccgagggacccgtggtcaccgtctccgtcacgcctccaccgaacgggcccacgtccggtccttccccgtggcccgtcccgtgcctccgagtaccg

SEQ ID NO: 253327 - DNA, 542 bp, Homo sapiens
  misc_feature: GYAE6OF02I5PMG.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccagggaaggggctggagtgggtctcatatattagtagtagtggtagtcccgtatactacgcagactctgtgaaggccgattcaccatcgccagggacaacgccaagaactcacagtatctgcagatgaatagcctgagagccgaggactcggccgtgtattactgtgcgagagatcccggcgatgatggcgacggctggtactactttgattacgtggggccagggaaccctggtccaccgtctcctcacgcctccaccaagggcccatccggtccttcccccgtggccgcccgtcgcctcccgacggacgccaccgtcccgagagaccg

SEQ ID NO: 253328 - DNA, 546 bp, Homo sapiens
  misc_feature: GYAE6OF02H8XYX.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccagggaggggctggagtgggtctcatatattagtagtagtggtagtcccgtatactacgcagactctgtgaagggccgattcaccatcgcaggacaacgccaagaactcacagtatctgcagatgaatagcctgagagccgagactcggccgtgtattactgtgcgagagatcccggcgatgatggcgacggctggtactactttgattactggggccagggaaccctggtacaccgtctccctcacgcctccacaacgggcccagtccggtccttcccccgcggccgccccgtcgccctccgacggacgccgacccgtccggacggacgaccg

SEQ ID NO: 253329 - DNA, 528 bp, Homo sapiens
  misc_feature: GYAE6OF02IDR73.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccagggaaggggctggagtgggtctcatatattagtagtagtggtagtcccgtatactacgcagactctgtgaagggccgattcaccatcgccagggacaaacgccaaagaactcacagtatctgcagatgaatagcctgagagccgagactcggccgtgtattactgtgcgagagatcccggcgatgatggcgacggctggtactactttgattactggggccagggaaccctggtcaccgtctcctcagcctccaccaaagggcccatcggtcttccccctggccgccctgctccaggagcaacctccgagagac

SEQ ID NO: 253330 - DNA, 602 bp, Homo sapiens
  misc_feature: GYAE6OF02HA77V.21.53.E09.1.454.CMB.1.raw
  modified_base (408)..(408): a, c, t, g, unknown or other
  misc_feature (408)..(408): n is a, c, g, or t
tcagtcgtcgctcgcacgaccggtgctcgatttagagagagtgtgttgggtttgggctgagctgggtttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgagggaagggctggagtgggtctcatatattagtagtagtggtagtcccgtatactacgcagactctgtgaagggccattcaccatcgcagggacaacgccaaagactcacagtatctgacagatgaatagcctagagagccgaggacgtcggccgtgtattacgtgtgacgagagacgtcccggngatgatgggcgacgggtctaggtacttacgtttgacttacggtgggaccgaacggggaacccttgggtccacccggttcctccctacgaccgtccctacccgtaacccggaaaccgggtccccaacggttcccgggttcccgttacccccccgtcgggtccccgtccccgttcggcccttacccggacggaccg

SEQ ID NO: 253331 - DNA, 562 bp, Homo sapiens
  misc_feature: GYAE6OF02GT5K2.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccaggggaagggctggagtgggtctcatatattagtagtagtggtagtcccgtatactacgcagactctgtgaagggccgattcaccatcgccagggacaacgccaaagaactcacagtatctgcagatgaatagctgagagccgaggactcggcctgtacttactgtgcgagagagtcccggcgatgagtggcgacggcttggtacttactttgtattacgtcggggccgagggaaccctggtccaccggtcctcctccacgccctccgaaccgtaacgggcccctaacgtccggttcccttcccccgttcggcccgtccctcggacctccgaggtaccg

SEQ ID NO: 253332 - DNA, 544 bp, Homo sapiens
  misc_feature: GYAE6OF02HX5AL.21.53.E09.1.454.CMB.1.raw
  modified_base (350)..(350): a, c, t, g, unknown or other
  misc_feature (350)..(350): n is a, c, g, or t
  modified_base (430)..(430): a, c, t, g, unknown or other
  misc_feature (430)..(430): n is a, c, g, or t
  modified_base (497)..(497): a, c, t, g, unknown or other
  misc_feature (497)..(497): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccagggaagggctggagtgggtctcatatattaagtagtagtggtagtcccgtatactacgcagactctgtgaagggccattcaccatcgccagggacaacgccaagactcacagtatctgcagatgaatagcctgagngccgaggactcggccgtgtattacgtgtgcgagagactccggacgatgatggacgacggctggtactacgttgattacgngggcagggacctggcctaccgtctcctcgacgtcctccgaacgacggcccagtccgtccttccccgnggcccgccctcgcctccgacggccgcctacccgtcgacgacgacccg

SEQ ID NO: 253333 - DNA, 538 bp, Homo sapiens
  misc_feature: GYAE6OF02HEOAD.21.53.E09.1.454.CMB.1.raw
  modified_base (376)..(376): a, c, t, g, unknown or other
  misc_feature (376)..(376): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccagggaagggctggagtgggtctcatatattagtagtagtggtagtcccgtatactacgcagactctgtgaagggccattcaccatcgccagggacaacgccaagaactcacagtatctgcagatgaatagcctgagagccgagactcggccgtgtaacttacngtgcgagagacgtcccggcgatgatggcgacggctggtactacttgattacgtgggccagggaccctggcaccgtcctcctcacgccctccaccgaacgggcccagtccgtccttccccgcggccgccctcgcctccgacggcgccaccgtccgagacgacg

SEQ ID NO: 253334 - DNA, 625 bp, Homo sapiens
  misc_feature: GYAE6OF02JY8DZ.21.53.E09.1.454.CMB.1.raw
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
tcagtcgtcgctcgcacgaccggtgctcgatttagagagagtgtgttgggtttgggtcgtgagctgggtttccttgttgtctattataaaggtagtccagtgtcaggtgcagttggtggagtctgggggaggcttggtcaagcctggagggtccctgagactctcctgtgcagcctctggattcaccttcagtgactactacatgggctggatccgccaggctccaggggaagggctgggagtgggtctcatatattagtagtagtggtagtcccgtatactacgcagactctgtgaaggccgatcaccatcgcaggacacgccaagaactcaacagtanctgcanatagaatagcctaggagacgcccgaaggaccttccggggaccgttgttaagttaccgtgtacggtccggaaggaagaccgtacccgggacgtagtcggaagtcgggacggaccgggctagggtaccttagtttgtaagtttaccggtgggggacccaagggtaaccccgttggtaaccgaccgtctccctacgacgcccttaccaacccggaacgggtccctacgtcccggttcccttcccccgtaggtcccgccccttggacctcccggaggtaaccg

SEQ ID NO: 253335 - DNA, 558 bp, Homo sapiens
  misc_feature: GYAE6OF02G94N0.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaagggctggagtgggtctcatatattagtagtagtggtagtcccgtatactacgcagactctgtgaagggccgattcaccatcgccagggacaacgccaagaactcacagtatctgcagatgaatagcctagagagccgaggactcggccgtgtattactgtgcgagagactccggcgatgatggcgacggctggtacttacgtttgattacgtggggccgagggaacccgtggtcctaccgtcctcctcacgccctaccaccgaacgggcccacgttccggtccgttcccccgtcggcccgtcccgtcgtcctccgacggacgccacccgtccgagacgg

SEQ ID NO: 253336 - DNA, 543 bp, Homo sapiens
  misc_feature: GYAE6OF02FSL2V.21.53.E09.1.454.CMB.1.raw
tcagtcgtcgctcgcacgaccggtgctcgatttagagagagtgtgttgggtttgggctgagcgtgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgaggggaaggggctgggagtgggtctcatatattagtagtagtggtagtcccgtatactacgcagactctgtgaagggccattcaccatcgccagggacaacgccaaagaactcacagtatctgcagatgaatagctgagagccgaggactcggcctgtattactgtgcgagagagtcccggcgatgatgggcgacggctggtactactttgattacgtggggccacgggaaccctggtccaccgtctcctcacgccctccaaccgaacgggcccagtcccgttccttcccccgtggcccgccctcgcctccgaggacg

SEQ ID NO: 253337 - DNA, 548 bp, Homo sapiens
  misc_feature: GYAE6OF02IS4TQ.21.53.E09.1.454.CMB.1.raw
  modified_base (377)..(377): a, c, t, g, unknown or other
  misc_feature (377)..(377): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccagggaagggctggagtgggtctcatatattagtagtagtggtagtcccgtatactacgcagactctgtgaagggccattcaccatcgccagggacaacgccaagaactcacagtatctgcagatgaaatagcctgagagccgaggactcggccgtgtaattacngtgcgagagactcccggcgatgagtcggcgacggcgtaggtactacgtttgtattacgtgggccacgggaccctcggtcaccgtctcctcacgcctaccacgaacgggccacgtcgtccttccccgtcggccgtccctcgcctcgacggacgccgaccctccgacgcgacg

SEQ ID NO: 253338 - DNA, 552 bp, Homo sapiens
  misc_feature: GYAE6OF02ITVKV.21.53.E09.1.454.CMB.1.raw
  modified_base (331)..(331): a, c, t, g, unknown or other
  misc_feature (331)..(331): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctctggattcaccttcagtgactactacatgggctggatccgccaggctccagggaagggctggagtgggtctcatatattagtagtagtggtagtcccgtatactacgcagactctgtgaagggccgattcaccatcgccagggacaacgccaagaactcacagtanctgcagatgaatagcctgagagccgaggactcggcgtgtattactgtgcgagagacgtcccggcgatgagtggcgacggcgtggtacttactttgattacgtcggggccacgggaccgtggtccaccgtctcctcgacgtcctacaccgacggcccacgtccggtccttccccgtcggcccgtcccgtcgcctccgacggaccgccgacccgtccgagacg

SEQ ID NO: 253339 - DNA, 546 bp, Homo sapiens
  misc_feature: GYAE6OF02IGQDS.21.53.E09.1.454.CMB.1.raw
  modified_base (331)..(331): a, c, t, g, unknown or other
  misc_feature (331)..(331): n is a, c, g, or t
  modified_base (503)..(503): a, c, t, g, unknown or other
  misc_feature (503)..(503): n is a, c, g, or t
  modified_base (527)..(527): a, c, t, g, unknown or other
  misc_feature (527)..(527): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattcaccttcagtgactactacatgggctggatccgccaggctccgagggaaggggctggagtgggtctcatatattagtagtagtggtagtcccgtatactacgcagactctgtgaagggccgattcaccatcgccagggacaacgcaagaactcacagtntctgcagatgaatagcctgagagccgaggacctcggccgtgtattactgtcgcgagagagtcccggcgatgagtggcgacggcgtggtactacgtttgattacgtggggccagggaccctggtccaccgtctcctcacgccctccaccgaggcccagtccgtccttccccgnggtccgccctgcctccgacggacncccgacctccgagacgacg

SEQ ID NO: 253340 - DNA, 620 bp, Homo sapiens
  misc_feature: GYAE6OF02IYLJW.21.53.E09.1.454.CMB.1.raw
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaagggctggagtgggtctcatatattagtagtagtggtagtcccgtatactacgcagactctgtgaaggccgattcaccatcgccagggacaacgccaagaactcacagtanctgcagatgaatncctgagagccgaggactcggccgtgtattactgngcgagagatcccggngagtgatgggcgacggctgggtactacgttttgatttacgtcggggaccacggggtaaacccttcgggtaccacccggttaccttccccgtacgaaccgtccctaccccgacccggaacggggtcccccagttccccgggttcccttaccccccggttcggcccggttcccccttcggacccctcccgaacggggaccctcccgtaaccccggttccggacggacccgg

SEQ ID NO: 253341 - DNA, 663 bp, Homo sapiens
  misc_feature: GYAE6OF02HBCZP.21.53.E09.1.454.CMB.1.raw
  modified_base (341)..(341): a, c, t, g, unknown or other
  misc_feature (341)..(341): n is a, c, g, or t
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
tcagtcgtcgctcgcacgaccggtgctcgatttagagagagtgtgttgggtttggggttttccttgttgctattataaaaaggtgtccgagtgtcaggtgcagttggtggagtctgggggaggccttggtcaagcctggagggtccctgagactctcctgtgcagcctccggattcaccttcagtgactactacatgggctggatccgccaggctccagggaagggctggagtgggtctcgatatattagtagtagtggtagtcccgtatactacgcagactctgtgaagggcctatcaccagtcgccgagggacaacgccaagaactcacgtagtatcgngcagatagaatgcctgagaggccgaggctcggcgtagtacttacngtgacgagacgactcccggngagtggagtcgggacgacggcgttacggtacttacgtttagactttaacggcggggacccgtaacgggtaaccccgtggttacccgacccggttctcccgtacgtacgccccttaccgaacccgtaaccgggtccctaacggttcccgggttacccgttccccccggtacgggtccccggtaccccgttcggtaccccttacccggaacgggttacccgtaccccgtacccggtaccccggaaggacccgtaccccg

SEQ ID NO: 253342 - DNA, 554 bp, Homo sapiens
  misc_feature: GYAE6OF02G2BUM.21.53.E09.1.454.CMB.1.raw
  modified_base (430)..(430): a, c, t, g, unknown or other
  misc_feature (430)..(430): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaaggggctggagtgggtctcatatattagtagtagtggtagtcccgtatactacgcagactctgtgaagggccgattcaccatcgccagggacaacgccaagaactcacagtatctgcagatgaatagcctggagagccgaggactcggcgtgtattactgtgcgagagatcccggcgatgagtggcgacggctggtactactttgattacgngggccacgggtaccctggtcaccgtctcctcacgccctccaaccgaacgggcccagtccggtccgtttcccccgtcggccgtccccgtcgccctcccgacggaccgccacccgtcccgagaccg

SEQ ID NO: 253343 - DNA, 665 bp, Homo sapiens
  misc_feature: GYAE6OF02JLHN3.21.53.E09.1.454.CMB.1.raw
  modified_base (188)..(188): a, c, t, g, unknown or other
  misc_feature (188)..(188): n is a, c, g, or t
  modified_base (361)..(361): a, c, t, g, unknown or other
  misc_feature (361)..(361): n is a, c, g, or t
tcagtcgtcgctcgcacgaccggtgctcgatttagagagagtgtgttgggtttgggctgagcgtggtttcgtgtagctattataaaaggtgtccagtgtcaggtgcagttggtggagtctggggggaggcttggtcaagcctggagggtccctggagactctcctgtgcagcctctggattcaccttnagtcgacttactacgatgggctggactccgcaggctccgagggaagggctgggaggtggtctacattatagttagtagtaggtggtacgtccgtataccgtacgcagactctgtaggaacgggccattcacctatccgaccagggacaacgcctaagaactcacagtatccgngacagtatagaacgtacgcgtagaacggacgcggaggaccgtcggtcgtagttacttacgtgtgacgtaggacggtacgtacccgggtgtagtacggtaggtcgggaccgggtacggtacgttacgttaaccgttggtttaggtacgtttacgggccgggtaccggtaaccgggtacccgtcgggtacctacccggtcttacccgacgtacctaccccgtacgaaccccggtaccggccgttaccggttcccgttccccgttcccgtccggtacccgcccggttaccgtccgaccggtacggcg

SEQ ID NO: 253344 - DNA, 576 bp, Homo sapiens
  misc_feature: GYAE6OF02H5KNC.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggaggtcccctgagactctcctgtgcagcctctggattcaccttcagtgactactacatgggctggactccgccaggctccaggggaaggggctggagtgggtctcatatattagtagtagtggtagtcccgtatactacgcagactctgtgaagggccgattcaccatcgccgagggacaacgccaaagactcacagtatctgcagatgaatagcctgagagccgaggactcggccgtagtattacgtgtgcgagagacgtccggcgatgagtggcgacggcgtcggtacttacgtttgagttacgtcggggccgaacgggaacccgtcggttaccgaccgtctacccttcgacgtccctccgacccgaacggaccctacgtccgttcccgttcccccgtcggtcccgcccgtcgccgttcccgaggtaccg

SEQ ID NO: 253345 - DNA, 639 bp, Homo sapiens
  misc_feature: GYAE6OF02ITVQM.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccagggaagggctggagtgggtctcatatattagtagtagtggtagtcccgtatactacgcagactctgtgaagggccgattcaccatcgccagggacaacgccaagaactcacagtatctgcaagatagaatacgcctagagagccggaaggacgtcggcgtgtattacgtgtgcgagagacgtcccggagagtgagtggcgacggtcgtacggttacttacgtttagtacgtttacggtcggggaccctaacggggaacccgttcggtaccgacccgttcctcccgtacgaccgtaccctacccgaacccggaaaccgggtccctaacgttcccggttccctttccccccggtcgggtaccccgtccccgttcgacccgttacccgaacgggtaccgcccgtacccggtaccggacgaccgacccg

SEQ ID NO: 253346 - DNA, 551 bp, Homo sapiens
  misc_feature: GYAE6OF02H9A4L.21.53.E09.1.454.CMB.1.raw
  modified_base (429)..(429): a, c, t, g, unknown or other
  misc_feature (429)..(429): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
  modified_base (528)..(528): a, c, t, g, unknown or other
  misc_feature (528)..(528): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattcaccttcagtgactactacatgggctggatccgccaggctccagggaagggctggagtgggtctcatatattagtagtagtggtagtcccgtatactacgcagactctgtgaaggccgattcaccatcgcagggacaacgccaaagactcacagtatctgcagatagaatagcctgagagcgaggactcggccgtgtattactgtgcgagagagtcccggcgatgatggcgacggctggtactacgtttgattacgnggggcagggaaccctggtaccaccgtctacctcacgccctccacgaacgggcccagtccgtccttcccccgnggcccnccctcgtcctaccgacggacnccgacccgtccggacgtgacccg

SEQ ID NO: 253347 - DNA, 595 bp, Homo sapiens
  misc_feature: GYAE6OF02GWEAW.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccagggaaggggctgggagtgggtctcatatattagtagtagtggtagtcccgtatactacgcagactctgtgaagggccattcacatcgccagggacaacgccaagaactcacagtatctgcagatgaatgcctagagacgcgaggactcggccgtagtattactgtgcgagagactccggcgagtgatggcgacggcgtggtactacgttttgaagtttacgtcggggcctacggggaacccgttggtcccgtacccgtctcccgtcgacgtccctcccgaaccgaacgggcccctagtcccggttccctttacccccgtcgggcccgtccccgtcgacccgttcccgacgggaccgcccgacccgtccggacgacgacccg

SEQ ID NO: 253348 - DNA, 613 bp, Homo sapiens
  misc_feature: GYAE6OF02H2Z9B.21.53.E09.1.454.CMB.1.raw
  modified_base (577)..(577): a, c, t, g, unknown or other
  misc_feature (577)..(577): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcacttcagtgactactacatgggctggatccgccaggctccgaggggaagggctggagtgggtctcatatattagtagtagtggtatcccgtatactacgcagactctgtgaagggcattcacatcgccaggacaacgcaagaactcacagtactctgacagatagaaatcgcctaggacgagccgaaggactcgggcctagttactacgtgtcgacgagagacgtcccggagagtggatgggaccggacgggacgttaggtaaccttacgttaggtacgtttaccggtagggggacccgtaacggggtaacccgtcgggttaccaccgttcctaccgtacgacctccgacccaaccggaaccgggtccctacgttccggttcccctttcccccgnggtccccgtcccgtcgcccttacccggaggtaaccg

SEQ ID NO: 253349 - DNA, 661 bp, Homo sapiens
  misc_feature: GYAE6OF02H21KY.21.53.E09.1.454.CMB.1.raw
  modified_base (190)..(190): a, c, t, g, unknown or other
  misc_feature (190)..(190): n is a, c, g, or t
  modified_base (297)..(297): a, c, t, g, unknown or other
  misc_feature (297)..(297): n is a, c, g, or t
  modified_base (459)..(459): a, c, t, g, unknown or other
  misc_feature (459)..(459): n is a, c, g, or t
tcagtcgtcgctcgcacgaccggtgctcgatttagagagagtgtgttggggtttgggctgagctgggttttccttgttgctattataaaaggtgtccagtgtcaggtgcagttggtggagtctgggggagcttggtcaaggcctgggagggtccctgagactctcctgtgcagcctctggattcaccttnagtcactacacagtgggctggatccgccaggctccgaggggagggctggagtggtctcgatatattagtagtagtcggtactcccgtaatacacgcaagtactctgnggaaacgggcctatttccaaccatcggaccaaggggaaccaaaccggcctaaaagaactccgaacaggttactctggccagtaatcgaatcgcctggaacgcgccgtaagggacctcgggcttgtattacgtgtgcgaagcgaagtcccggcggaatggtancggcggtacggcgtgggtaacctacgttagacttaacggtcgggaccgaacgggaacccgtggttaccgtacccgtctacccgtacgaccgtccccttacccgaacccggtaaacgggacccccgtacgtcccgggttccccttaccccccggttcgggccccgtcccggttcccgtacccggttaccccgagggtacccgg

SEQ ID NO: 253350 - DNA, 642 bp, Homo sapiens
  misc_feature: GYAE6OF02F4HDD.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccagggaaggggctggagtgggtctcatatattagtagtagtggtagtcccgtatactacgcagactctgtgaaggccgattcaccatcgcagggacaacgccaagaactcaacagtatctgcagatagaatacgcctagagagccgaaggactcggccgtgtaattacctggtgcgaagacgacgtccccggcgagtcgtagtgggccggacgggcttacgggtaccttacgtttagatttaccggtcggggtacccgaaggggtaaccccgttggtcccgaccgttcctccgtcacgtccctaccaacccgaacgggtccccagttcccggttacccttcccccgtacggggtccccgtacccgtccgtccctacccggaacgggtaccgtacccgtaaccccggtcccggtaacggccggtaaccccg

SEQ ID NO: 253351 - DNA, 580 bp, Homo sapiens
  misc_feature: GYAE6OF02ICLQO.21.53.E09.1.454.CMB.1.raw
  modified_base (447)..(447): a, c, t, g, unknown or other
  misc_feature (447)..(447): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattcaccttcagtgactactacatgggctggatccgcaggctccagggagggctggagtgggtctcatatattagtagtagtggtagtcccgtatactacgcagactctgtgaagggccgattcaccatcgccagggacaacgccaagaactcacagtatctgcagatagaatagcctagagagccgaggactcggccgtgtaattactgtcgcgagacgacgtcccggacgagtgagtcgggacgacgggcgtggtacttacgtttgtacttacggnggggaccgacgggtacccgtggtccacccgtctcctcacgcccgtccaccgaacgggccccagttcccggtccctcccccggtcggcccgcccgtcgcctccgacggcgcccgacccgtccggacgacgaccg

SEQ ID NO: 253352 - DNA, 584 bp, Homo sapiens
  misc_feature: GYAE6OF02GWRCH.21.53.E09.1.454.CMB.1.raw
  modified_base (401)..(401): a, c, t, g, unknown or other
  misc_feature (401)..(401): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctctggattcaccttcagtgactactacatgggctggatccgccaggctccgagggagggctggagtgggtctcatatattagtagtagtggtagtcccgtatactacgcagactctgtgaaggccgattcaccatcgccgagggcaacgccaagaactcacagtatctgcagatagaatacgcctgagacgaccgaggactcggcgtagtattacgtgtgacgagacgacgtccggngatgagtgggcgacggcgtaggtacttacgtttagacttacgcggggaccgaacgggtacccttggtaccgtaccgtctccctcgacgtccctaccgaccgaccgggccctacgtccgttcccttcccccgtcggcccgtcccgtcgcctaccggacggaccgccgacccgtaccgaggaccg

SEQ ID NO: 253353 - DNA, 596 bp, Homo sapiens
  misc_feature: GYAE6OF02IM4OB.21.53.E09.1.454.CMB.1.raw
tcagtcgtcgctcgcacgaccggtgctcgatttagagagagtgtgttggggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgagggagggctggagtgggtctcatatattagtagtagtggtagtcccgtatactacgcagactctgtggaacgggccgtattccaccatcgcccgagggacaacgccaaagaactcacagtatctgcagatagaatagcctagagagaccgaggactcgggccgtgtacttacgtgtcgacgagagtacgtcccggagagtgagtggcgacggcctggtactttacgtttagtagttacggtcggggaccgtaacgggtacccgttcggtaccgtaccgttctccgtcaccgtcccaccgaaccgaacggccctacgtccggttcccttccccggtcggccctcccgtgccctccgacggacgtaccacccgtcgacgacg

SEQ ID NO: 253354 - DNA, 605 bp, Homo sapiens
  misc_feature: GYAE6OF02G6LYK.21.53.E09.1.454.CMB.1.raw
  modified_base (402)..(402): a, c, t, g, unknown or other
  misc_feature (402)..(402): n is a, c, g, or t
  modified_base (583)..(583): a, c, t, g, unknown or other
  misc_feature (583)..(583): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatcccgccaggctccgagggaagggctggagtgggtctcatatattagtagtagtggtagtcccgtatactacgcagactctgtgaaggccgattcacatcgcagggacacgccaagactcacagtatcgtgcagatgaatacgcctagagacgccggaggaccgtcgggcctagtacttacgtgtgcgagagacgtcccggngtatgagtcggcggtacggcgtacggtacttacgtttgacgttacggtcgggaccgacgggtacccgtggtacctacccgtcttccctacgaccgtccctacccgaacccgaccgggtcccacgttccggttccccgttcccccggtcggcccgtcccgtcgtcccgtccgacgggtaccncccgtacccgtccggagaccgg

SEQ ID NO: 253355 - DNA, 658 bp, Homo sapiens
  misc_feature: GYAE6OF02JDYQT.21.53.E09.1.454.CMB.1.raw
  modified_base (405)..(405): a, c, t, g, unknown or other
  misc_feature (405)..(405): n is a, c, g, or t
  modified_base (428)..(428): a, c, t, g, unknown or other
  misc_feature (428)..(428): n is a, c, g, or t
tcagtcgtcgctcgcacgaccggtgctcgatttagagagagtgtgttgggtttgggctgagcgtggtttcgttgttgctattaataaaaggtgtccagtgtcaggtgcagttgggtggagtcgtgggggaggcttggtcaagcctggagggtccctgagactctcctgtgcagcctctggattcaccttcagtgactactacatgggctaggatccgccaggctccgagggaagggctggagtgggtctcatatattagtagtagtggtagtccgtatactacgcagactctgtaggaacggccgtattaccaccagtccgccgaagggacaacgccaaagtaactcacagtatctgcagatgaatacgctgaagacgcgaggacctcggaccgtgtactttacnggtcgcgaggagacgtcccgganatgagtcgggacgacggcgttcggtaactttacggtttagtacgtttacggacggggttacccgaaacgggggttaccccttggggttaaccctcccgggttacctccgtaccaccgtaccctacccgaaccggaaaccgggtcccctaaggtttccccgggttccccttttaccccccgggcggtaccccggtcccccgttacggtacccgttcccggaggtaccccgg

SEQ ID NO: 253356 - DNA, 562 bp, Homo sapiens
  misc_feature: GYAE6OF02HR64Y.21.53.E09.1.454.CMB.1.raw
  modified_base (235)..(235): a, c, t, g, unknown or other
  misc_feature (235)..(235): n is a, c, g, or t
  modified_base (394)..(394): a, c, t, g, unknown or other
  misc_feature (394)..(394): n is a, c, g, or t
  modified_base (434)..(434): a, c, t, g, unknown or other
  misc_feature (434)..(434): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgcaggctcgagggaagggctggagtgggtctnatatattagtagtagtggtagtcccgtatactacgcagactctgtgaaggccgattcaccatcgcagggacaacgccaagaactcacagtatctgcaagatagaatagcctagagagcgaggactcggctagtattacgtgtgcgagagacgtcccggngtatgagtggacgacggctggtacttacgtttgattacgngggaccacgggaaccctggtacctaccgtctcctacacgccctaccgaaccgaacggccctacgttccggtacccttccccggtcgcccgtcccgtcgtcctacgacggacaccacccgtacgagacg

SEQ ID NO: 253357 - DNA, 617 bp, Homo sapiens
  misc_feature: GYAE6OF02HCBPU.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctctggattcaccttcagtgactactacatgggctggactccgccaggctccgaggggaagggctggagtgggtctcatatattagtagtagtggtagtccgtatactacgcagactctgtgaagggccattcacatcgccagggacaacgccaagactcacagtatctgcagatgaatacgcctgacgagccgaaggacgtcggccgtagttattactggtgcgagagctcccggacagtgagcggacgacggtctgggtaacttacgtttagtacgttacggtggggtaccacggggtaaccctgggtccctaccgtcctccgttccacgtccctacccgaaccgaaccgggtccctacgttacccgggttccctttcccccggtacgggtccccgtccccgtacgtccccgtaccggacgggaccgcccaccccggttcccggaagtaccg

SEQ ID NO: 253358 - DNA, 654 bp, Homo sapiens
  misc_feature: GYAE6OF02IVGBN.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttgggtggagtctggggggaggcttggtcaagcctgggagggtccctgagactctcctgtgcagcctctggattcaccttcagtgactactacatgggctggatccgccaggctccgagggagggctggagtgggtctcatatattagtagtagtggtacgtccgtatactacgcagactctgtgaggccgattcaccatccgccgagggacaacgccaagaactcacagtactctgacagatagaatagcctagagacgcgagacgtcggccgtagtattacgtgtcgcgagacggactcccgggagagtgagtggacggaccggtctaggttaccttagtttagacgtttacggtacggggaccgtacggggtaaacccgttcgggttaccctacccggttccgttaccccgttccgtacccgtcccgtacccgaaaccccggtaaccgggtaccccttaccggttccccggttccccgtttaccccccggttcgggcccccgttccccgttccggacccggttccccggacgggtaccccg

SEQ ID NO: 253359 - DNA, 541 bp, Homo sapiens
  misc_feature: GYAE6OF02FJ14Q.21.53.E09.1.454.CMB.1.raw
  modified_base (395)..(395): a, c, t, g, unknown or other
  misc_feature (395)..(395): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccagggaaggggctggagtgggtctcatatattagtagtagtggtagtcccgtatactacgcagactctgtgaagggccgattcaccatcgccagggacaacgccaagaactcacagtatctgcagatgaatagcctgagagccgaggactcgggccgtgtattactgtgcgagagatcccggngatgatggcgacggctggtactactttgattacgtgggccagggaccctggtccaccgtctcctcagtcctccaccaacgggcccagtccggtccttccccgtggccgcccgtcgcctccgacggcgccaccgtccgagacgaccg

SEQ ID NO: 253360 - DNA, 588 bp, Homo sapiens
  misc_feature: GYAE6OF02IB6HR.21.53.E09.1.454.CMB.1.raw
  modified_base (325)..(325): a, c, t, g, unknown or other
  misc_feature (325)..(325): n is a, c, g, or t
  modified_base (384)..(384): a, c, t, g, unknown or other
  misc_feature (384)..(384): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattcaccttcagtgactactacatgggctggatccgccaggctccaggggaaggggctggagtgggtctcatatattagtagtagtggtatcccgtatactacgcagactctgtagaagggccgattcaccatcgccagggacaacgccaagaacncacagtatctgcagatagaatagcctgagagcgaggactcggccgtgtaattacgtggngcgagagacgtcccggcgagtagagtggcgacggtcgtggtactacgtttagtattcggtcgggaccgtaacgggacccttggtaccgtaccgtccgtccctcgacgtccctcccacgaacggcccacgtcccgttaccgttccccgtcggcccgtccctacgccctccggacggacgaccgttacccgaccgtacgacgaccg

SEQ ID NO: 253361 - DNA, 682 bp, Homo sapiens
  misc_feature: GYAE6OF02I9ZXH.21.53.E09.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggactccgccaggctccgaggggagggctgggagtgggctcatatattagtagtagtggtacgtcccgtatactacgcagactctgtgagggccattccacatcgcagggacaacgcaagacncacagtactctgcagatgaatcgacctgagacgccggaggaccgtcggccgttagttacgttacgttgtcgcggacgtacggtacgtccgggcgtagtcgtagtcgggtacgacgggacgttcggttaaccgttctttaggtaacgttcgggtacggggacccggtaacggggtaaccccgttcgggttaccctacccggttcccttacctaccggtacccgtacccgtaccccggtaacccggaaccggggttacccccgtacggttaccccgggttcccccgttacccccgggttccggtaccccggtccccgtccgggttacccgtaccccgggtaacgggtaccccgg

SEQ ID NO: 253362 - DNA, 577 bp, Homo sapiens
  misc_feature: GYAE6OF02HC0BS.21.53.E09.1.454.CMB.1.raw
  modified_base (349)..(349): a, c, t, g, unknown or other
  misc_feature (349)..(349): n is a, c, g, or t
  modified_base (393)..(393): a, c, t, g, unknown or other
  misc_feature (393)..(393): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctctggattcaccttcagtgactactacatgggctggatccgccaggctccgagggaagggctggagtgggtctcatatattagtagtagtggtagtcccgtatactacgcagactctgtgaagggccattcaccatcgcaggacaacgccaagaactcacagtatctgcagatgaatagctgagngccgagactcggcgtgtacttacgtgtgcgagagacgtcccggngagtgagtggacgacggcgtggtacttacgtttgacgttacgtcggggaccacgggaacccgtgggtacctaccgtcctcccgtacgacgtccctacccaaccgaacgggcccctacgttccggtcccgttccccgcggccctcccgtcgccgtcccgacggccgccgacccgtccggagaccg

SEQ ID NO: 253363 - DNA, 694 bp, Homo sapiens
  misc_feature: GYAE6OF02I9AI0.21.53.E09.1.454.CMB.1.raw
  modified_base (362)..(362): a, c, t, g, unknown or other
  misc_feature (362)..(362): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagccctctggattccaccttcagtgactactacatgggctggatcccgccaggcttcgaggggaagggctggagtgggtctcatatattagtagtagtggtatcccgtatactacgcagactcgtgtggaacgggccgtattcaccatcgaccgagggacaaccgccaagaacctacgacagtactctgacagatagaatanccgtggaagacgccgaggaccgtcggacgtgttaattaccgtggtcgacgagagaccgtcccgagagtggagtcggaccgacggtccgtaggttaccgttacgtttgtacgttacggcggggtaccaacgggggtaacccttcgggacccgtacccgtcccgttcccgtacccggcgtacccccttacccgaaccggtaaccccggtccccgttacgggttaccccggttcccccggtttcccccggtacggggtccccctaccccgttccggtacccctcccgggtaacgggaccccgtacccgtaacccccgttacgggaccggacccgg

SEQ ID NO: 253364 - DNA, 713 bp, Homo sapiens
  misc_feature: GYAE6OF02HBNWV.21.53.E09.1.454.CMB.1.raw
tcagtcgtcgctcgcacgaccggtgctcgatttagagagagtgtgttgggtttgggctgagctgggttttaccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgaggggaagggctggaggtggtctcatatattagtagtagtggtacgtcccgtatactacgcagactctgtagaacgggccgtatttaccatcgaccgagggacaacgccaagaactcacagtactctgacagatagaactagcctagagacgccggaggaccgtcgggaccgtgtactttacgtggtcggtacggaaggacggtaacgtcccgggagtagtacggtaggtcgggaccggacgggtaccgttacgggttaaccttacgttttacggtaacgtttacgggtccgggggtacccggtaaccggggtaaccccgttcggtacccgtacccggttccgtccccgtacgacccgtacccccttacccgaacccggtaacccggggtcccctaaccggttcccgggttaccccctttaccccccgggtcggtcccccggtccccggtccgtaccctacccgggtacgggtacccgtaacccccgg

SEQ ID NO: 253365 - DNA, 556 bp, Homo sapiens
  misc_feature: GYAE6OF02JH6NP.21.53.E09.1.454.CMB.1.raw
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (537)..(537): a, c, t, g, unknown or other
  misc_feature (537)..(537): n is a, c, g, or t
  modified_base (549)..(549): a, c, t, g, unknown or other
  misc_feature (549)..(549): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagttgactactacatgggctggatccgcaggctcgagggaggctggagtgggtctcatatattagtagtgtggtactcccgtatactacgcagactctgtgaagggccattcaccatcgccagggacacgaccaagactcanagtatcgtncagatgatagccngagagccgagactcggcgtagtattcgtgtgcgagngacgtcccggngactgacgtcggcgtacggcgtgtacttacgttgattacgtagggccgtacggaacccgtggtaccgaccgtcctacctcacgtccctccgaaccgacgggcctacgtcggtacctccccgtcgccgtccctcggcctccggacggtncccgacctcggngacgccg

SEQ ID NO: 253366 - DNA, 704 bp, Homo sapiens
  misc_feature: GYAE6OF02FK2N2.21.53.E09.1.454.CMB.1.raw
tcagtcgtcgctcgcacgaccggtgctcgatttagagagagtgtgttgggtttgggctgagctgggttttccttgttgctattataaaaggtgtccagtgtcaggtgcagttggtggagtctggggggaggcttggtcaagcctggagggtccctgagactctcctgtgcagcctctggattcaccttcagtgactactacatgggctggatccgccaggctccgagggaagggctggagtgggtctcgatatattagtagtagtggtagtcccgtatactacgcagactctgtgaagggccattcaccatcgccagggaccaacgccaagtaactcacagtatctgcagatagaattagcctaggagacgaccggaaggtaccgtccgggtaccgtaggttaactttaaccgtggtacggacggaaggacgaacgtcccgggacgtaagtacggtagttcggggtacgtaccgggtcttacgggttaaccgtttacttttgggtaacgttttacggtacggggggtacccgtaaacgggggtaaccccttcgggtaccgtaacccgttccttcccttacgccgtaccccttacccgaacccggtaaccgggaccccgttaacgttccccgggttacccccgtttaccccccggtccgggtaccccgtacccccgttcggtacccctcccgggtacggaacccg

SEQ ID NO: 253367 - DNA, 668 bp, Homo sapiens
  misc_feature: GYAE6OF02IYVH2.21.53.E09.1.454.CMB.1.raw
  modified_base (273)..(273): a, c, t, g, unknown or other
  misc_feature (273)..(273): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtgggggaggcttggtcaagcctggagggtccctgagactctctgtgcagcctgtggattcaccttcagtgactactacatgggctggactccgcaggctccgaaggggagggctgggagtgggtctcatatattagtagtagtggtcgtccgtatacacgnagactgtgtagacgggccattcaccatcgcgagggacaacgccaaagacctcacagtactctgacagatgaattcgcctaggacgtacggccggaaggtaccgtccgggccgttagttaacttacgtggtagacggagtacggtacgtcccggagagtggagtcggacggaccggtacgtcggttaacgttacgtttaggtaacgttacggtccggggtaccgtaacgggtacccgttcggtaccgtacccgtccgtccgtacgacccgtcccgtaacccgaacccggaaccggtccccgtacgttccccggttacccgttcccccggtcggtacccgtcccgttcgtcccgtaccggacggacccgtacccgtacccgtaccggacggtacccg

SEQ ID NO: 253368 - DNA, 591 bp, Homo sapiens
  misc_feature: GYAE6OF02F21F6.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccgagggaagggctggagtgggtctcatatattagtagtagtggtagtcccgtatactacgcagactctgtgaaggccattcacatcgccaagggacaacgccaagactcacagtatctgactagatgaaatacgcctaggagagccgaggacctcgggaccttgtaattcgtggtgacgagagacgtccggacgatgagtggcgacggtcgtaggtaaccttagtttacgattacggtcgggaccgtaacgggaacccgttcggtacctaccgttcctcctccgacgtcccgtaccacgaacggtcccacgttccgtcccgtccccgtgcccgtcccgcgtccgtaccgacggccgccgtaccgtcccggagacgaccg

SEQ ID NO: 253369 - DNA, 783 bp, Homo sapiens
  misc_feature: GYAE6OF02HDVS3.21.53.E09.1.454.CMB.1.raw
tcagtcgtcgctcgcacgaccggtgctcgatttagagagagtgtgttgggtttgggttttccttgttgctattaataaaaggtgtccagtgtcaggtgcagttggtggagtcgtggggggaggcttggtcaagcctgggacgggtccctgagactctcctgtgcagcctctggattccaccttcagtgactactacatgggctggatcccgccaggctccgaagggggaaggggcgtgggaggttgggtctacataattaattagtagttagtaggttacgtccgttatactacgcaacgactcgtgtaggaacgggccgtattccaacctacgtccgacccgaacggggaaccaaccggacccaaaaggaacctacaacgtaagttactctgacaagagtagaagtacgccgtaggacgacggaccgacggacgtccgggcgttagttacttacgtggtcgacggagagaccgtacccggagagtgaacgtcgggacggccgggtacgttacggttaaccgtttacgttttacggtaacgtttaaccggggtcgggggtaacccgaaccgggggttaaccccgttacggggttaccctaaccccggtttccttcccccgtaccgaccgttacccccgtacccgaaacccggaacccgggtaccccgttacccgttaccccggtttcccccggtttaccccccggtccgggtccccgtaccccgttccggtaccccgtaccggtaccggaccgtaccccgccccgtaccggacggtaacccgg

SEQ ID NO: 253370 - DNA, 623 bp, Homo sapiens
  misc_feature: GYAE6OF02HWARD.21.53.E09.1.454.CMB.1.raw
  modified_base (392)..(392): a, c, t, g, unknown or other
  misc_feature (392)..(392): n is a, c, g, or t
  modified_base (400)..(400): a, c, t, g, unknown or other
  misc_feature (400)..(400): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaaggcctggagggtccctgagactctcctgtgcagcctccggattcaccttcagtgactactacatgggctggatccgccaggctcgagggaagggctggagtgggtctcatatattagtagtagtggtagtcccgtatactacgcagtactctggtagaacgggcctaattccaaccatccgaccgtaagggaaccaacggaccaaagaacctcaacgagtatcgtgacagatgaatgcctagagagccgagactcggacgttntattacgngtgcgagacgactcgaaggcgatgactgggacgtacggtcgttaggtacttagtttacgtagttaccggcggggaccaacccggggtaaccttcgggtacctacccgtccgttccgtacaaccgcccctaaccgaacccggacggtccctaggttccccggttccctccccggacggcccctcccgtcgaccttcccgaggccaccctaccgttccgagaccg

SEQ ID NO: 253371 - DNA, 701 bp, Homo sapiens
  misc_feature: GYAE6OF02FY70D.21.53.E09.1.454.CMB.1.raw
  modified_base (271)..(271): a, c, t, g, unknown or other
  misc_feature (271)..(271): n is a, c, g, or t
  modified_base (317)..(317): a, c, t, g, unknown or other
  misc_feature (317)..(317): n is a, c, g, or t
  modified_base (386)..(386): a, c, t, g, unknown or other
  misc_feature (386)..(386): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccgagggagggctggagtgggtctcatatattagtagtagtggtacgtccgtatactcgnagtactctgtgaaggccattcacatcgcaggacacgcaagactcanagtactctgacagatagaacgtacgcctagacgacgccggaaggacctcgggccgttagtactttacgnggtacgacgagacgacgtcccggagtatggagtcgggcggaaccggtcgttcggtaactttacgtttagtaacgtttccggtacgggggtaccctaacggggtaaccccgttcggtaccgtacccggttccgacccgttacgaccggtccccttacccgaaccggtaaaccggggtcccctaacggtttcccggttaccccgtttaccccccgggtacgggtccccgttaccccgttcccggtacccgtttacccggaacggggtaccccgtaccccggttaacccggtaccccggtaacggacccggtaacccg

SEQ ID NO: 253372 - DNA, 565 bp, Homo sapiens
  misc_feature: GYAE6OF02IY4MD.21.53.E09.1.454.CMB.1.raw
  modified_base (405)..(405): a, c, t, g, unknown or other
  misc_feature (405)..(405): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaagggctggagtgggtctcatatattagtagtagtggtagtcccgtatactacgcagactctgtgaagggccattcaccatcgccagggacaacgccaagactcacagtatctgcagatgaatgcctgagagaccgaggactcggccgtgttacttacgtgtgcgagagacgtccggnagtgagtcggcgacggtcgtcggtacttacttgtagttacgtcgggaccgagggtaaccctggtccaccgtcctccgtcacgtccctaccaaccgaacgggccctacgttccggttacccttcccccgtcggccgtcccctcggtccctccgaggtaccg

SEQ ID NO: 253373 - DNA, 659 bp, Homo sapiens
  misc_feature: GYAE6OF02IW9D8.21.53.E09.1.454.CMB.1.raw
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctgggagggtccctgagactctcctgtgcagcctctggattccaccttcagtgactactacatgggctggatccgccaggctccgaggggaagggctggaggtgggtctcatatattagtagtagtggtagtcccgtatactacgcaagactntggtgaacgggccgattcaccatccgcgaggacaacgctaaagaacctnacagtatctgacagatgaactacgcctaggagtacgaccgaggaccgtccggaccgtagttacttacgtgtgacgagacgacgtccggtacgacgtagacgtgggacgacgggtacgttacggtacgttaacgtttagtacgttacgtacgggccggtaacggtacccgtcggttacccgtacccgttaccttccgtaccgtaccgtcccctaccggtaacccggaaccgggacccgttaaccggtcccggttacccgtttacccccggtcggtcccgtccccggtaccgtacccgttacccggaacggtacccgg

SEQ ID NO: 253374 - DNA, 686 bp, Homo sapiens
  misc_feature: GYAE6OF02GZ7FJ.21.53.E09.1.454.CMB.1.raw
tcagtcgtcgctcgcacgaccggtgctcgatttagagagagtgtgttgggtttgggttttccttgttgctattataaaaaggtgtccagtgtcaggtgcagttggtggagtctggggggaggcttggtcaagcctggagggtccctgagactctcctgtgcagcctccggattcaccttcagtgactactacatgggctggatccgccaggctccagggagggctggagtgggtctcatatattagagtagtggtagtcccgtatactacgcagactctgtgaagggccgattccaccatcgccagggacaacgccaaagaactcacagtatctgcagatgaatacgcctgagagccgaggacgtcggccgtgtacttacgtgtgcgagagacgtcccggcgagtggagtgggcggacgggcgttacggttaccgttacgttttagtacgtttacggtcgggggtacccgaacggggtaaccccgttcgggttacccgtacccgttcccgtcccttccgtaccgtccccttaccccgaacccggaaaccggggccccctacggttccccggtttaccccgtttcccccccgggttcgggtacccccggtcccccgttccggtccccgttacccggaacgggtaccgtaccccgtaccccgttacccgggacggtaccggaacccgg

SEQ ID NO: 253375 - DNA, 727 bp, Homo sapiens
  misc_feature: GYAE6OF02GNDBH.21.53.E09.1.454.CMB.1.raw
tcagtcgtcgctcgcacgaccggtgctcgatttagagagagtgtgttgggtttgggctgagctgggttttccttgttgctattataaaaaggtgtccagtgtcaggtgcagttggtggagtcgtgggggaggcttggtcaagcctggagggtccctgagactctcctgtgcagcctctggattcaccttcagtgactactacatgggctggactccgccaggcctccgaggggaacgggctggagtgggtctcatatattagtagtaggtggtactccgtatacgtacgcagaccttcgtagtggaacggccgtaattccgaaccagtccgaccgagggaaccaaccggcaaagaactcaactagtactctgacagtatagaatacggcctaggaagacggccggaaggacccgtcgggcccgtttagtaacgtttacgtgtcggacgaaggtaacggtacgtcccgggacggtagtcggacgttacgggacggaccgggtacgttacggttaacgttacgttttagtaacgtttaccgggtaccggggacccgtaacggggtaacccgttcgggtacctaacccgtacgttcccgttaccgtacgtaccgtaccccgtacccgaacccggtaaccgggtaccccgtaaccggttccccggtttaccccgtttcccccggtccgggtacccccgtacccggttccggtacccgtacccggtaaccgg

SEQ ID NO: 253376 - DNA, 799 bp, Homo sapiens
  misc_feature: GYAE6OF02FHSER.21.53.E09.1.454.CMB.1.raw
  modified_base (167)..(167): a, c, t, g, unknown or other
  misc_feature (167)..(167): n is a, c, g, or t
  modified_base (591)..(591): a, c, t, g, unknown or other
  misc_feature (591)..(591): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggagcttggtcaagcctgggaggtccctgagactctcctgtncagcctctggattcaccttcagtgactactacgatgggctggatctgccagggtcctccgagggggtaacgggtcctgggacggttcgggttacctcgaacgtttaagttattaaggttacggtacgtacgggttacgttcccccggtaattacccgttaaccggacctacggtaaccttccgttgggttacaaacggggggtcccctaatttacccaacccttaagttcccggacccaaacgggggaaccctaaaccggggtacccaaaaaggtaacccttccaaaccgtaaggttacctcgtacgacgtacgacgttggaaaactcggacccttaggaacgtacggacccggacggacccgttcgggcccgttagttaacgtttaccgtggttacgacgcggaacggtacgtccccgggtanagttacgaggttcggaccgtacgcgttacggtacttacgttagtacgtacggtcgggaccgtaacgggtacccttgggaccctaccggttcctcccgttacgaccgtcccttacccggaacccggtaccggacccctaaccggttccccggttcccgtttcccccggtacggtccccggtccctaccggcccgttacccggaaccggg

SEQ ID NO: 253377 - DNA, 714 bp, Homo sapiens
  misc_feature: GYAE6OF02JKJ5M.21.53.E09.1.454.CMB.1.raw
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtcccctgagactctcctgtgcagcctctggattcacctttcagtgactactacatgggctggactccgccaggctccgagggagggctggagtgggtctcatatattagtagtagtggtagtcccgtatactacgcagctctggtgaaggccattcacatcgcgaggacacgcaagactcacagtatctgcaagatagaatacgccgtagacgacggccgaggtccgtacgggccgttaggttacttacgtggtacgcggaagaggacgtcccgggacgtagtggtagtcgggtaccggacggtcgttaggttaaccgttacgttttacgtacgttaccggtcgggggtaccggaaccgggtacccggttacggtacccgtaccccggtttcctcccgtacgtaccgtaccccggttaccaaccccgggaccgggtacccccgtaccggttccccgggttacccccggtttccccccgggttacgggtcccccgtaccccgttcccggtacccgttacccggaaccgggtaccccgacccggttacccccgggtaccggtaacccggtaacccgg

SEQ ID NO: 253378 - DNA, 748 bp, Homo sapiens
  misc_feature: GYAE6OF02FX0DF.21.53.E09.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctggggggaggcttggtcaagcctgggagggtccctgagactctcctgtgcagcctntggattcaccttcagtgactactacagtgggctggactccgcaggcctccgaggggagggctgggagtggtctcatatagttagtagtagtggtacgtacccgtatactacgcagtactctggtaggaacgggcctattccaccagtccgcgagggacaacgccaaagaactcacgagtatccgtagacagtatgaaaacgttcgcccgttaggaaggaccgtacccgggaaacggggacccgttaccggggcccgtttagttaaccgtttaccgttggtacggacgggagacggtaacgtcccgggtacgagtaggagttcggggaccggtacgggccgttagggttaaccgtttacgtttggtaacgtttaccgggtcggggacccggtaaccggggtaacccggtcggttacccgtaaccgttcccgtaccgttaccgacccgtcccgtacccgaaccccgggtaaccggtacccgttacccggttcccggtttcccccgttacccccggttccgggtccccggtcccccgttaccggaccccgttacccggtacgggtaacccccgg

SEQ ID NO: 253379 - DNA, 786 bp, Homo sapiens
  misc_feature: GYAE6OF02JBPQ3.21.53.E09.1.454.CMB.1.raw
  modified_base (172)..(172): a, c, t, g, unknown or other
  misc_feature (172)..(172): n is a, c, g, or t
  modified_base (197)..(197): a, c, t, g, unknown or other
  misc_feature (197)..(197): n is a, c, g, or t
tcagtcgtcgctcgcacgaccggtgctcgatttagagagagtgtgttgggtttggggttttccttgttgctattataaaagggtgtccagtgtcagggtgcagttgggtcggagtctgggggaggcttgggtcaagcctggagggtccctgagactctcctgtgcagcctcnggattcaccttcagtgactactacntgggctggactccgcaggctccgagggaacggggctgggacgtcgggtctaccagtacgtattaaggtagtacggtggtactccccgtaagttacctacgtcaggaccttcgtgtacggaacgggccctaagttccaaccgtagtcccgaccggtaacggggacaaccggaccgtaagtaaccttccgaacgtaaggttaactccgtacggactaaggtaactagggaaacttaccggcctaggtaacgacggtacccgggaaggtccttccgggaccttaggtacttacgtcggtaggaccgagtacggacccgtaccggtagactacggacgtacggtccggtaccggtcgtaacggtttaacgttaccgtttacggtaacgttccgggttaacgggtcccggtaaccgggttaccccgttgggttaacccctaccggtttcccttaccggttacgacccgtcccttaacccgacggtaacccggtacccgttcggttacccgttccccgggtccccgttacggcccgttacccgttggacccgttaaccggaccggaccgttacccggaccccgttaggaccgacg

SEQ ID NO: 253380 - DNA, 608 bp, Homo sapiens
  misc_feature: GYAE6OF02I28HD.21.53.E09.1.454.CMB.1.raw
  modified_base (334)..(334): a, c, t, g, unknown or other
  misc_feature (334)..(334): n is a, c, g, or t
  modified_base (409)..(409): a, c, t, g, unknown or other
  misc_feature (409)..(409): n is a, c, g, or t
  modified_base (513)..(513): a, c, t, g, unknown or other
  misc_feature (513)..(513): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattcaccttcagtgactactacatgggctggatccgccaggctccgaggggaagggctggagtgggtctcatatattagtagtagtggtagtcccgtatactacgcagactctgtgaagggccattcaccatcgccagggacaacgccaagactcacagtactcngcagatagaatgcctagagacgccggaggacgtcgggccgtgttattacgtggtagacggagacgacgtcccggngagtggacgtgggcgacgggtcgtaggttacttacgtttaggactttacggtggggacccgtacgggtaacccgtggtcccgtaccgttcctcctcacgtcccnccgaaccgaccggcctacgttcccggttcccttaccccggtcggcccgtcccgtcgtcccgccggacggccgaccgtacccgcggtacgacgccg

SEQ ID NO: 253381 - DNA, 667 bp, Homo sapiens
  misc_feature: GYAE6OF02F6N17.21.53.E09.1.454.CMB.1.raw
  modified_base (418)..(418): a, c, t, g, unknown or other
  misc_feature (418)..(418): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagcctccggattcaccttcagtgactactacatgggctggatccgccaggctccgagggaaggggctggagtgggtctcatatattagtagtagtggtacgtcccgtatactacgcagactctgtgaagggccgatcaccatcgccagggacaacgccaagacctcacagtactctgcagatagaatacgtcctaggacgacgaccggaggacgtccgggtccgtagtacttacgtggtgcgaagacgtacgtcccggngacgtgagtggccggtacggtcgtagggtacctttacgtttacgaacgtttacggtcggggaccgtacggggtaaccctcggtaccgtacccgtcgtacccgtccgaccgtccctacccgaacccggaaccggtccccgtaacgttcccggttacccccttccccggtaccgggtcccctaccccggtccgtacccgtccggaccgggtaccgacccgtaccccgtaccgggacctaccggtaacccgg

SEQ ID NO: 253382 - DNA, 614 bp, Homo sapiens
  misc_feature: GYAE6OF02GRQED.21.53.E09.1.454.CMB.1.raw
  modified_base (333)..(333): a, c, t, g, unknown or other
  misc_feature (333)..(333): n is a, c, g, or t
  modified_base (409)..(409): a, c, t, g, unknown or other
  misc_feature (409)..(409): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctctggattcaccttcagtgactactacagtgggctggactccgccaggcctccgaaggggagggctgggagtgggtctcatatattagtagtagtggtagtcccgtatactacgcagactctgtgaaggccatcaccatcgcagggacaacgccaagactcaacagtanctgcagatagaatagcctggacgaggaccgaggactcggtaccgtgtacttacgtgtcgacgagagacgtcccggngatgagtggcggacggtcgtaggttacttacgtttgtaacttacggtcggggaccgtaacgggacccgttcgggtacctacccggttctcccgtaccgacgtccctacccgaaccgaaccggccctacgtccggttcccgttccccggtacggcccgtcccgtcgtcccgtaccgaggaccgtccgacccgtccggagtacccgg

SEQ ID NO: 253383 - DNA, 674 bp, Homo sapiens
  misc_feature: GYAE6OF02G9OWH.21.53.E09.1.454.CMB.1.raw
  modified_base (182)..(182): a, c, t, g, unknown or other
  misc_feature (182)..(182): n is a, c, g, or t
  modified_base (333)..(333): a, c, t, g, unknown or other
  misc_feature (333)..(333): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagccctcggattcaccttcagtnactactacatgggctggatcccgccaggctccgaggggagggctggagtgggtctcatatattagtagtagtcggttacgtcccgtataacctacgcagactctggtgaagggcctattccaccatccgccagggaaccaaccgcccaaanaacctcaacagtactctacggcaagatagaactacgccgtaggaacggacgacccggaggtacccgccggtaccgttgtaactttacgtgtaggccgaaggtaccggaccgtccccggtgagtggagtcgggacggacggtcgtacggttacttagtttcgtagttcggtcgggtacccgtaccgggtacccgtcggtaccgtaccgtccttcccgactaccgtaccctacccgaacccggaaccggcccctacgttcccgttcccgttccccggtacgggccctccccgtcgtacccgtaccggacgaccgtaccctacccggtacccggacgaccgccg

SEQ ID NO: 253384 - DNA, 760 bp, Homo sapiens
  misc_feature: GYAE6OF02IQKGH.21.53.E09.1.454.CMB.1.raw
  modified_base (231)..(231): a, c, t, g, unknown or other
  misc_feature (231)..(231): n is a, c, g, or t
tcagtcgtcgctcgcacgaccggtgctcgatttagagagagtgtgttgggtttgggttttccttgttgctattataaaggtgtccagtgtcaggtgcagttggtggagtctggggggaggcttggtcaagccgtggagggtccctgagactctcctgtgcagcctctggacttcaccttcagtgactactacagtgggctggactccgcaggcctccgagggagggctggngtggtctacatatattagtagtagtggtacgtcccgtatacgtacgcagtactcgtagtacggaacgggtccattccacccgagttaccggacccggaaggggaaccaacccggaccaaaggtaaccctaccaacgtacgttaacgcctaccgggactaggaacgttaggaaccttaaggcccgtaagggaccgtaacgggaccgtagggtacccgttcgggaccgtttacgtagtttaccgcggttacggaccggtaagtacccgggtacgtacccgggtcggaagttacgggacgttgggtaccgtacgggtacgttacggttacggttaacgtttacgtacgggtaccgtcggggacctaccgggtaccctcggtaccctccgtacccttccggtaccgtaccgtcccgtaacccgacccgtaacggtcccccgttacgtcccggtttacccggttccccggtccggtcccgtaaccgttccgaccgtcccgaccggtaccgaccgaccgttaccggacgtacccg

SEQ ID NO: 253385 - DNA, 650 bp, Homo sapiens
  misc_feature: GYAE6OF02JP4VP.21.53.E09.1.454.CMB.1.raw
tcagtcgtcgctcgcacgaccggtgctcgatttagagagagtgtgttgggtttgggctgagctgggtttccttgttgctattataaaaggtgtccagtgtcaggtgcagttggtggagtctgggggaggcttggtcaagcctggagggtccctgagactctcctgtgcagcctctggattcaccttcagtgactactacatggctggatccgcgagctccgagggagggctggagtgggtctcgatatattagtagtagtggtacgtccgtatactacgcagactctgtagaaggtccagttcaccgtatccgaccgtagggaccaacggccaaaaggacctcaacgtagtatcgtagacaagactagaatacgcctaggagtacgaccgaggtaccgtcgggaccgttagttacgttacgtaggtacgacgtaagacgacgtaccggacgtagtggaacgtgggacgtacggctaggttacttagttgaactttacggtcgggacccgtaacgggacccgttggtacccgaccgttcgtacccgtgaacccggtccttacccggaaccggtaaccgggtaccctaggttccccggttcccttaccccggcggttacccgcccgtcgtacccgttaccgagggtaccccg

SEQ ID NO: 253386 - DNA, 631 bp, Homo sapiens
  misc_feature: GYAE6OF02FOHQR.21.53.E09.1.454.CMB.1.raw
  modified_base (174)..(174): a, c, t, g, unknown or other
  misc_feature (174)..(174): n is a, c, g, or t
  modified_base (199)..(199): a, c, t, g, unknown or other
  misc_feature (199)..(199): n is a, c, g, or t
  modified_base (353)..(353): a, c, t, g, unknown or other
  misc_feature (353)..(353): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggagcttggtcaagcctggagggtccctgagactctcctgtgcagcctntggattcacttcagtgactactacngtgggctggactccgcaggctcgagggagggctggaggtggtctcatatagttagtagtagtggtacgtccgtatactacgcacgactcgtggtaggacggggccattccacagtccgccgagggacaaccgccaaagaactcacagtactcgngcaagatagtaactacgcctaggagacgcggaacggacgtccggtccgtgttaacttacgtgtcggacgaggtacgtcgtccggacgtagtcgagtcgggcggtaccggcttcggtaacttcgttaggtacgttacgggtacgggaccgacgggtaccgtcggtccgtaaccgttcctacgtcgaccgtcccgtaacccgaccgggaaccgtcccgtacggttcccgtccccgttcccgtccggacccgtcccgtccgacccgtaccgacgtacccgg

SEQ ID NO: 253387 - DNA, 821 bp, Homo sapiens
  misc_feature: GYAE6OF02JDXF2.21.53.E09.1.454.CMB.1.raw
  modified_base (191)..(191): a, c, t, g, unknown or other
  misc_feature (191)..(191): n is a, c, g, or t
tcagtcgtcgctcgcacgaccggtgctcgatttagagagagtgtgttgggtttgggttttccttgttgctattataaaaggtgtccagtgtcaggtgcagttggtggagtcgtgggggagcttggtcaagcctggaggtccctggagactctcctgtgcagcctactggattcaccttcagtgactactanagtcgggctaggactccgcaggcctacgagggagggctggagtcggtctacgatagttagttagtaggtagtcggtacgtcccggtatacgtacgacgtacgtactctaggttacggaacgggcccgttaattcctaaccacggtaccgacccgaagggaacccgaaaccgaccctaaaacgtaaccgttaccacgtaacgtccgttaactacggcgtaacgtacgttaaggaacttacgtacgtcggaacgtaacgggccgtaaggaccgcgggtaccgtagtacgtttaacgcggttacgaccgggaaggaccgtaccggtaaccgggtaccgaacggtacggtacgacgggtacggaacggttacggttacggtaaccgttacgttacggttaagtttaaccggacggggttaacccgacccggggttaaccggtacccgggttaccgtaccccgggtttaccgttacccgtaaccgtacccgttaacccgtaaccttaaccccgggaacccggttaccctacccgggtttccgtttcccccggtccccgtccggtacccgttccccggccgttcctacccggggtaacggtcccgacccccgtaccggaccctaggggtaaccccg

SEQ ID NO: 253388 - DNA, 619 bp, Homo sapiens
  misc_feature: GYAE6OF02JYWQH.21.53.E09.1.454.CMB.1.raw
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattcaccttcagtgactactacatgggctggatccgccaggctccagggaagggctggagtgggtctcatatattagtagtagtggtagtcccgtatactacgcagactctgtgaagggccattcaccatcgccagggacaacgccaagaactcacagtactctgcagatgaatagcctgagngaccgaggactcggctgtattacngtagcgagagacgtccggcgtatggactgggccggacgggtcgtacgggttacttacgttagtaacgtttacggtcggggacccgaacgggtacccgtgggtacctacccggtccttccgtaccgacgtccccgtaccacccgaacgggtcccctaacgtcccggttccttacccccgtcggcccgtacccgtcgtcccgtaccgacggtaccgaccctcccgtaccggtacgaccgtacccg

SEQ ID NO: 253389 - DNA, 733 bp, Homo sapiens
  misc_feature: GYAE6OF02JL1G3.21.53.E09.1.454.CMB.1.raw
  modified_base (288)..(288): a, c, t, g, unknown or other
  misc_feature (288)..(288): n is a, c, g, or t
tcagtcgtcgctcgcacgaccggtgctcgatttagagagagtgtgttgggtttgggttttccgtttgttgtctattataaaaggtagtccagtgtcaggtgcagttggtggagtctgggggagggcgttggtcaagcctggagggtccctgagactctcctgtgcagcctccggattcaccttcagtgactactacatgggctggatccgccaggctccaggggaagggctggagtgggtctcatatattagtagttaggtggtacgtccgtatactacgcagacctntgtgaagggccgattcaccagtccgcccgtaaggggacaaccgccaaacgaactcacagtatctgactaagatagaaatacgcctaggaacgaggcccggaggaccgtccgggtaccggtttgggtaaactttacgtgggtacgggccgtaagggacggaccgttaccccgggaggtaacgtacggtaggtacgggtcggacgggtcggtacgggtacgtttaaccgtttgtaacgtttaccggtcggggtacccggtacgggtaaacccggtcgggttaccgtacccgttccgtaccctaccgtaccgtaccctcccgaaaccgtaaccgggaccctacggtaccggtttcccttcccccgggtccgggtacccgtccccgtacggtcccgttacccgggaacggtaccggccgtaaccccggtaccggtaccgacggtacccg

SEQ ID NO: 253390 - DNA, 718 bp, Homo sapiens
  misc_feature: GYAE6OF02GFAB3.21.53.E09.1.454.CMB.1.raw
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
tcagtcgtcgctcgcacgaccggtgctcgatttagagagagtgtgttgggtttggttttccttgttgctattataaaaggtgtccagtgtcaggtgcagttggtggagtctgggggaggcttggtcaagcctggagggtccctgagactctcctgtgcaagcctcggacttccaccgttcagtgactactacatgggctgggatccgccaggctccaggggagggctgggagtggtctcgaatactagttagtagttaggtggtacgtcctagtactacgcagacctgtgtaggacggcctactacacgtcgtccacggaacggaccaaccgacgtaaacgtacctacacgtaagtccgttntagaccgtaagtcgtaaacgtacncgttaccgaggtaacgcggaccggtaggtacccgtcggaaccggttntaaccgttggtacggnggacgagtaccgtccgaccggtatacgtggacgtcggacgacgttcggtacttacggttgttacgtaacggttcggaccgggtaccgtaaccggtccgtacggttaccctaccggttcccttccgtaccggtacccgtttacccgaacccggttaacccggaaccggtaccccgtacggtttacccccgtcccggtttacccgccgggtacccctcccgttaccgcccgtacggaccggtactccccgaccggtacaccgagtacccgg

SEQ ID NO: 253391 - DNA, 675 bp, Homo sapiens
  misc_feature: GYAE6OF02HAI9J.21.53.E09.1.454.CMB.1.raw
  modified_base (390)..(390): a, c, t, g, unknown or other
  misc_feature (390)..(390): n is a, c, g, or t
tcagtcgtcgctcgcacgaccggtgctcgatttagagagagtgtgttgggtttgggctgagctgggttttccttgttgctattataaaaggtgtccagtgtcaggtgcagttggtggagtctgggggaggcttggtcaagcctggagggtccctgagactctcctgtgcagccttctgattcacttcagtgactactacagtagggctggactccgccgaggccgtccgaaggggaaggggcgtgggaggtcgggtctacgataattagttagtagtaagtggtacgtacccgtataacgtacgcaagcttcgtggtaggaagggcctacttccgaccacgtccgaccgaaggaaccgaacgaccaaaagaaccctacgtaacaagtacncgtacgacaagtagtagtaaacgtacgccgtaggaacggtacggaacggacggtaaccgtccggtacgtttagttaacttacgtggtcgacggtaacggagtacccggtccgagtacgtggtacggtcggaccggtacggtacgtacggttaccttagttacgtagttaccgggtcgaccggtaccgtacgtcgtcctaccgtctcgacgccgtacctaccgacccggacgtaccgtacgtcccgtcccgttcccgtcgccgtcccaccgccgtcggagtacccg

SEQ ID NO: 253392 - DNA, 684 bp, Homo sapiens
  misc_feature: GYAE6OF02F1BRB.21.53.E09.1.454.CMB.1.raw
  modified_base (339)..(339): a, c, t, g, unknown or other
  misc_feature (339)..(339): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctgtgcagcctccggattcaccttcagtgactactacatgggctggatccgccaggctccgagggaagggctggagtgggtctcatatattagtagtagtggtacgtccgtatactacgcagactctgtagaacgggcctattcaccatccgccgagggacaacgccaagaacctcacagtatcngcagatagaatacgcctagagacgccggaggactcgggccgttagttacttacgtgtcgacggaagacgaccgtccccggagtagtggtacggtcgggaccggacgggtaccgttacgggtacctttaacgtttagtaacgtttaccgggcgggggtaacctaaccggggtaaccctggggtaccctacccgtccttcccgtaccgacgtacccctacccgacccggtaaccgggcccctaccggttcccgttcccgttcccccggtcgggtacccccgtcccggtccgtacccgcccggaacgggtaccctaccccggacccgtacccggagtaccgaacccgg

SEQ ID NO: 253393 - DNA, 780 bp, Homo sapiens
  misc_feature: GYAE6OF02IGZYS.21.53.E09.1.454.CMB.1.raw
  modified_base (151)..(151): a, c, t, g, unknown or other
  misc_feature (151)..(151): n is a, c, g, or t
  modified_base (178)..(178): a, c, t, g, unknown or other
  misc_feature (178)..(178): n is a, c, g, or t
  modified_base (383)..(383): a, c, t, g, unknown or other
  misc_feature (383)..(383): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggagcttaggtccaagcctggaggtccctgagctcncctgtgctagctcgtggattcaccttnagtgtacctactactagtgggctacggcttcccgccaggtccgtaccgaacggggagggtcgtggaggtcggtctctatataagttacggttataggcggttacgtacccgtatacgtaccgctacgaccgttcgtgtacggtacgggaccgtacttaccgaaccgactcccgggacccgagggtaccgaaccgtaccccgaaanaaccgtacaccgtagttacctcgtacgtacacgattaacgacgtacgtacccgtacgaaggtaccgaccgggtaacggtaacgtcccgggtacggttacgttaagttcgtaggttacgacggtagtacgtacggtacccggacgtacgtagaacgtggaccggtacgtaccgtacgttacgttacgtttaggtaacgttacggtacgggtacccgtaccggtaacccggtcgttacccgtcccgttacctacccgtacggacctcccgtacccggaaaccgtacccggtacctacccgttacccggttcccccgttaccccgggttccggtaccccgtacccccggtcgtacccgtacccggtacgtccacccgaccgttaccccggagtaccccgg

SEQ ID NO: 253394 - DNA, 722 bp, Homo sapiens
  misc_feature: GYAE6OF02IDU56.21.53.E09.1.454.CMB.1.raw
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (370)..(370): a, c, t, g, unknown or other
  misc_feature (370)..(370): n is a, c, g, or t
tcagtcgtcgctcgcacgaccggtgctcgatttagagagagtgtgttgggtttgggttttccttgttgctattataaaaggtgtccagtgtcaggtgcagttggtggagtctgggggaggcttggtcaagcctggagggtccctgagactctcctgtgcagccctccggattcacctttcgagttgacttacctaacagtgggcctggactccgccaggctccgaggggaagggctgggagtgggtctcgatatattagagtagtggtagtcccgtatactacgcanctcngtggacggtaccgattcccacagtccggaccgaacgggaaccaaccgacccgaaagaacctacaaccgttagtacttcngaccgaagataggtaactacgtaccgtggaacgacggtaccggaacgggacccgttacgggtaacccggttagtttaaccgttacgttcggggtacgacggagttaacggaccgttcccggacgtagtaggtacggtagggaccgtaccggtgtacgtacttagtttcgtagttcgggtacggtaccgacggtacccgtgtacccgtaccttccgaccgttacgccgtaccccttaccgccggaaccgggtacccgtaccgtaccccggttcccttcccccgggcgtaccccgtcccgtccggttaccgacccggacgaccggtacccaccccggtaccgacgacgtacccg

SEQ ID NO: 253395 - DNA, 776 bp, Homo sapiens
  misc_feature: GYAE6OF02GCRTY.21.53.E09.1.454.CMB.1.raw
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (377)..(377): a, c, t, g, unknown or other
  misc_feature (377)..(377): n is a, c, g, or t
tcagtcgtcgctcgcacgaccggtgctcgatttagagagagtgtgttgggtttgggttttccttgttgctattataaaaggtgtccagtgtcaggtgcagttggtggagtctggggggaggcttggtcaagcctggagggtccctgagactctcctggtgcagcctccggattcaccttcagtgactactacagtggcctggactccgccaggtcctccgaagggtaagggggcttgggaagttggtcctnaattactagttacgagttacggtggtactcccgtaatacctaccgnaagtcctcgtgtacggaacggtccgattaccgacctagtaccgaccgaacgggaacaaccggacctaaacgaaaccgttnaaaccgtaggtaaccttcgtagtaccgaagtagtagtaaaacgcgtaccgtacgaaacggcgtaacccggagggtaacccgccggggtaaccggtagttaaacccttgtacgtacggacgaagtaccgtaacgtcccggtacgacgtagtacggacggtacggacggtcgtacggtaacttacttaggtacgttacgggcgggaaccgtacgggtaaccgtcgtaccgaccggttcctacccgtcgaccgtacccgtaccgtaccggtaacccgggtaccctaccgggttccgttaccccggtcccccggttacggacccccggtttccggaccgtttacccgaccgggttaaccggccgaacccgttaacccggtcccgtaggaaccccgttaccggg

SEQ ID NO: 253396 - DNA, 657 bp, Homo sapiens
  misc_feature: GYAE6OF02I705T.21.53.E09.1.454.CMB.1.raw
  modified_base (175)..(175): a, c, t, g, unknown or other
  misc_feature (175)..(175): n is a, c, g, or t
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (452)..(452): a, c, t, g, unknown or other
  misc_feature (452)..(452): n is a, c, g, or t
tcagtcgtcgctcgcacgaccggtgctcgatttagagagagtgtgttgggtttgggctgagctgggttttccttgttgctattaataaaaggtgtccagtgtcaggtgcagttggtggagtctgggggagcttggtcaagcctggagggtccctgagactctcctgtgcagcctntgattccaccttcagtgactactacntgggctggatccgaccgagcctaccgaaggggaagggctggagtggtctnatatattagtagtagtggtacgtacccgtaataccgtacgctagacctcgtgtaggaacggccgtattccaccatcgacgaggacaacgcaaagacnacagatcngacgagactagaatacgtctagacgtacgccggaagaccgtccggccgtttagttaacgttacgtgtacggagaacggacgtacggtacccggganaacgttagaacgtgggaccggtaccgggtacgttacgggttaacctttacgtttagtaacgttacggtacgggtacccgaacgggtaccccgttacggtaccctaccgttccgtacctacgtaccgtacctacccgacccgaaccggaccctacgtcccgttcccgttccccgtccgccggtccctcggaccttccgacgtaccg

SEQ ID NO: 253397 - DNA, 504 bp, Homo sapiens
  misc_feature: GYAE6OF01EFEO8.51.40.D07.1.454.CMB.1.raw
  modified_base (396)..(396): a, c, t, g, unknown or other
  misc_feature (396)..(396): n is a, c, g, or t
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaacgcccctaaactcctgatctacgatgcatccaatttggaaacagggtcccatcaaggttcagtggaagtggttctgggacagtattttacttcaccatcagcagtcccttcaccctgaanatcttgacaacatattactgtacaacagtatgaattaatcctacccactcctacgtttcggcgggaggaccgaagggtgagatacaaacgactggtaggactgcacta

SEQ ID NO: 253398 - DNA, 512 bp, Homo sapiens
  misc_feature: GYAE6OF01C2GKM.51.40.D07.1.454.CMB.1.raw
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgagacattagtaactatttaaatgtatcagcagaaaccaggcaagcccctaaactcctgatctacgatgcatccaattaggaacagggtcccatcaaggttcagtggaagtggttctgggacagtattttacttctacatcagcacggggccttctaccctacgaagatcttgacaacaataattactagtacaacaagtatagtaataatactacctactctacttcggtacggagggaccgaaggtaggaggatacaaacgaacgtagtagatcgcgactac

SEQ ID NO: 253399 - DNA, 486 bp, Homo sapiens
  misc_feature: GYAE6OF01AG68U.51.40.D07.1.454.CMB.1.raw
  modified_base (424)..(424): a, c, t, g, unknown or other
  misc_feature (424)..(424): n is a, c, g, or t
  modified_base (463)..(463): a, c, t, g, unknown or other
  misc_feature (463)..(463): n is a, c, g, or t
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacagggtcccatcaaggttcagtgaagtggttctgggacagtattttacttcacctatcaagcagccttcaccctgaagatcttgcaacatattactgtacaacagtangtataatctcccatcacttcgcggaggaccaaggtgganatcaaagactgtcggatgcacta

SEQ ID NO: 253400 - DNA, 886 bp, Homo sapiens
  misc_feature: GYAE6OF01BWVWX.51.40.D07.1.454.CMB.1.raw
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaatggtatcagcaagaaaccgagggacaacgaccctaaactcctagatctaacgatcgactatacctaaagttttacgggaaaaccgtacggggttaccccaagttaccgtaaaacgggtttccaaagggttaggggtaaacgggtttcggggttttaccgtacggggggtaaaccttaaagggtttaaacttttttttaacccgtttttaccgaaaccctaactttacccggaaacggtacccgtaaacgggttaccccccttttaacccgtaaaccccccgtttaagggtaaaaccggtaacttttacccgttttaacgggaaccccttaaaaaccgttaacttttaaaacctttttaaccgttacgggtttaaccctaaaaaccgttaagggttttaaacttaagggttaaaacctttaaaacctttcccccttaacccccgtaacccttttacccgtttaaacccgggttttttacccgggggaaacccgggggtaaaacccgggggtaaaccccgttaaaaggggggttagggtaaacggtaaaccgttaaaacccggtaaaaaccgggttaaaccgtttacgggttacgggggtaccctttaacggggaaccccttaaaccccttaaacgg

SEQ ID NO: 253401 - DNA, 581 bp, Homo sapiens
  misc_feature: GYAE6OF01C3YD9.51.40.D07.1.454.CMB.1.raw
  modified_base (496)..(496): a, c, t, g, unknown or other
  misc_feature (496)..(496): n is a, c, g, or t
  modified_base (573)..(573): a, c, t, g, unknown or other
  misc_feature (573)..(573): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcactgccaggcgagtgagacattagtaatatttaatgtatcagacaagaaaccgaggaccaaacgaccctaaactcctagactactaacgatcgactaactacctaagtttaacggaaacgaacggggtacccaagtacgtaaaggttacgaaggtacggtaaggttggttacgtagggtaactagttaacttttacctttacacctaatcagtacacgtccctttacaaccctagaacgtactacgtagaccaactattacgttaactgtaacaactagtanagtaatactctaccactcgtacgtttcggacggaacggacgaaggtaggaatacaacgaaactagtacgtgactacnccgactac

SEQ ID NO: 253402 - DNA, 498 bp, Homo sapiens
  misc_feature: GYAE6OF01DXQ44.51.40.D07.1.454.CMB.1.raw
  modified_base (373)..(373): a, c, t, g, unknown or other
  misc_feature (373)..(373): n is a, c, g, or t
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaaccagggcaaagcccctaaaactcctgatctacgatgcatccaatttggaaacagggtcccatcaaaggttcaagtggaagtggttctgggacagattttactttnaccaatcagcagcccttcaccctgaagatcttgcaacatattactgtcaacagtatgataaatctcccactcactttgcgagggaccgaaggtggagatacaaaacgaactagtggactgcacca

SEQ ID NO: 253403 - DNA, 538 bp, Homo sapiens
  misc_feature: GYAE6OF01DKYON.51.40.D07.1.454.CMB.1.raw
  modified_base (324)..(324): a, c, t, g, unknown or other
  misc_feature (324)..(324): n is a, c, g, or t
  modified_base (384)..(384): a, c, t, g, unknown or other
  misc_feature (384)..(384): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggacaaagcccctaaactcctagatctacgatgcataccaatttggaaacgngggtccatcaaggttcagtggaagtggtctgggacagtattttacttcactatcaagcanccttcaccctagaacgtatcttgacaactattacttactgtacaaactagtaattgtaataacttcctaccctactcctacgtttcgggacggaagggtaccgtaagggtggaagataaccgaaacgaacgttggacggctacgcctaactacg

SEQ ID NO: 253404 - DNA, 516 bp, Homo sapiens
  misc_feature: GYAE6OF01EGZHA.51.40.D07.1.454.CMB.1.raw
  modified_base (409)..(409): a, c, t, g, unknown or other
  misc_feature (409)..(409): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaacgcccctaaactcctgactctacgatgcataccaatttaggaaacagggtcccatcgtaaggttcaggtaggaagtggttctgggactagtattttacttcaccatcagcacgtcccttcaccctgaacgtntcttgacaactattattactgtacaacagtatgaattatctcccatcacttcggcggaggaccgaagggtggaagatacgaaaacgacgttgtacggctgccactac

SEQ ID NO: 253405 - DNA, 595 bp, Homo sapiens
  misc_feature: GYAE6OF01AOP4X.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgagactattagtaactatttaatgtatcagacaagaaaccgaggacaaccgacccctaaactccgtagactactaacgatcgactactacctaagttacggaaacggtacggtaccatacgtaaggttacgaggtaggtaaggttggttacgtagggaactagttacttttacttaccactatacgagctacgttccctaccaccgtagaacgtcttactacgactaactattacttactagtaaccaatagttatagtaacttaactcctaccctatcttacggttcggacgggaacggacggtaaggtaggaacgtactaaccgaaacgtacgtcggtacggtacctacgacgttaacccgtcg

SEQ ID NO: 253406 - DNA, 616 bp, Homo sapiens
  misc_feature: GYAE6OF01BP16A.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctggtaggagacagagtcaccatcacttgccaggcgagtgaggacattaagtaactatttaaattggtatcagcaagaaccagggacaacgacccctaaactcctagatctacgatgactactacctaagtttacgggaaacgtacggggtacccaagtacgtaaggttcgtaggtagggtaaggttgggttacgtagggtaactagttacttttactttaccaactactcacgtcctacgtcccttaccacctagaatacttactagacctaatattaacttacgtacgtacaactagttaatagtaacttaaccttccctaccctacttccgtaccggttaccgggacgggaaccgggtaacggtaagggtaggacgtaacgtaacgaaacgtacgtacggtacgacgtacgaccgtactacg

SEQ ID NO: 253407 - DNA, 537 bp, Homo sapiens
  misc_feature: GYAE6OF01EJPPD.51.40.D07.1.454.CMB.1.raw
  modified_base (351)..(351): a, c, t, g, unknown or other
  misc_feature (351)..(351): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacagggtcccatcaaggttcagtggaagtggttcngggacagtattttacttcacatcagcagcccttcaccctgaagattcttgacaaacattattactgtacaaacagttatgaattaactcctacccacttctacgtttccgggacgggtaagggaacccgaagggtggaagtataccgaaaacggaacttgggtacggacctcggccaacccgtacg

SEQ ID NO: 253408 - DNA, 496 bp, Homo sapiens
  misc_feature: GYAE6OF01DQ1QL.51.40.D07.1.454.CMB.1.raw
  modified_base (347)..(347): a, c, t, g, unknown or other
  misc_feature (347)..(347): n is a, c, g, or t
  modified_base (492)..(492): a, c, t, g, unknown or other
  misc_feature (492)..(492): n is a, c, g, or t
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagccctaaactcctgatctacgatgcatccaatttggaaacagggtccatcaaggttcagtgaagtggttcngggacagtatttacttcacatcagcagcccttacaccctgaagattcttgcaacatattatgtacaacagtatgtaataactctacccatctactttcggcggaggaccgtaaggtggagatacaaacgaactgtaggactcgcnctac

SEQ ID NO: 253409 - DNA, 497 bp, Homo sapiens
  misc_feature: GYAE6OF01A3B6N.51.40.D07.1.454.CMB.1.raw
  modified_base (391)..(391): a, c, t, g, unknown or other
  misc_feature (391)..(391): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttaggaaacagggtccatcaagttcagtggagtgttctgggacagtatttacttcacctatcagcagccttcaccctgaantctgcaacatattactgtacaacagtatagtataatcctaccactctactttcggacggtacgggaccaagggtgaagactacaaacgactgtggactgcactacg

SEQ ID NO: 253410 - DNA, 492 bp, Homo sapiens
  misc_feature: GYAE6OF01A9A87.51.40.D07.1.454.CMB.1.raw
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgccatctgtaggagacagagtcaccatcacttgccaggcgagtgaggacattagtaactatttaaattggtatcagcagaaaccagggcaagccctaaactcctgatctacgatgcatccaatttggaaacagggtcccatcaaggttcagtggagtggttctgggacagtattttactttcaccatcagcagccttcaccctgaantcttgacaacatattacngtacaacagtatgataatctcccactcacttcggcggaggaccgaagggtgagctacgaaacgactggtgctgcactacg

SEQ ID NO: 253411 - DNA, 526 bp, Homo sapiens
  misc_feature: GYAE6OF01BNVD2.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaagtttggaaacagggtcccatcaaggttcagtggaagtggttctgggacagtattttacttcacatcagcagcccttcaccctagaacgtacttctttagacctaaactattaactttactgtacaactagtaatagtaattaactcctcccactctacgtttcggcggaaggaccgtaaggtggagtacacgaaacgacgtgtagctcgcacctacg

SEQ ID NO: 253412 - DNA, 514 bp, Homo sapiens
  misc_feature: GYAE6OF01C0THJ.51.40.D07.1.454.CMB.1.raw
  modified_base (318)..(318): a, c, t, g, unknown or other
  misc_feature (318)..(318): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccatcacttgccaggcgagtgaggacattagtaactatttaaattggtatcagcagaaccagggcaacgcccctaaatcctagatctacgatgcatccaatttggaaacngggtacccatacgaaggttcaagtggaagtggttctgggactagtatttacttcacctatcagcagtcccttacacccgtagaacgtattcttagactaactattacttactcgtacaactagtatagtatactctacccatctacgttcggcggaggaccgaaggtggaagatacaaagactgngctgcncgtac

SEQ ID NO: 253413 - DNA, 515 bp, Homo sapiens
  misc_feature: GYAE6OF01EUHPG.51.40.D07.1.454.CMB.1.raw
  modified_base (200)..(200): a, c, t, g, unknown or other
  misc_feature (200)..(200): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatcacttgccaggcgagtgaggacattagtaactatttaaattggtatcagcagaaaccagggcaagcccctaaactcctgatctacgatgcatccaatttggaaacagggtcccatcaaggttcagtggaagtggttctgggacagtattttacttcacatcagcagcccttcaccctgaagatcttgcaacattattactgtacaactagtaatgaattaactcctacccacttcacgtttcggacggaggtaccgaaggtggagtactacaaaacgtaacgtgtacggactcgccactacg

SEQ ID NO: 253414 - DNA, 695 bp, Homo sapiens
  misc_feature: GYAE6OF01CKWW4.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctggtaggagacagagtcaccatcacttgccgaggcgagtgaggactattagtaacttatttaatgtatcagcaagaaaccgagggaccaacgtacccctaaactcctagtactactaacgattcgacctaactaccgtaaagtttacgggaaaccgtacggggtaccccaagttaccgaaagggtttcgaagggttacgggtaaaggttgggtttaccgtaggggtaacgttaaggtttaactttttaccgtttaccaaccttacttccgaaacggtccaaccgttccccgttaccctaacccgttaaggaacgtacttccgttaacgacctaaacttattaacttacgtacgtaacaactaagtatacgtattaaaccttcctaccctacgttaccgtacggtttaccgggaccggggtaagggacccgtaaagggtacggaagtacgtaacccgtaaaacggtacgttacggtacggtacctacgtacccgtacgttaccg

SEQ ID NO: 253415 - DNA, 734 bp, Homo sapiens
  misc_feature: GYAE6OF01BXZVV.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaatggtatcagcagaaaccagggacaacgacccctaaactcctagactctacgatgactatacctaagtttacggaaacgtacggggtacccaagtacgtaaggttcaggtaggtaaggttgggtttacgtagggtaactaaggttactttttactttacaacctattccaagtccgtacggtacccctttaccgaaccccgttaggaaacgtactttaccgtttacgaaccctaaactaatttaacttttaaccgttacggttaacctaaaccgttaaggtttaacgttaacggtaaaactttaaaccttcccctttaacccccgtaaccgtttacccgttaacccgggttttttaccggggacccggggtaaacggggtaaccccgtaaagggggttacgggaaacgttaaacgttaacccgaaaaaccgggttaaccgtttacgggtacgggttaacctcgggaaccctaaccgttaaccgg

SEQ ID NO: 253416 - DNA, 572 bp, Homo sapiens
  misc_feature: GYAE6OF01EXDH8.51.40.D07.1.454.CMB.1.raw
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
tcagcgatcgtatacacgaccggtgctcgatttagtgatagagcgtaacaacaggaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgagacattagtaactattaatgtatcagcagaacagggcaacgaccctaaactcctagatctacgatgctatccaattggaaacagggtccatcaaggtcagtgagtgtcngganagtatttacttcactatcagcacgtcccttacaccgtagaacgnttacttnactaactattattaactgtacaactagtaactagtaattaacttccttacccgaacttaccgtaacgttttccggggacgggtaaacgggaacccgtaaaggggtaggaaaggtaactaaaccgtaaaaccggaacgtttagggtacgggtaccttacggaccctaaccgttaacg

SEQ ID NO: 253417 - DNA, 655 bp, Homo sapiens
  misc_feature: GYAE6OF01CBH8L.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcactgcaggcgagtgaggactattaagtaactaatttaaattggtatcagacaagaaaacccgagggacaaacgacccctaaaactcctagactactacgatcgacatacctaatttacggaaacgtacgggtacccaataccgtaaggtttacgaaggtggtaaggttcggttacgtaggggaactaaggttatttttaacctttacaaccctattacgacggtactacgtccctttacaacccgtaggtaactacgttcctttagacctaaactattaacgtttactagtaactaaactacgttaatacgtaattaaacctccttacccctaacttccgtaaccggtttaccggggaccgggtaaacgggtaaccgtaagggtacggaacgtaactaaccgaaaacggtacgtggtacggtactcggacctaaccgtacg

SEQ ID NO: 253418 - DNA, 543 bp, Homo sapiens
  misc_feature: GYAE6OF01A0YA4.51.40.D07.1.454.CMB.1.raw
  modified_base (350)..(350): a, c, t, g, unknown or other
  misc_feature (350)..(350): n is a, c, g, or t
tcagcgatcgtatacacgaccggtgctcgatttagtgatagagcgtaacaacagaggggggagtcagtcccaaccaggacacagcatggacatgagggtccctgctcagctcctgggggctcctgctgctctggctctcaggtgccagatgtgacatccagatgacccagtctccatcctccctgtctgcatctgtaggagacagagtcaccatcacttgccaggcgagtgaggacattagtaactatttaaatggtatcagcagaaaccagggcaacgcccctaaactcctgatctacgatgcatccaatttggaaacagggtccatcaagttcagtggaagtggttcngggacagtattttacttcactatcagcacgtccctttacaccctgaaagtacttcttagcctaaactattaacttactgtacaaactagttaactgtaacttaactcctacccactacctacgtttcggacgggtagggacccgaaggtaggaagtactacgaaacgtacgtggtacggactgccaccgtaag

SEQ ID NO: 253419 - DNA, 699 bp, Homo sapiens
  misc_feature: GYAE6OF01CU2GJ.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcacatcacttgccaggcgagtgaggactattagtaactagtttaaattggtatcagcaagaaaccagggacaacgcccctaaactcctgactctacgatcgctataccgaaagttttacggaaaaccgtacggggtacccaagttacgaaacgggtttccaaaggttagggaaaggtttcggggtttacgtaggggaaccttaaggttaacttttttaacctttccaacccgttaattcccgaaggtaccctaaccggtcccctttaccgaaccccttaggaaacgttacttccgtttacgaacctaaactaatttaacttacttaggtaaccaaagtacgtaagttagtaacttaacttcccgtaccctacttaccgtaccggtttccgggacggggtaacgggtaacccgtaaagggggtacgtaaacggtacgtaaaccgaaaaccggttacgtacgggttacgggtactacggaccctaaccgttacg

SEQ ID NO: 253420 - DNA, 522 bp, Homo sapiens
  misc_feature: GYAE6OF01AUO4O.51.40.D07.1.454.CMB.1.raw
  modified_base (419)..(419): a, c, t, g, unknown or other
  misc_feature (419)..(419): n is a, c, g, or t
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaaactcctgatctacgatgcatccaatttggaaacagggtccatcaaggttcagtggaagtggtctgggacaggtattttactttcacctatcagcagtcccttcacccgtgaagtatcttgacaacattattacngtcaaactagtattagaattaactcctaccctactcctacgtttccggacgggagggaaccaagggtgaaggatacgaaacgtactggtacggctgcacgtac

SEQ ID NO: 253421 - DNA, 680 bp, Homo sapiens
  misc_feature: GYAE6OF01CTIMU.51.40.D07.1.454.CMB.1.raw
  modified_base (199)..(199): a, c, t, g, unknown or other
  misc_feature (199)..(199): n is a, c, g, or t
tcagcgatcgtatacacgaccggtgctcgatttagtgatagagcgtaacaacagagggggagtcagtcccaaccaggacacagcatggacatgagggtccctgctcagctcctgggggctcctgctgctctggctctcaggtgccagatgtgacatccagatgacccagtctccatcctccctgtctgcatctgagganacagagtcaccatcactgccaggcgagtgagacattagtaactatttaatggtatcagcaagaaaccagggaccaacgacccctaaaactcctagacttctacgatgcaactcctaaagtttaggaaacgacggggttaccccaagttaccgaaaggtttaccgaaggtagggtaaggttgggtttacgtacggggtaactaaggtttaacttttacgttttaacctaccctaattaccaacggtacctaacggtaccccttttaccaaccccgttagtaacgtatttccgtttacgacctaaactaactttaacttaacgtacgttactaaacgtagttaactacgtaaattaaccttctaacccctacttacctaaccggtttcgggaccgggtaacgggaacccgtaaagggttaggaacggtaacgtacgaaaacggtacgtacgggttacggtaccgtacgtaccgaaccgttacg

SEQ ID NO: 253422 - DNA, 521 bp, Homo sapiens
  misc_feature: GYAE6OF01BFYGL.51.40.D07.1.454.CMB.1.raw
  modified_base (350)..(350): a, c, t, g, unknown or other
  misc_feature (350)..(350): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (475)..(475): a, c, t, g, unknown or other
  misc_feature (475)..(475): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggggccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaacaggggtcccatcaaggttcagtggaagtggttntgggacagtattttacttcaccatcagcagccttcacctagaagtactcttgacaactatatactntacaanagtatgatactcctccactctacttcggacggtagggaccgtaaggtcggaanagtaccgaaacgtaactggtacggtctaggacctaccgtgttaccg

SEQ ID NO: 253423 - DNA, 603 bp, Homo sapiens
  misc_feature: GYAE6OF01AHC8I.51.40.D07.1.454.CMB.1.raw
  modified_base (426)..(426): a, c, t, g, unknown or other
  misc_feature (426)..(426): n is a, c, g, or t
  modified_base (453)..(453): a, c, t, g, unknown or other
  misc_feature (453)..(453): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagacaagaaaccgagggaccaacgacccctaaactcctagtactctacgatgcatacctaagtttaggaaacgacgggtcccaagtcaaggttcagtggaagttggttcgtagggactagtattttacttacacctatcagcacgtcccttacaccctagaacgtntcttagacctaaatacttatttaaccngttaaccaacgtaacgttatacgtaacttaacgtcccttaccctaccgtaccgttaccgtttccggggaccgggaacggggtaacccgtaaggggtacggaagtaacgtaaccgaaaacgtacgtggtacggacttcggacctacgtacg

SEQ ID NO: 253424 - DNA, 655 bp, Homo sapiens
  misc_feature: GYAE6OF01D174L.51.40.D07.1.454.CMB.1.raw
tcagcgatcgtatacacgaccggtgctcgatttagtgatagagcgtaacaacaggaggggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagatcaccatcactgccgaggcgagtgagactattaagtaactaatttaatgtatcagcaagaaccgaggacaacgacccctaactcctagtactactacgatcgactacttaccgtaagtttacggaaacgtacgggtaccctaatacgtaaggttacgaggttaggtaaggttcgggttcgtaggggtacttaagttactttttaccttacaacctatacgagacctagttccccttccgacccgtagaaacgtacttaccgttagacctaaacttactttaattaccgtagtaactaaacgtagttatagttaacttaaaccttccctaacccctacttaccgttacccgggtttacgggaccggggtaacggtaaccggtaaaggggttcggaagttaacgtaaccgaaaaccgtacgttgggaccggtactacgcctaaccgtacg

SEQ ID NO: 253425 - DNA, 603 bp, Homo sapiens
  misc_feature: GYAE6OF01ASHEV.51.40.D07.1.454.CMB.1.raw
  modified_base (202)..(202): a, c, t, g, unknown or other
  misc_feature (202)..(202): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgacccagtctccatccctccctgtctgcatctgtagganacagacgtcaccatcacttgccgaggcgagtgaggactaattagtaacttatttaaagttggtatcagacaagaaaccgagggacaaccgacccctaaactcctagactacgtacgatgactactacctaagtttacggaaacgtacgggtacctagtacgtaacggttacagggtaggtaaggttcggttacgtagggtacgtagttacttttacttactacctatacacgtactacgtcccttacacccgtagaactcgttactacgaacctaactattacttactatactaactagtatagtatacctcctacctactcgtacgttcgggacggtacggaacgtacgggtaggacgtacgtaacgaaacgacgttaggtacgactcgaccgtcgtacg

SEQ ID NO: 253426 - DNA, 549 bp, Homo sapiens
  misc_feature: GYAE6OF01CUMIU.51.40.D07.1.454.CMB.1.raw
  modified_base (362)..(362): a, c, t, g, unknown or other
  misc_feature (362)..(362): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggacaagccctaaatcctgatctacgatgcatcctaattggaacagggtccatcaagttcagtgaagttggtctggatagtatttacttnactatcagcagccttcaccctagagtatcttgacaactatattactgtacaacagtatagtataactcctacccgtactccgtaaccgtttcgggaccggtaacgggaccgaaacgggggtagaacggtaacgtaaaccgtaaaacggtacgttacgggacggttacctcggtacccaacgttaacg

SEQ ID NO: 253427 - DNA, 539 bp, Homo sapiens
  misc_feature: GYAE6OF01EYVIK.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaatgtatcagcaagaaccaggacaacgcccctaaactcctagactctacgatgcatcctaatttacggaaactacgggtcccatcgtaaggttcagtggtaagtggttctgggactagtacttttacttcacctatcagctacgccttacaccctagaatacttcttacgactaactatattactgtacaactagtatagtaactaactcctacctactctacgtttcgggacggagggtaccgaagggtagagtacacgaaacgtacgtggtacggactgccactacg

SEQ ID NO: 253428 - DNA, 765 bp, Homo sapiens
  misc_feature: GYAE6OF01DYVRJ.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgacccagtctccatccctccctgtctgcatctgtaggagacagagtcaccatcacttgccgaggcgagtgaggactattaagtaacttaatttaaattggtatcagacaagaaaccgagggaccaacgtacccctaaactcctagacttacgtaacgatcgactactacctaaagttttaacggaaaccggtacggggtaccccaagttacgaaagggtttacaagggttagggtaacggtttgggtttacgtaggggtaactaaggtttaactttttaccgtttaccaacctaattccgaacggtcctaacgttaccccctttaccgaaccccgttagggtaaacgttacctttaccgtttacggaaaccctaaaacgttaacttttaaaccgttttaaccgtaccgggttaacctaaaacgttaaggttaacttaggtaaacctttaacccttcccgttaaccccctaacgttcccgttaacccgggtttcgggggaaccgggtaacggggtaacccgtaaagggggtacggaacgtaacgtaaaccgaaaaccggtacggttacggttacgggaccctttacggacctaacccgttacg

SEQ ID NO: 253429 - DNA, 544 bp, Homo sapiens
  misc_feature: GYAE6OF01E2NWR.51.40.D07.1.454.CMB.1.raw
  modified_base (352)..(352): a, c, t, g, unknown or other
  misc_feature (352)..(352): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattaagtaactatttaaattggtatcagcagaaccagggcaacgaccctaaactcctgatctacgatgcatccaatttggaaacacgggtcccatcaaggtcaggtggaagtgttcngggacagtacttttacttcactatcagcacgtcccttcaacccgtgaacgtacttcttgaccaaactattaactttactgtacaactaagtatagaattaactccttaccacttctacgtttccgggacggaacgggacctaagggttgaagtacgtaaccgaaacgtacgtggtacggctcggctaccgta

SEQ ID NO: 253430 - DNA, 736 bp, Homo sapiens
  misc_feature: GYAE6OF01BP7VX.51.40.D07.1.454.CMB.1.raw
  modified_base (280)..(280): a, c, t, g, unknown or other
  misc_feature (280)..(280): n is a, c, g, or t
tcagcgatcgtatacacgaccggtgctcgatttagtgatagagcgtaacaacgaggaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggactattaagtaacttaatttaaattggtatcgagacaagaaaccngggaccaacgtccccttaaacgtcctagactcgtaacgatcgactactaccctaaagttttacgggaaaccgtacggggtacccctaagtaccgtaaagggttccgaagggttagggtaacggttgggtttacgtaggggtaactaacggttaacttttttaccgttacaacctagttaccgaacgtcctaacggttccccttaccaacccgttagtaaacgtactttccgtttaggaaccctaaacgttaactttaactttaaccgttacgttaaccctaaacgttaaggtttaaacttaacggtaactttaaaccgttcccttaaccccctacgtttacccgttaacggtttacccggggtaccggggtaaaacggggtacccgtaaagggggttaggaacgttaacgtacggaaaacgtaggttcggtacggacgttacgacctacgttaacg

SEQ ID NO: 253431 - DNA, 659 bp, Homo sapiens
  misc_feature: GYAE6OF01DZ1VK.51.40.D07.1.454.CMB.1.raw
  modified_base (200)..(200): a, c, t, g, unknown or other
  misc_feature (200)..(200): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtagganacagatcaccatcacttgccaggcgagtgaggacattagtaacttatttaaattggtatcagacagaaaccagggaccaacgtaccccctaaaactccgtagtactactacgactgactactacctaagtttacggaaacgtacggggtaccctaagtacgaacggttacgtaggtacgggtaaggttgggttcggtaggggtacttaaggtttactttttaacctttacgtaaccctactcgaacgtcctaacggtacccctttaccgaacccctaggtaaacgtactttccgtttagacctaaactatttaactttactacgtactaacgtagtaattagtaacttaactcccttaccctaccttaccgtaccggtttacgggccgggtaacgggtaccgtaaagggtaggagtaacgtaaccgtaaacgacgttggtacggtctacgcctactacg

SEQ ID NO: 253432 - DNA, 685 bp, Homo sapiens
  misc_feature: GYAE6OF01DDQKY.51.40.D07.1.454.CMB.1.raw
  modified_base (201)..(201): a, c, t, g, unknown or other
  misc_feature (201)..(201): n is a, c, g, or t
tcagcgatcgtatacacgaccggtgctcgatttagtgatagagcgtaacaacagaggggggagtcagtcccaaccaggacacagcatggacatgaggtccctgctcagctcctggggctcctgctgctctggctctcaggtgccagatgtgacatccagatgacccagtcctccatccctccctgtctgcatctgtagganacagagtcaccatcacttgccaggcagtgaggactattagtaacttatttaaattgtatacagacaaggaaacagggacaacgacccctaaactcctagactcgtacgatcgacatacctaagtttaggaaacgtcgggtacccattacgtaaggttcaaggtgaaggttggtcgtagggactagttacttttacttacacgtactcgtaacgctacgtccctttacaaccccgttaagtaacgtacttacgtttacgacctaaattaacgtttaattttaccgtagttaacctaaaccgtaagttaacgtttaacgtaactttaaccttacccttaacccgttacctttaccggttacccgtttaccggggaccggggtaacggaacccgggtaaagggtagggaaacggttaaccgtaaccgtaaaaaccgtaaccggtttcgggtaacggaccgttaacggttacccaacccgtttaacgg

SEQ ID NO: 253433 - DNA, 675 bp, Homo sapiens
  misc_feature: GYAE6OF01CQNZ0.51.40.D07.1.454.CMB.1.raw
  modified_base (200)..(200): a, c, t, g, unknown or other
  misc_feature (200)..(200): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtagganacagacgtcaccatcacttcgccaggcgaggtgaggactattaagtaacttaatttaaattggtatcagacaagaaaccgagggaccaaacgtcccctaaactccctgactctacgatgactatacctaagttaggaaaccgtcgggtaccccagtacgtaaggttacaggtaggtaaggttggttacgtagggactagttacttttacgttactacctatcgacgtacacgtcccctttaccgtacccgttaaggaacgttacttcgtacgtacctaactactttaacttacttacgttaaccaaagtaacgttaattacgtaacttaaccgttcccttacccctacgttaccgttaacccggttttacggggacccgggtaacgggtaaccgggtaaaggggttacgggaaacgtaccgaaaccgtaaacggtaaacgttcgggtacgagttaccggaaccctaccgttaacg

SEQ ID NO: 253434 - DNA, 711 bp, Homo sapiens
  misc_feature: GYAE6OF01DCZWD.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtcctccatccctccctgtctgcatctgtaggagacagagtcaccatcacttgaccaggcgagtgaggacattagtaacttaatttaaattggtatcagacaaggaaaccgagggacaaccgaccctaaacgtcctagactctacgatgactactacctaagtttacggaaaccgtacggggtacccctaagtacgtaaacggtttacgaaggttagggtaaggttacgggtttacgtagggggtaaccgttaaggtttaacttttttaacccgttttaacccaacccttaattacccgaagtcccgtaaccggttccccctttaacccgaaccccgttaggtaaacgtacttaccgttagacccttaaactattaactttacgtacgtaacaacgtaagttatagtaacttaactccttaccctacttaccgttaccggtttaccggggacgggtaaccggggtaacccggtaaggggtaggaacggacttaacccggaaaacggtaccgttggtaccggaccgtacggccctaaccttacg

SEQ ID NO: 253435 - DNA, 681 bp, Homo sapiens
  misc_feature: GYAE6OF01DWQ9M.51.40.D07.1.454.CMB.1.raw
  modified_base (496)..(496): a, c, t, g, unknown or other
  misc_feature (496)..(496): n is a, c, g, or t
tcagcgatcgtatacacgaccggtgctcgatttagtgatagagcgtaacaacaggaggggggagtcagtcccaaccaggacacagcatggacatgagggtccctgctcagctcctggggctcctgctgctctggctctcaggtgccagatgtgacatccagatcgacccagtcctccatccctcccgtgtctgctagtcgtggtaggagactaagtacgtacaacctatcctacgttcggaccgagggcgaggtagacggaacttagttaagttaaacttaagttttaagtggttaatacaaggaccaaacggaaaccgacgggaacctaaccgtaccccttaaacgtcctagtactacgtacgtatcgactacgttaccgtaagttaacggaacggtacggtacctaagtacgtaaggttcgaggtggtaagtggttcgaggtactagtttactttactaccactactacgacgctaaccgtcctactaccgtanaacgtcttactacgaactaactattctttaagtcgtaacaacttagtactataacttaccgttccctaccacgttaccgttacggttacggggaccgggtaaccgggtaaacgtaggggtaactaacggtaaacaaccggtaaacggttacggtcgtaacgggacctcgaaccgtcgttaacccg

SEQ ID NO: 253436 - DNA, 659 bp, Homo sapiens
  misc_feature: GYAE6OF01EIPQD.51.40.D07.1.454.CMB.1.raw
  modified_base (457)..(457): a, c, t, g, unknown or other
  misc_feature (457)..(457): n is a, c, g, or t
  modified_base (650)..(650): a, c, t, g, unknown or other
  misc_feature (650)..(650): n is a, c, g, or t
tcagcgatcgtatacacgaccggtgctcgatttagtgatagagcgtaacaacaggaggggggagtcagtcccaaccaggacaacagcatggacatgagggtccctgctcagctcctggggctcctgctgctctggctctcaggtgccagatgtgacatccagatcgacccagtcctccatccctccctgtctgctatcgtaggtaggagacagacgtccacctatcctacgttcgaccgtagggcgaggtaggacggactaagttaagtaaacttaatttaaagttggtatacgaagacaacgaaccgacggaccaaccgtacccctaactcctagtactactacgtatcgactacttactaaggttaacggaaaccggtacggtacctaagtacgtaaggttcgtaggtaggtaggtggttcgtagggtactaaggttacttttacttaccaactntacgacgtactaccgtccctaccaacgtagaacttactctacgaactaacgtactttaacttccgtagtaactaacgttagtactaagttaacccttactccctacctaacttccggttaacgttccggggaacgtaacgggaccgttaagggacgaacgtacgtaaaccgaacgttcgtcggtcgactaccncgtacttcg

SEQ ID NO: 253437 - DNA, 752 bp, Homo sapiens
  misc_feature: GYAE6OF01BOUYS.51.40.D07.1.454.CMB.1.raw
  modified_base (150)..(150): a, c, t, g, unknown or other
  misc_feature (150)..(150): n is a, c, g, or t
  modified_base (168)..(168): a, c, t, g, unknown or other
  misc_feature (168)..(168): n is a, c, g, or t
  modified_base (174)..(174): a, c, t, g, unknown or other
  misc_feature (174)..(174): n is a, c, g, or t
  modified_base (290)..(290): a, c, t, g, unknown or other
  misc_feature (290)..(290): n is a, c, g, or t
  modified_base (352)..(352): a, c, t, g, unknown or other
  misc_feature (352)..(352): n is a, c, g, or t
tcagcgatcgtatacacgaccggtgctcgatttagtgatagagcgtaacaacaggaggggggagtcagtcccaaccaggacacagcatggacatgaggtccctgctcagctcctggggctcctgctgctctgctctcaggtgccagatgngacatccagatcgacccntctccnctcctcctgtcctgctagtctaggtagagacgagtacgacacctatacctacgttcgccgaggtcgtaggtaggaagtacgtaagtttaactaaattaagtttaagtagtacgtanacgacgaacgaaaccggacggacaaccgtaaccctaacgtacctagtactaccggtactacncggtactaacttaccgttaaaggttacggaaaccggggtaccgggtaacctaacggttacccgttaaaggtaccggtaagggtaacggggttacggttacgggtttacgggtaaccgggtaacgtttaacggtttacttttttaaccgtacctaaccgtactacggtaacctacggtaccttacccgttacccgacgttaacgaactacttaccgtactaacgtaactagtttaacttacctaacgtaacgtaacctagttactaacgtacttaaccttaccctacccgtacgttaccgttaccggtacgggtacccggtaacggtaccgggtaaggacggttacgaaccgtaacggtaaacgtacggtagtacggtacgaccgtaccgtacgttaccgg

SEQ ID NO: 253438 - DNA, 644 bp, Homo sapiens
  misc_feature: GYAE6OF01DBD3O.51.40.D07.1.454.CMB.1.raw
tcagcgatcgtatacacgaccggtgctcgatttagtgatagagcgtaacaacaggaggggggagtcacgtcccaaccaggacacagcatggacatgagggtccctgctcagctccgtggggctcctgctgctctggctctcaggtgccagatgtgacatccagatcgaccagtctccatccctccctgtctgcatctgtaggagacagagtccaccatcacttcgccaggcgagtgaggactataagtaacttaatttaatgtatcagcaagaacgaggacaacgacccctaaactcctagactactacgatcgactactacctaagttaggaaacgcgggtacccagtacgtaagttcaggttaggaagttggtacgtaggactagttacttttacttacaactactcacgcacgtcccttaccaacccgtagaacgtacttcgttacgactaaactattttaacttacgttacgtaactaaactaagttaagttagtaacttaactcccttaaccctacttaccgtaccggttttacgggaccgggtaagggaaccggtaaggggtaagggaacgtaaacgttaaaccgtaaaacggtaacggttacggttaacgggtgtaccggtaacgtacccgttaacg

SEQ ID NO: 253439 - DNA, 748 bp, Homo sapiens
  misc_feature: GYAE6OF01CKVNB.51.40.D07.1.454.CMB.1.raw
  modified_base (202)..(202): a, c, t, g, unknown or other
  misc_feature (202)..(202): n is a, c, g, or t
  modified_base (473)..(473): a, c, t, g, unknown or other
  misc_feature (473)..(473): n is a, c, g, or t
tcagcgatcgtatacacgaccggtgctcgatttagtgatagagcgtaacaacaggaggggggagtcagtcccaaccaggacacagcatggacatgagggtccctgctcagctcctggggctcctgctgctctggctctcaggtgccagatgtgacatccagatcgacccagtctccatccctcctgtctgcatctgtagganacagacgtcaaccatcctacttcgacccgaggcgagtgaaggtactaattaagtaacttaatttaaacgtggtatacgacgacaacggaaaccgagggaccaaccgtacccctaaactccgtagtactactacgtatacgactactaccgtaagtttaacggaaaccgtaccgggtaccctaagtaccggtaaaggttcgtaggttaagggtaagttcgggttacgtacgggaacttagtttaactttttaccttaccgaacctagttacncgtacgtaccgttaccctttaccgaacccgttaagaacgttacgttaccgttacgaacctaaacgttactttaaactttccgtaagttaacaaccgttaaggttaacttacgtaaacttaacccgttcccttaaccccttacgttaccgttaccgggttaccgggaaccggggtaacggggtaacccggtaaggggtacgggtaaacgtaaccgtaaaccggtaaaacgtcgggttaccggtacggtacccgttacggacccgtaaaccgtttcg

SEQ ID NO: 253440 - DNA, 667 bp, Homo sapiens
  misc_feature: GYAE6OF01BFQ1K.51.40.D07.1.454.CMB.1.raw
  modified_base (570)..(570): a, c, t, g, unknown or other
  misc_feature (570)..(570): n is a, c, g, or t
tcagcgatcgtatacacgaccggtgctcgatttagtgatagagcgtaacaacaggaggggggagtcagtcccaaccaggacacagcatggacatgaggtccctgctcagctcctggggctcctgctgctctggctctcaggtgccagatgtgaccatccagatcgacccagtcctccatccctccctgtctgctatcgtgtaggagacagatcaccatccattcgcgaggcgagtggagactattaagtaacttaatttaaagtgtatcagacaagaaccgacgggacaaaccgtacccctaaactccctagtactacgtaacgactcgactaagttacctaagtttacggaaaccggtacgggtacccaagttacgtaaacggttacgtaagggtaggtaaggttacgggtttacgtagggtaaccgtaagttttactttttacgtttacccaacgtacttacgaagtaccgtacttccccgtttaccaacccttaaggtaactcttacgttaccgataaactagttacttactactacaactagttatagtaactacgtcctaccctnttaccgtacggtttccgggaggtaccgggtaacgtagggtaggaagaaccgtaaccgtaaaaggtacgtcggttacgactcgtaaccgccgttaacg

SEQ ID NO: 253441 - DNA, 553 bp, Homo sapiens
  misc_feature: GYAE6OF01C39EV.51.40.D07.1.454.CMB.1.raw
  modified_base (542)..(542): a, c, t, g, unknown or other
  misc_feature (542)..(542): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcacatcacttgccaggcgagtgagacattagtaactatttaaatgtatcagcagaaccagggacaacgcccctaaatccctagactactacgatgacataccaagtttggaaacgtacgggtaccccaattacgaaggttcaaggtggtaaggttggttcgtagggactagttattttacgttcacctatcagacacgtccttcacctagagtatctgacaactataacttactagtactaactagtattagtataactcctacctacttaccgtacggtttacggcgggtaacggaccgtaaggtaggagtacacgtaaacgacgttgacggtnacggcactacg

SEQ ID NO: 253442 - DNA, 696 bp, Homo sapiens
  misc_feature: GYAE6OF01A335E.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccgagggacaacgcccctaaactcctgactctacgatcgctataccaatttaggaaacgacgggtaccccagtacgaaggttcaggtggtaaggtggttcgtgggtaactagttactttttaccgtttcaacctataccgtagccgtacggtacccctttacccgacccgttagaaacgtacttacgttcgaaccgtaaacctatttaacgttttaaccttacgttaactaaacctaaggtttaacgtaagtaaactttaaaccttacccttaaccccctacgttaccttaacccggttttcccgggggaaccggggtaaacgggggtaacccgtaaaaggggttcggggaaaggtaaccgttaaaccggaaaaaccggttaaccgttacggggttacggtaccgttccggtacgaacccgtttaacg

SEQ ID NO: 253443 - DNA, 714 bp, Homo sapiens
  misc_feature: GYAE6OF01BZ30A.51.40.D07.1.454.CMB.1.raw
tcagcgatcgtatacacgaccggtgctcgatttagtgatagagcgtaacaacaggaggggggagtcagtcccaaccaggacacagcatggacatgagggtccctgctcagctcctggggctcctgctgctctggctctcaggtgccagatgtgacatccagatcgacccagtcctccatccctccctgtctgcatcgtaggtaggacacagacgtaccaccatctacttcgccgaggcgagtagaggactaattaagtaacttaatttaagtgtactcagacaacgaaccgacgggacaaccgtacccctaaactccgtagtactcgtaacgagtaccacgttacgtaacgttaacggtaaacggaaccgggtcggtaacctacgtaaggttacggtacggtagggttaaggtacgggttcggtaggtacggtactttaacttttaaccgttttacctaccgtaactactacggtaccgtaccttacccgtacccttaccgtaacgtaagttacgttcgttacctacgaaccttaacgtttaattacgtttaacgtaaccgtaacttaacggttaataacgttacgtaacctttacccgttacccacccttaccgttaaccggtccggggttaaccgggaaccggtaacggtaaggtacgtacggtaactacggaaacgtaagtacggtggaactccgtacacgtagttacccg

SEQ ID NO: 253444 - DNA, 769 bp, Homo sapiens
  misc_feature: GYAE6OF01A24F0.51.40.D07.1.454.CMB.1.raw
  modified_base (199)..(199): a, c, t, g, unknown or other
  misc_feature (199)..(199): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctcctgtctgcatctgtagganacagagtcacatcacttgccaggcgagtgagactagttaagtaacttaatttaattggtatcagacaacggaaaccgaggggaccaaaccggaccccttaaaactccgtagtacttaccgtacgatcgacctaactaccgtaaagtttacggaaacgtacggggtcccaagtacgtaaggttacgagggtaggtaaggttcggtttaccggtagggtaacgttaacgtttaacgttttttaccctttaccgaacctagttacccgaacgtaccgtaaccggttaccccctttaaccgaaccccgttaaggtaaacgttacctttaccgttacgaaccttaaaccgttaacttttaaccgtttaaccgttacggttaaacctaaaccgtaaggttttaacgtaacgtaaacctttacttcccccttaaccccgtaccgttacccgttaccgggtttaaccggggaccgggtaaaccggggaacgttaacgggggtagggtaaacgaccgttaaacgtaaaccggtaaccggtttcgggtacggtacctaccggaaacctacccgtttaccg

SEQ ID NO: 253445 - DNA, 714 bp, Homo sapiens
  misc_feature: GYAE6OF01BZPW1.51.40.D07.1.454.CMB.1.raw
tcagcgatcgtatacacgaccggtgctcgatttagtgatagagcgtaacaacaggagggggggagtcagtcccaaccaggacacagcatggacatgagggtccctgctcagctcctggggctcctgctgctctggctctcaggtgccagatgtgacatccagatgacccagtcctccatccctccctgtctgcatctgtaggagacagacgtaccaccactcacttcgccgaggcgagtgaggactaattagtaacttaatttaaattggtatacagacaagaaaccgagggaccaacgtacccctaaatcctagacttacagtatcgactacttaccgtaaagtttacggaaacggtacgggtaccctaagtacgtaaggttcgaaggtagggtaaggttcgggttacgtaggggtaactaggtttaacttttttaccgtttactaacccgtattaccgacgtacctacggtacccctttacgacccgttagaacgttctacgttacgtacctaaacttaagttactttacgtacttaacgtaacgtaagttaactagttaacctaaccgtttacccctaccctaacccgtttccgttaaccccgggttttaccgggggaccgggtaaaccggggtaacgtaacggggttacggtaaacggtacgttaaaccgaaacggtacgttggtacggtacgtccgacctacgttaccg

SEQ ID NO: 253446 - DNA, 683 bp, Homo sapiens
  misc_feature: GYAE6OF01C565D.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtcaccatcacttgccaggcgagtgaggactatagtaacttatttaatgtatcagacagaacaggacaacgcccctaaactcctagactctacgatagactactacctaagttaggaaaccgtacgggtaccctaagtacgtaaggtttcgaaggttagggtaaggtttcgggttacgtaggggtaacgttaggtttaactttttaccgtttaccaacctacgttaccaacggtaccaaccggttaccccttttaccgaacccgttaaggaaccgttacttaccgtttacggaacctaaacttaactttaacgtttaacttacgttaacctaaacgtagttaagtagttaacttaacctcccttaaccctacgttaccgttaccggtttacgggaccgggtaacgggtaccgtaagggtacggtaagtacgtaaccgtaaacgtacgtacggtacggaccgtacgccctacgttacg

SEQ ID NO: 253447 - DNA, 672 bp, Homo sapiens
  misc_feature: GYAE6OF01DZFYD.51.40.D07.1.454.CMB.1.raw
  modified_base (206)..(206): a, c, t, g, unknown or other
  misc_feature (206)..(206): n is a, c, g, or t
  modified_base (509)..(509): a, c, t, g, unknown or other
  misc_feature (509)..(509): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgacccagtcctccactccctccctgtctgcatcgtggtagganacgagacgtcaccatccacgttgccaggacgagtgaggactaatttaagtaaacttaattttaaagtggtatcgaagacaacgaaaccgacgggaccaaccgtacccctaaactccgtagacgttactaacgtatcgacacttaaccgtaagttacgggaaacgtacgggtaccctaagtacgtaaggttactaagggtaggtaaggttcggtcgtagggaactaagtttacttttacttccaactatcgatcacgtcccttaccgaacctagaactatcttacgactaatattattaccgtnaactaactagttatagtactaaccttccctacccttacgttaccgttaaccgggtttcgggaaccggggtaaacgggtacccggtaaagggttacggggaactaaaccgtaaaccgtaaacggtaaccgtttgggacggtaccgtaccgccctaaccggttac

SEQ ID NO: 253448 - DNA, 650 bp, Homo sapiens
  misc_feature: GYAE6OF01EYGM1.51.40.D07.1.454.CMB.1.raw
tcagcgatcgtatacacgaccggtgctcgatttagtgatagagcgtaacaacagagggggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagatccaccatcacttgccaggcgagtgaggacattagtaacttatttaattgtatcagacacgaaacgagggacaacgtacccctaaactcctagactctacgtatgtctatacctaatttacggaaacgtacggggtaccctaagtacgtaaggttacgaggtagggtaacgttgggttcgtagggtaactaggttacttttacgtttaccactactacacgactacgtaccctcctaccgtagtaacgactacgttgactaactacttaacttactactacaactaagtaacttagtaacttaacttaccctacccttaaccttccgtaaccgtttaccgggtaccgggtaaaccgggtaaccggtaacggggtaagggaacgtaacgtaaaccgtaaacgtaaccggttaggtacggtaccgttacgacctaacccgttacg

SEQ ID NO: 253449 - DNA, 717 bp, Homo sapiens
  misc_feature: GYAE6OF01CKJYT.51.40.D07.1.454.CMB.1.raw
  modified_base (288)..(288): a, c, t, g, unknown or other
  misc_feature (288)..(288): n is a, c, g, or t
tcagcgatcgtatacacgaccggtgctcgatttagtgatagagcgtaacaacaggaggggggagtcagtcccaaccaggacacagcatggacatgagggtccctgctcagctcctggggctcctgctgctctggctctcaggtgccagatgtgacatccagatgacccagtctccatcctccctgtctgcatcgtgaggagacagatcaccatcacttgccaggcgagtgagacattagtaatatttaattggtatcagcaagaaaccagggacaacgaccctaaacncctagtactactacggatgctaactaccgtaaattttagggaaaaccgtacggggttaccccaaatcggtaaacggtttcgaaaggttaggggttaacggttggggtttaccgtacgggggtaataacgggtttaacttttttacctttaccaccgttaacttccaagggtccgtaaaccttcccctttaaccgaccccgtaaggtaacgttaacttctttacggactaaacctatttaaactttcggtaacgttaaccaaagttacggtaacttataaccttaaacttccctaaccccggtacttaccctttagggttacccgggacggggaacggtaaaccgggtaagggttacgggaaacgttacgtaaacccgtaaaacgggtaacgttcgggttacggacccttacgcccgtaaaccggtttcg

SEQ ID NO: 253450 - DNA, 610 bp, Homo sapiens
  misc_feature: GYAE6OF01ER9ZW.51.40.D07.1.454.CMB.1.raw
  modified_base (500)..(500): a, c, t, g, unknown or other
  misc_feature (500)..(500): n is a, c, g, or t
tcagcgatcgtatacacgaccggtgctcgatttagtgatagagcgtaacaacaggaggggggagtcagtcccaaccaggacacagcatggacatgagggtccctgctcagctcctgggctcctgctgctctggctctcaggtgccagatgtgacatccagatcgacccagtcctccatccctccctgtctgctatctaggtagagacagacgtcaccatcacttgccgaggcgagtgaggactaagttagtaacttaatttaagttggactacagacaaggaaaccgaggaccaaccgtacccctaaactccgtagacttcgtacgtatcgactactaccttaagttaggaacgtacgggtaccagtacgtagtacgagtaggtacggttggtcgtaggtactagttacttttacttaccaactataccgagctacgtcccttacaccgtagtaactctactacgtactactattacttactacgtaacaactaagttanacgtaatttactacccttaccctattacctccgggtttacggaacggacggtaacgagggtagtacaaacgagtaaacccgacgttcggacgtaccgcgtctacgttacg

SEQ ID NO: 253451 - DNA, 699 bp, Homo sapiens
  misc_feature: GYAE6OF01BSEBJ.51.40.D07.1.454.CMB.1.raw
tcagcgatcgtatacacgaccggtgctcgatttagtgatagagcgtaacaacaggaggggggagtcagtcccaaccaggacacagcatggacatgagggtccctgctcagctcctggggctcctgctgctctggctctcaggtgccagatgtgacatccagatgacccagtcctccatccctccctgtctgcatcgtgtaggagacagacgtaccacctatccacgttcgccgagggcgagtaggacgactaattaagtaacttaattttaagtaggtatacagacaaggaaaccgagggacaaccgtacccctaaactccgtagtactacgtaacgatacgactactaacgtaagtttaacggaaacggtacgggtaccctagtaacgtaacggtcagggtacggtaaggttcggttacgagggtactaggtttacttttaaccgttacaacctatacgagtacctacgtacccttaccaccgtagtaacttacgttactacgaaccgtaaacttagtttaactttacgaacgtactaaaccgtaaggttacgtaataacttacccttaccctaccctaacgtacccgttaacgggttccgggaaacgggttaaccgggtaaaccgaaggggttacggaaacgttaaaccgaaacgtaaaacgtcggttacggtcgtacgtacgaaccctacgttacg

SEQ ID NO: 253452 - DNA, 664 bp, Homo sapiens
  misc_feature: GYAE6OF01A1DG2.51.40.D07.1.454.CMB.1.raw
  modified_base (230)..(230): a, c, t, g, unknown or other
  misc_feature (230)..(230): n is a, c, g, or t
  modified_base (650)..(650): a, c, t, g, unknown or other
  misc_feature (650)..(650): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcacactcactcgccgaggcgagngagactattagtaacttaatttaattgtatacagacgaacgaaaccggagggaccaaccgaccccgtaaacctccgtacgtactacctaacgatcgactaacttaccgtaaagtttacggaaaaccggtacggggtaccctaacgtacgtaacggttacgaggttagggtaaggttggttacgtcggggtaactaaggtttatttttaccttacaaccgtaacttcgaacgtacctacggttaccccttaaccgaaccctaggtaaactacttccgttagaacctaactagttaactttacgtagttaactaacgtaagttataagtattaaccttacctacctaccttgtacccgttacgggacgggaacggtaacggtagggtaggaactacgtaacgaaacgtacgtgtacggtacncggtccaacgtccg

SEQ ID NO: 253453 - DNA, 703 bp, Homo sapiens
  misc_feature: GYAE6OF01C2X6W.51.40.D07.1.454.CMB.1.raw
  modified_base (202)..(202): a, c, t, g, unknown or other
  misc_feature (202)..(202): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgaccagtctccatccctccctgtctgcatcgtgtagganacagacgtccaccatcacttgaccgaggcgagtagaggtactaagttaagttaaacttaatttaaattggtatcaagacaacgaaacgagggaccaaacgcccctaaactcctagtactctacgatcgactactaccgtaagttacggaaacgtcgggtaccctagtacgtaaggttcgaggtaggaaggttacggttcggtagggtaactaggtttaacttttactttccgaactactcgaacgtctaccgtacccctttaccgaaccctaggaacgtcttacgtacgaacctaaactacgtttaactttaccgtacggttaactaaactaggttataacgtaactttaaccgccctttaaccccgtacttaccggttaacccgtttacggggaacccgggtaacggggtaaaccgtaaaggggttcggaaacgtaaccgtaaaccgtaaaaacccggtgttccgggtaacggcctaacccggacgtaaccctttaacgg

SEQ ID NO: 253454 - DNA, 705 bp, Homo sapiens
  misc_feature: GYAE6OF01CTSY8.51.40.D07.1.454.CMB.1.raw
  modified_base (203)..(203): a, c, t, g, unknown or other
  misc_feature (203)..(203): n is a, c, g, or t
tcagcgatcgtatacacgaccggtgctcgatttagtgatagagcgtaacaacaggaggggggagtcagtcccaaccaggacacagcatggacatgagggtccctgctcagctcctggggctcctgctgctctggctctcaggtgccagatgtgacatccagatcgacccagtctccatccctccctgtctgcatctgtagganacagatcaccatcactgccaggcgagtgaggactattaagtaacttatttaaattggtatcagacaacgaaacgacgggaccaacgacccctaaactcctagtactactacgatcgactactacctaaagtttacgggaaaccgtacggggtacccctaagtacgtaaggttacgaaggttagggtaaggttcgggttacgtagggtaactaaggtttaacttttaacgtttccaaccgttataccgtaacgcctaacgtcccctttaccaacccgttaaggtaaacgttacttaccgtttacgaacctaaaacgttatttaaacgtttacctacggttaacctaaacgttaagttaataacgtaacttaaaccttcccttaacccctacttaccgttaacccggtttaccggggacggtaacgggtaacggtaaagggtcggaacgtaacgtaaccgtaaaacggtacgttgggtacgtaccgtacggccctaaccgtacg

SEQ ID NO: 253455 - DNA, 820 bp, Homo sapiens
  misc_feature: GYAE6OF01BPXCT.51.40.D07.1.454.CMB.1.raw
  modified_base (129)..(129): a, c, t, g, unknown or other
  misc_feature (129)..(129): n is a, c, g, or t
  modified_base (757)..(757): a, c, t, g, unknown or other
  misc_feature (757)..(757): n is a, c, g, or t
  modified_base (801)..(801): a, c, t, g, unknown or other
  misc_feature (801)..(801): n is a, c, g, or t
tcagcgatcgtatacacgaccggtgctcgatttagtgatagagcgtaacaacaggagggggggagtcagtccccaaccaggacacagcatggacatgagggtccctgctcagctccgtggggctcctantctctgcgtctcgtcgtggccagtagtagtggacactacacagtactaccgaccgtctccctacctcctcccttcgtctcgctactgttaggtaggacggacgaagtacgtacacctactacgtaccgttacgccggacggtcgggtacggaggtacggaactaacggtttaatttaaccttaaattttaaggtttaggtatacccaaggtagaaacccgaacggaacggtacgacccgtaacccttaaacctcgtcgtatccgttacgactagacctacgttaacgttaacgtttaaacggggaactaccgggggtcctaataggtaacggttcgaagggttgggtaaggtttacggtcggtcgggtaaatacggtttaacctttttacggtacctaccggactacggtacaaccgttacgtaccttacccggtaacctacgggtaattacccgtacttttaagggaaccttaacttaaacgtttaccgtttacgttaaacgtacggttaaaacttaacggtttaattacccgttaagttaaacccccttaccttaccccgggtacctttaacgggtccccgggtttaagggttacccggggaaaccgggtaagttaccggggtaanaccgggttaacaaacggttacccgtaactttacggcggttaacncgaaactccctaaggttcg

SEQ ID NO: 253456 - DNA, 849 bp, Homo sapiens
  misc_feature: GYAE6OF01BEZPE.51.40.D07.1.454.CMB.1.raw
  modified_base (142)..(142): a, c, t, g, unknown or other
  misc_feature (142)..(142): n is a, c, g, or t
  modified_base (835)..(835): a, c, t, g, unknown or other
  misc_feature (835)..(835): n is a, c, g, or t
tcagcgatcgtatacacgaccggtgctcgatttagtgatagagcgtaacaacagagggggagtcagtcccaaccaggacacagcatggacatgaggtccctgctcagctcctggggctcctgctgctctggctctcgaggtnccagatgtagacatccagatcgacccagtcctccactccctccctgtcctgcatctagtaggagacagacgtccaccgactcctacgttcgaccgaggcgaggtagaaggtacttaagtttaacgttaaactttaagttttaaagttaggtaactacgaacggaccgaaacggaaacccggacgggacccaaacccgtaccccccgtaaaacttcccgtagtaaccgttacctaacgtagttacgtacctaacgttaaccttaaaggtttaaccgggaaaaccggtaccggggttacccctaaacggtttaaccgggtaaacggtttacgtaaacggggtttaacgggtaacgggtttacgggtttacccgggtaagggtaacggtttaacgttttaaccggtttttaaccgtttacccgaaccttaacgttacccgaagttaccccgtaaccgttcccctttaaccccgaacccggtttaggtaaaccggttctttaccggttaaccggtaaccttaaacctttaggttttaaccgtttacctaccggttactaaacgttaacggttataacggttaaactttaacccgttccctaacctacgttaccgttaccggttaccgggacgggaaccgggtaacgtagggtacccggtagaaccgtaaaccgtaacgtacgtggaccgtactaccncgtaacccgttacg

SEQ ID NO: 253457 - DNA, 873 bp, Homo sapiens
  misc_feature: GYAE6OF01EZHH0.51.40.D07.1.454.CMB.1.raw
  modified_base (206)..(206): a, c, t, g, unknown or other
  misc_feature (206)..(206): n is a, c, g, or t
tcagcgatcgtatacacgaccggtgctcgatttagtgatagagcgtaacaacaggaggggggagtcagtccccaaccaggacacagcatggacatgagggtccctgctcagctcctgggcctcctgctgctctggctctcaggtgccagatgtgacatccagatcgacccagtcctccactccctccctgtctgcatctgtagganacagactcaccatcctacgttcgacgaggcgaggtgaaggtactagttaagttaacttaattttaaagttggtaatacacgtacaacggtaaaccgacgggacaaaccgtaccccgtaaactcccgttacggaacttaccgtaacgtactacggacctaacgttaacccgtaaaggttttaacgggaaaaccggtacccgggggttaaccccctaacgttaaccgggttaaaacggtttaccggaaagggtttaacggggttaaacgggtttcggggttttaaccgggtaacggggttaaacgttaaggttttaaaccgtttttttaaccgtttaccgtaaacccgttacgttaccgtaacgtacccgtaaccgttaccccgtttaacccgtaaccccgttaggttaaaacgtacgtttaccgtttacgaacccttaaacgttaactttaaccgttttaaccgtaaccgtaaccgtaaacgttaacggttaactacggtttaaacttaacccgttaccccttacccgttaacccgttaccggttaccggtttaacccggggacccgggtaaacggggtaaccggtaagggtacggaacggtaaccgtaaaccggtaaaacggttacgttacgggtaccgtaccgaccgtacccgtaccggtttaccc

SEQ ID NO: 253458 - DNA, 658 bp, Homo sapiens
  misc_feature: GYAE6OF01BTBZJ.51.40.D07.1.454.CMB.1.raw
  modified_base (203)..(203): a, c, t, g, unknown or other
  misc_feature (203)..(203): n is a, c, g, or t
  modified_base (386)..(386): a, c, t, g, unknown or other
  misc_feature (386)..(386): n is a, c, g, or t
  modified_base (453)..(453): a, c, t, g, unknown or other
  misc_feature (453)..(453): n is a, c, g, or t
  modified_base (595)..(595): a, c, t, g, unknown or other
  misc_feature (595)..(595): n is a, c, g, or t
  modified_base (637)..(637): a, c, t, g, unknown or other
  misc_feature (637)..(637): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgacccagtcctccatccctccctgtctgcatctgtagganacagatcaccatcacttgccgaggcgagtgaggtacattagtaattatttaaattggtatcagacaagaaacccgagggacaacacccctaaactcctgtatactacgatgactataccgtaagttacggaaccgacgggacctaagtacgtaaggttacaggtaggtaaggttcggttacgngggtaactagttacttttaccttacaccatcaacgctaccggttcccttactaacccgtagaacgtnttacgtacaacctaacgtaatttaactttacggtataacctaaacgtagttaatacgtaaacttaaccttacccttacccgacgttacccgtacggtttacgggaccgggttaaacgggaacccggttaagggaggggtaanacccgggtaaactaaaccgggtaacgttcgggtacggttacnccgggttaaccacccgttacg

SEQ ID NO: 253459 - DNA, 628 bp, Homo sapiens
  misc_feature: GYAE6OF01A0IJE.51.40.D07.1.454.CMB.1.raw
  modified_base (614)..(614): a, c, t, g, unknown or other
  misc_feature (614)..(614): n is a, c, g, or t
tcagcgatcgtatacacgaccggtgctcgatttagtgatagagcgtaacaacagagggggggagtcagtcccaaccaggacacagcatggacatgagggtccctgctcagctcctgggggctcctgctgctctggctctcaggtgccagatgtgacatccagatcgacccagtctccactcctccctgtctgccatctgtaggagacagagtccaccatccacttcgcaggcggtagtagaggaactagtttaagtaactttaatttaaattggtactacgagacgaacgaaaccgacgggaccaacggtacccctaactcctagactcgtacgatgactactacctaagttacggaacgtacggtacctagtacgtaggttacgtaggtacggtagttcgggtacgtagggtactagttacttttaccttacacctatcaagtcctacgtcccttacacctagtaactcttacgtacactaactatactttacgagtaactaacgtagtatagtaacttacttccctaccctacgttcccgttacggtccgggacgggtacgggtaacggtaggggtagacgtaacgaacgtaaacggaggttcgtaccggtntaccgctacgtacg

SEQ ID NO: 253460 - DNA, 833 bp, Homo sapiens
  misc_feature: GYAE6OF01BXN36.51.40.D07.1.454.CMB.1.raw
  modified_base (823)..(823): a, c, t, g, unknown or other
  misc_feature (823)..(823): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgacccagtcctccatccctcctgtctgcatctgtaggagacagagtccaccatcctacgttcggaccgagggacgtaggtaggaacggtaactaagtttaacgttaaaactttaagttttaaaagtttgggtaacttacgaacggtaaccgaaaacggaaaacccggtaacgggggaaccctaaaacccgggttaacccccttaaaaacccgttcccgttaacggttaaccgttacccgttaaacggtaacgtttaccggaaccttaaaccgttaaacccggtttaaacggtttttaaccggggaaaaaccggttaccgggggttacccctaaacgtttaccggtaaacggttacggtaacgggttagggttaacgggttacggtttaccgggtaaggggtaaccttaacgtttacgtttttaccctttaacggacctaacgttaccgacgtaccgtaaccgttcccctttacgaaccgttagaaacgttaccttacctacgaacctaacgttacgtttaactttacgtacgtaacgttaacgtaagttacgtacgtaaacttaccttcccgtaaccttacgtaccgttacggttacgggacgggtaacggtaccgtaggtaacgaggtaaccgacgtaaacgtgtcggtacaccggtanccctagtacg

SEQ ID NO: 253461 - DNA, 730 bp, Homo sapiens
  misc_feature: GYAE6OF01BT94U.51.40.D07.1.454.CMB.1.raw
tcagcgatcgtatacacgaccggtgctcgatttagtgatagagcgtaacaacaggaggggggagtcagtcccaaccaggacacagcatggacatgagggtccctgctcagctcctggggctcctgctgctctggctctcaggtgccagatgtgacatccagatcgacccagtcctccactccctcctgtctcgctatctggtaggagacagactccaccatcctacgttgccgaggcgagtcgaggactagttaagtaacttatttaaagttggtatacagacgaacgaaccgtaggaccgaaccgtaccctaaactcctagacttacgtacgatacgactactaccgtaagttacggaaacggtccgggtacctaagtactaacggtacgtacgggtaggtaacggttggttcgaagggtacttaagtttacctttttaccgtacctactacgttaccgacgtacctaccggttccccttaccgtaacccgtagtaaccggttattccgtataaacccttaaacgtactttaaacgtttaccgtaacgtaactaaccggttaagttaaccttaacgtactttaacccttcccgtaacccttaaccgtttacccggttaccggttaccggggaacggggtaccggaaaccgggttagggttacggaacgttaacctaaaccggtaaaccgttacggtcggtacggtactaccggtaccctaccgttaccg

SEQ ID NO: 253462 - DNA, 670 bp, Homo sapiens
  misc_feature: GYAE6OF01CA846.51.40.D07.1.454.CMB.1.raw
  modified_base (126)..(126): a, c, t, g, unknown or other
  misc_feature (126)..(126): n is a, c, g, or t
  modified_base (156)..(156): a, c, t, g, unknown or other
  misc_feature (156)..(156): n is a, c, g, or t
  modified_base (168)..(168): a, c, t, g, unknown or other
  misc_feature (168)..(168): n is a, c, g, or t
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (652)..(652): a, c, t, g, unknown or other
  misc_feature (652)..(652): n is a, c, g, or t
  modified_base (659)..(659): a, c, t, g, unknown or other
  misc_feature (659)..(659): n is a, c, g, or t
  modified_base (663)..(663): a, c, t, g, unknown or other
  misc_feature (663)..(663): n is a, c, g, or t
tcagcgatcgtatacacgaccggtgctcgatttagtgatagagcgtaacaacgaggaggggggagtcagtcccaaccaggacacagcatggacatgagggtccctgctcagctccgtggggctccngctgctctgctctcgaggtcgccagatganacactccagtancgacctagtctccacttccgtccgtgtcctagactatcgtagaggacganagtagacactactcgtactcgacgaggacgngtagacgatacttaagtaacttaagtttaagtagtacacgagacgaacgaaccgaggacctaaaccgtcctaaactcgtaagtacttacacgtactacgactaacctaacgaaagtttacgggaaaccggtccggactaagttaaccggtagttacgggtagtaaggggttacgtacgggtttacgtacgggaacgtttaacgttttaacttttaccttacctaccgttacacgtaacgtcctacgttacccttacgaaccgtaacggtacgttatacgttacgaactacgttaattaccgtataacgtataacgtaagtagttacaactttaccacctaccgtcttaaccgtcggttacgggagtaaccggacgagggtaagactagtaccaacgttgtcgnggtaccncganacgttcg

SEQ ID NO: 253463 - DNA, 730 bp, Homo sapiens
  misc_feature: GYAE6OF01BUYXA.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagtatcgaccctagtctccactccctccctgtctgctatctgtaggagacagacgtaccacctatcctacttcgaccgaggccgtaggtaggacggtaactaagtttaagttaactttaagttttaaagttggtaacttacgagaccgaaacggaaacccgagggaccaaaccgtacccctaaccgtcctacgtactctacgtagtcgactactaccgtaagtttacggaacggtacgggtaccctaagtacgtaaggttcgtaagggtggtaaggtttacggttacggtacgggtaacgttaggtttaactttttaccgttactaacgtacttaccgacgtaccgtaccgtcccttacccgtaaccctacggtaagttaccttacgttaccgaacctaacttactttaactttaacgttacgtaactaacgttaagtaacgtttagtaaccttaccttacccgtaccctaccgttaccgtaccggtttaccggggaaccgggtacgggtaaccggagggtaggaagtaccgtaaacgaacgtacgtggtacggtctaacgtcctacttacg

SEQ ID NO: 253464 - DNA, 752 bp, Homo sapiens
  misc_feature: GYAE6OF01B5YHL.51.40.D07.1.454.CMB.1.raw
tcagcgatcgtatacacgaccggtgctcgatttagtgatagagcgtaacaacaggaggggggagtcagtcccaaccaggacacagcatggacatgagggtccctgctcagctcctggggctcctgctgctctggctctcgaggtgccagatgtgacatccagatcgacccagtcctccactccctcctgtctgctatcgtggtaggagacgagacgtaccaccactctacgttcgaccgaggcgaggtagacggtaactaattaacgttaaactttaattttaagttaggtatacgaacgacgaaacggaacggaacggaccgtaacccgtaaccccttaaaccgtccgtaagtacttacgtaacgtatcgactaacttaccgtaagttacggaacggtaccggtaccaagtacgtaaggtacgtaggtaggtaaggttcggtacgtaggtaacttagtttacttttacctttaccaacgtaactccgacgtcccgtaccgttaccctacccgtaaccgtaaggtaaccttcctttacggtacaaccgttaaacttaagttttaaccttagtaacctacgtaacttaaggttacttaacgttaaaccttaccgtttacccaccccgttagttacccggttaacgggttcccggggaaagggtacccgggtaaagggtacggttacggaacccgtaacgtaaaccgtaaacgggtacggttgtaccggtaaccctgaaccccgtaactttcgg

SEQ ID NO: 253465 - DNA, 958 bp, Homo sapiens
  misc_feature: GYAE6OF01EDDE5.51.40.D07.1.454.CMB.1.raw
  modified_base (152)..(152): a, c, t, g, unknown or other
  misc_feature (152)..(152): n is a, c, g, or t
tcagcgatcgtatacacgaccggtgctcgatttagtgatagagcgtaacaacaggagggggggagtcagtcccaaccaggacacagcatggacatggacgggtccctgctcagcctccgtggggctcctgctgctcgtggctctcgaggtcnccagatggtgaccactccgagtactcgaccctacgtccctacctaccttccccgttcccgttggttcctacggtacctacgttaccggttagggaaccgggtaagaaccggtaaggtaccgttacccaaccctagttaccccgtaaccgtttcgggacccggtaaggggtaccggtagggtaacggtaacggttaaactttaacgttttaaaacggtttaaactttttaaaagttttaaacggtttaggtaacttacggaacggtaaccggaaaccggaaaaccgggtacgggaacccgtaaaccccgtaaccccttaaccgttccgtaaggtaccttacgtaacgtacgtacgtacgttaaccttaaccggtttaacggtaaacgggaaccggtaccgggtacctacggtaacggttacggttacggtagggtacgggttacggtttacggttacgggtacggttaacgtttacgttttaacctttttaacgttacctaacgtacctacgtaccgtccgtaaccgttccccgtaaccgtaaccgttaggtaaccttacgtttacgaacttaacgtaactttaactttacgttaaccttacgtaaacgaacgtttacgtaagtttaccttaaaccttaccccgttaccctttaacccggtacccttacccgggttaaccggggtttacgggaaacccggggtaaccgggttaaccggaaggggttaaacccgtacggtaaaacccgtaccgggtaaaacgttcggttacgggtaccgtaccgtaacccgttacgtaccctttcggg

SEQ ID NO: 253466 - DNA, 781 bp, Homo sapiens
  misc_feature: GYAE6OF01AUX73.51.40.D07.1.454.CMB.1.raw
  modified_base (148)..(148): a, c, t, g, unknown or other
  misc_feature (148)..(148): n is a, c, g, or t
  modified_base (153)..(153): a, c, t, g, unknown or other
  misc_feature (153)..(153): n is a, c, g, or t
  modified_base (581)..(581): a, c, t, g, unknown or other
  misc_feature (581)..(581): n is a, c, g, or t
  modified_base (639)..(639): a, c, t, g, unknown or other
  misc_feature (639)..(639): n is a, c, g, or t
tcagcgatcgtatacacgaccggtgctcgatttagtgatagagcgtaacaacaggagggggggagtcagtccccaaccaggacacagcatggacatgagggtccctgctcagctccgtggggctcctgctgctctggctctcagggtnccagngtcgtgactactaccaagtaactcggacccctagtcctacctacttccctaccctgtctcgtacacttcgtagggtacgaagacgaacggtagtacccaacaccgttacctcgttacgaccgacgggacggtaagtgaacggtaactaaacgtttaattaaaaccgttaattttaaagttcggttaactacgtaaacgtacggaaaaccggaaaaccggacgggtaaccctaaaccgtaaccccttaaaccgtaccctaggaacctacgtaacggtacgacgtaactactaaaccgttaaaggtaacggtaaaccgggtaccgggtaaccttagtaacgggttaaacggtcgtaagggtacggtaaggtacccgttgggtaacgttaacggttacgtttaactttaccgttacaactacgtacgtacnccgtaacgtccgtaacaacgtagactacttgtaacgactaaattacttacgttaactntaaccggaagtattacgtactacgttaaccaccttaccgtacctagttacccgtacgggaggaacggtaaccggtaggtaagcggttaaagaaacccgtcgtaacgggtacgtacggtaacgtccctaaagtccttaaccgg

SEQ ID NO: 253467 - DNA, 799 bp, Homo sapiens
  misc_feature: GYAE6OF01AN7D8.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctcgtggctctcaggtcgccagatgtgacatccagatcgaccctagtcctccctactccctcccgtgtctgctacttcgtaggtaggagaaccgagacgtaccacctactctacgttcggccgtaggcggtaggtaggaacggacttaagttaacgttaactttaagttttaaagttcggtaactacgacgacggaacgaaaccggtacgggaaccaaaccctacccctaaccgtccgtacgtactacgtacgagtcgtactaacttaccgttaaaggttacggaaaccggtaccggtacctaagttaacggtacggttacggtaagggttacgggtacggtttacgggttacgtaacgggtactttaacgttttaccttttaacccgttacctacgtaacgtacgaaccgtccgtacccgttaccccttaccgtaacccgttaagtaacgtcctttactacgaacctaacgttaactttacgttaacgtacgtaacctaagttaacgttagttaacgttaaacttacccttaccccttaccgttacccgttacccggttacggtaccgggggtaacccggtaacggggtaaacgttaggggtaacgtagtaaccgtaaacccggtaaaggttccggtacgggtcgacccggttactaccgtaaccgtttcg

SEQ ID NO: 253468 - DNA, 679 bp, Homo sapiens
  misc_feature: GYAE6OF01BCPXG.51.40.D07.1.454.CMB.1.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (352)..(352): a, c, t, g, unknown or other
  misc_feature (352)..(352): n is a, c, g, or t
tcagcgatcgtatacacgaccggtgctcgatttagtgatagagcgtaacaacaggaggggggagtcagtcccaaccaggacacagcatggacatggagggttccctgctcagctccgtggggctcctgctgctctggctctcgaggtgccagtatgtgaccatccagtatcgacccagttccctccactccctccctgtctgctatctaggtaggacanaggtactacacctntcctacgtgccgaggcgagtggaagtataagtttaagttaattaagtttaagtgtacacaaggaccgaaacgaaccggagggacctaacccgtaccctaaacttcgtatactacgtacngttacactaacttacggtaaacgttacggggaaccgtcggtacctataggtaaggttcgaaggtagggtacgtttgggtcgtagggtaacttagttttacctttactacaactcgtactacgtacctaccgttacccctaccgaaccgtaggaacttacgttactaacgtaacctaagttaacttacttacgtacgtaacgtaagtagtaataacttaattaccctcctaacccgttacctacggttccgggttacgggacgggtaacggacggttaaggataacgtagacccgtaaagtcggtagtagtaccgccactacctacgg

SEQ ID NO: 253469 - DNA, 711 bp, Homo sapiens
  misc_feature: GYAE6OF01EQQTI.51.40.D07.1.454.CMB.1.raw
tcagcgatcgtatacacgaccggtgctcgatttagtgatagagcgtaacaacaggaggggggagtcagtcccaaccaggacacagcatggacatgagggtccctgctcagctcctggggctcctgctgctctggctctcaggtgccagatgtgacatccagatcgacccagtcctccactcctccctgtctgctatcgtaggtaggacgaccagtacgtaccacctatccgtacgttcgaccgacgggtacgaggtaggaacggaactaagtttaagttaaactttaaagtttaaagttaggtaactacgaagtacgaaacggtaaaccgagggaccaaccgtaaccccttaaactcctacgtactacgtaacgtatacgtactacttacgtaagttaacggaaaccggtacggtacctaagtacgtaaggttacgtaggttaggtaaggttcggttacgtaggtacttagtttacttttaccttactactataccgacgtactacgtaccctaccgacctagtaacgtcttacgtagaactacgtaattacgttactactactaactagttagtacgttaataacccgttcctacccgtacttaccgttacgggtaccgggtacgggaacggtaaccggtaaggttagggaacgtaacgtaaaccgtaaacggtacggttcggacggttactaccgaaccgtcgttaacg

SEQ ID NO: 253470 - DNA, 738 bp, Homo sapiens
  misc_feature: GYAE6OF01BCWRI.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctgggggctcctgctgctctggctctcgaggtgccagatcgtgacatccagatcgacccagtctcactccctccctgtactgcctaatcgtaggtaggagaacctagacgtaccacccatacctacttcgccggaggcggtagtgacggactagttaacgtaacttatttaagtgtatacagacagaaaccgaggacctaaccgaccccgtaaactctacgactactaggtaatcgactactacctaaggttacggaaaccgtaccgggtacctaacttacgtaggttacgtggttagggtacgttgggtacgtacgggtacttaacgtttaagttttaccctttaaccgcctaacgtaccgtaccgtacttacccgtcccgttaaacctacccgtaaggtaacgttacttacccggtttacgaaccgtaaacttctttaaacgttaccttaacggtaacaaaccgttagttaccaaacgttaattaccccttacctacccccggttacttacccgttaccggtcggggaaccggaaccggggttaacccgtaagggggtacaacggttacccttaaaaccgggaacgttacgacggggttcccgacttcggaacccgcgtttacg

SEQ ID NO: 253471 - DNA, 704 bp, Homo sapiens
  misc_feature: GYAE6OF01D3KTB.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgacccagtctccatccctccctgtctgcatcgtgtaggagacgagacgtccacctactctacgtcgaccgtaggcggaggtagaggaactaagtttaacgtaacttaaattttaaagttggttaatccgtaagaccaaacggaaaccgtaacgggaccaaccggtaacccccttaaactccgtacgaactacgtaacgtatcgtactacttaaccgtaagtttacggaaaccggtacgggtaccccaaggttacgtaacggttacgaggttaggtaaggttcgggttcgtagggtaactaggtttacttttaccttaccaaccgtatccgaagtccttaccgtccctttaccaaccgttagacgttacttcctaacgacctaaactattttactaacgttacgtaactaacgtaagttagtaacgtacttaaccttccctaccctacgttccggttacggtttaccggggacgggtaacggtaccggtaaaggtaggaacgtacaaaccggtaagtacgtggtagccgtcacctcgttacg

SEQ ID NO: 253472 - DNA, 910 bp, Homo sapiens
  misc_feature: GYAE6OF01DXCFU.51.40.D07.1.454.CMB.1.raw
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
tcagcgatcgtatacacgaccggtgctcgatttagtgatagagcgtaacaacaggaggggggagtcagtccccaaccaggacacagcatggacatggacggtccctgctcagccttccgtgggcctcctgctgctctggcctctcgaggtcgacctagatggtacactataccgagactccgaccctacttcccncctaccttccccttccttntcgacactacgttacgtagggaaggaataaccgagacctaccctaaccgtccttacgtaccgtcggaccggtagggacggtaggtaaggaacgtaaactttaaagtttaaacgtttaaacgttttaaaggttttaaagtcggtaacttaccggaaacgtaaccggaaaccggtaaaacccgggtacggtaacccgtaacccctaaccccgttaaactcgtacgtacctacgtactagtacgtactaccgttaaacgtacgttaacggaaccggtccgtacctagtaacggtacgttacggaaggttaggttcggttcgtacgggtacgttactttaacggttttaccctttacaaccgttaactacgtaccccacggttcccttaacccgttccccgttaaccgaaccggtttaagttagtttaccgttaacctaacttaacgttacgttttacttaaaccgttacgtaaacgtaacgttaagtaacccttaagttaaccccttttaccccgtaaccgttaccccgtacccggttttttacgggaaaccggggttacccgggtaaacgggttaacccccggggttaaagggttaacccgggggtaagtaaaacccgttaaccccggtaaaacggtaaacggttccggttccggggtaacctccggtacccgtaacggttaccttccgtttaacccg

SEQ ID NO: 253473 - DNA, 846 bp, Homo sapiens
  misc_feature: GYAE6OF01BIBJK.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctcgtggctctcgaggtcgcgagtatgtgacatccaggactacgaccctagttcctcctaccttccctcccgttcgttcgtcgtacctaattcgttacggtaagggtaacgaccgtaaggtaaccttacccaaccctattcccgtacggttccggaccggtacggggacggtaaggttaggaacggtaaccttaagtttaaaacggtttaaaaccttttaaagttttaaaaggtttacggttactaacgaacggtaaccggtaaaacggaaaacccggtaacggggaccgtaaaccccgttaaacccccgttaaaccgttaccggttacgtaacttaccgtaacgtacgtacgtaactacgttaacgtaacggttttaacggaaccgggtaaccggtacctaagtacgtaggttacgtaggtaggtaggttggtacgtaggtaacgttagtttacttttactactacgtactacgtacgtaccgtacgttccctaacccgtacgtaacttacgttacgttaccgtaacgtaaccttaacgttacttaacgtttactaccgtaaccttaagtagttaacgttactaaacgttccttaaccctcccttaaccgttacgttaccggggtaccggacgggtaaccgggtaacggtaacggttaggaacggttaccgaaacggtaacctaacggttcggtacgaccgtatacccgtacttaccg

SEQ ID NO: 253474 - DNA, 880 bp, Homo sapiens
  misc_feature: GYAE6OF01EY9AU.51.40.D07.1.454.CMB.1.raw
  modified_base (113)..(113): a, c, t, g, unknown or other
  misc_feature (113)..(113): n is a, c, g, or t
  modified_base (174)..(174): a, c, t, g, unknown or other
  misc_feature (174)..(174): n is a, c, g, or t
tcagcgatcgtatacacgaccggtgctcgattttagtgatagagcgtaacgaacaggaggggggagtcaccgtccccaaccgtacggacacagcattggacatgagggtcccngctcagctccgtgggggcttcctgctggcttcggtggtctctcgaggggttcctccgtagnttagtttaggactactaccgtagtacgtacggtaccctacgtcctccctacgttcccgtccttcgtcggtacgctagttcctagggtacggacggaccaggacgtcctaacctactacctacgttcgaccggacggtacgtaggtacgtacggtaaccttaagtttaacggttaaacttttaagttttaaagttacggttaacttacgacgtaacgtaaaccggtaaacccggacgggaaccgtaaccccggtacccctaaaccggtaccgtaaccgtacgttaccgtaacgtacgtacgtactaacgttaacgttaaggttaacggaacggtaccggtacctaacgtaacgtaagtacgtaaggttaggtacggttcggttacgtcggtagttacgtttaacgttttacctacgtaactactaccgtagtacctaccgttaccgtaccctaaccgttagaaacgttacttcgtaacgtaaccgttaacttaccgtttaacgtttaaccgtacggtaactaaaccgttagttaagtacgtttaaccgttaccttacccgttaacccgagtttaccccggttacggttacccggggtaaaggtaaccgggttaacggtaaggggtacggtaacggtaaaccgttaacccggaaacggtttacggtaccggggtacctacgggtttacggaaccctaccggttacggg

SEQ ID NO: 253475 - DNA, 748 bp, Homo sapiens
  misc_feature: GYAE6OF01AX7QB.51.40.D07.1.454.CMB.1.raw
tcagcgatcgtatacacgaccggtgctcgatttagtgatagagcgtaacaacagagggggatcagtcccaaccaggacacagcatggacatgaggtccctgctcagctccgtggggctcctgctgctctggctctcgaggtgccagtatgtgactatccagatcgacccagtcctccacttccctccctgtctcgctattcgtaggtaggacacgagacgttccacctatctacctcggaccgtagggcgtagtaggaacgaacttaagtttaagttaactttaaattttaaagttaggtaactacgaggacaaagaaacccggagggaccaaaccgtaccccgtaaactccgtacgtactactacgtatcgactacgttacctaagttaaccggaacggtacggtacctaagttaccgaaggttacgtaacggttaggtaacggttcggttacgggtaacggttaacgttacgtttaacgttttacctaccgtacctaactacgtacgtacctaacccgttcccttaccgtaacgtacgtaacgttaccgttcgttaacgtaacttaactattacgttacctagtaacgtaacgtaattacgttaataaccttacccgttacctccccgtaagttcccgttaccggttaccggggtaaccgggaaccgggttaacggtacggtaaggaacgttacgaaaccggtaacgttacgttcgggacgtaccgtacgacgttaaaccgttccg

SEQ ID NO: 253476 - DNA, 792 bp, Homo sapiens
  misc_feature: GYAE6OF01BZAVT.51.40.D07.1.454.CMB.1.raw
tcagcgatcgtatacacgaccggtgctcgatttagtgatagagcgtaacaacaggaggggggagtcagtcccaaccaggacacagcatggacatggacgggtccctgctcagctccgtggggctcctgctgctcgtggctctcgaggtcgccagatgtacgacactccaagatcgacccagtcctaccactccctcctcgtctcgctacgttcgtagggtaaggaacgaccgaaggtactacaacctactctacgttcggaccgaaggacggaggtacgaacggtaacttaagttaagttaaactttaagtttaaagttaggtactacgaacgaacgaaacggaaaccgacgggaaccaaccgtaaccctaaaccgtcgtagtacgtaccgtacgtacgactacctaacgttaaccgttaaggttaacgggaaaccggtaccgggtaacctaacggtaacggtaaggttacggaggttaacgggtaacggttcggttacgggacggttaacttaggtttaacttttaccgtaccgactagtacacggtctaccgtcccttaccgaaccgtaggtaacgtatacttagaacctaactaagtttacgttactaacgtaactaaatacgttagtaacctactttaacctccgttaccctacgttaccgttaccggtttaccggggggaacggtaaaccgggtaacgggaacgggttacgaaacggtaaaccgttaacccggaaaagtttaccgggtcggggttacctacccggtacgtaaacccctccgtttacg

SEQ ID NO: 253477 - DNA, 778 bp, Homo sapiens
  misc_feature: GYAE6OF01B222Y.51.40.D07.1.454.CMB.1.raw
  modified_base (736)..(736): a, c, t, g, unknown or other
  misc_feature (736)..(736): n is a, c, g, or t
  modified_base (767)..(767): a, c, t, g, unknown or other
  misc_feature (767)..(767): n is a, c, g, or t
tcagcgatcgtatacacgaccggtgctcgatttagtgatagagcgtaacaacaggaggggggagtcagtcccaaccaggacacagcatggacatgaggtccctgctcagctcctggggcctcctgctgctcgtggcctctcgacggtcgccagtatgtacgactatccgaagtactccgaccctagtcctcctactccctcctgtctgacctatcgtaggaggagtacaggtactaccaacctattccaccgttggaccggagggtacgaggtacggaagtaacttaagtttaaacgttaaattaaagttttaagttacggtaatccgaaggaccaaaacggaaacccggacggtaaccaacccggtaacccccttaaacgtcccgtacgtaccgttacctaacggtacttccggaacttaccgttaaaccggttaaaacggtttaacgggtaaacccgggtaccgggttaaccctaaacgttaacggttaaaccgggtagttaaccgggttaagggttacggttacgggtttacgggtacggtaaccgtttaaagttttacccttttaacgtacccgttacgtaacgtacgtaaccgtaccgaccgttaaccctacccgtaacgtaacgtaataccgttacctaaccggtattaacgtatttaactcgttaacgtaaccagttaactagtactaactacctcctacgtcttacggtacggtgaccggaggaacgnggtaccgagacctacgaacggtgtcgactcncgtaactgtac

SEQ ID NO: 253478 - DNA, 486 bp, Homo sapiens
  misc_feature: GYAE6OF02GUYR2.51.40.D07.1.454.CMB.1.raw
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacagggtcccatcaaggttcagtgaagtggttctgggacagattttactttcacatcagcagccttcaccctgaagatcttgcaacatattactgtcaacagtatgataatctccactcactttcggcgaggaaccaaggtggagatacaaacgactgtaggctgacacta

SEQ ID NO: 253479 - DNA, 489 bp, Homo sapiens
  misc_feature: GYAE6OF02IYBLA.51.40.D07.1.454.CMB.1.raw
tcagcgatcgtatacacgaccggtgctcgatttagtgatagagcgtaacaacagaggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcagtgaggacattagtaactatttaaattggtatcagcagaaaccagggcaagcccctaaactcctgatctacgatgcatccaatttggaaacagggtcccatcaaggttcagtggaagtggttctgggacagtattttactttcacatcagcagccttcaccctgaagatcttgcaacatatactgtacaacagtatgataatctacccatcactttcgcgtaggaccgaaggtgagatacaaacgaactgtagctacgcacctag

SEQ ID NO: 253480 - DNA, 488 bp, Homo sapiens
  misc_feature: GYAE6OF02GNBOM.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacagggtcccatcaaggttcagtggaagtggttctgggacagattttacttcaccatcagcagccttcaccctgaacgatcttgacaacatattactgtcaacagtatgataatctcccactcactttcggcggaggaccaaggtggagatacaaacgactgtgctgcacta

SEQ ID NO: 253481 - DNA, 494 bp, Homo sapiens
  misc_feature: GYAE6OF02HX3NV.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacagggtcccatcaaggttcagtggaagtggtctgggacagtattttactttcaccatcagcagccttcaccctgaacgatcttgcaaacataattactgtcaacagtatgataatctcccactcactttcggcgagggaccaaggtggaagatacaaacgactggtggctgcactac

SEQ ID NO: 253482 - DNA, 514 bp, Homo sapiens
  misc_feature: GYAE6OF02J2E8R.51.40.D07.1.454.CMB.1.raw
  modified_base (317)..(317): a, c, t, g, unknown or other
  misc_feature (317)..(317): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaatcctgatctacgatgcatccaattggaaacngggtccatcaaggttcaggtggaagtggttctgggacagtattttacttcactatcagcagccttcaccctgaacntcttgcaactntattacngtacaacagtatagaataactcaccctactctactttcgggacggaggaccgtaagggtgaacgatacgaaacgaacgttcggaggtctacggacctacgtac

SEQ ID NO: 253483 - DNA, 518 bp, Homo sapiens
  misc_feature: GYAE6OF02HEK5H.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaatggtatcagcagaaccagggcaagcccctaaactcctgatctacgatgcatccaatttggaaacagggtcccatcaaggttcagtggaagtggttctgggactagtatttttacttcacctatcagcagtccttcaccctgaagacttcttgactaactatattactgtacaactagtatagattaactcctcccactcactttcgggcgtagggacctaagggtcggaagtactacgaaagtactggtaggctaggctacctacg

SEQ ID NO: 253484 - DNA, 548 bp, Homo sapiens
  misc_feature: GYAE6OF02HN806.51.40.D07.1.454.CMB.1.raw
  modified_base (388)..(388): a, c, t, g, unknown or other
  misc_feature (388)..(388): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactattaaattgtatcagcagaaccagggcaagcccctaaactcctgatctacgatgcatccaattggaaacagggtcccatcaagttcagtggaagtgtctgggacagtattttacttcacatcagcagtccttcaccctgaacntcttgcaactattaacttactagtaccaaacgagttagtagtaattaacttcctacccctaacttctaccgtttcgggaccggtaagggtaacccgtaaagggtcgggaaacgaacttaccgaaaaccggtacgtggtacggacctacggaccaccctag

SEQ ID NO: 253485 - DNA, 527 bp, Homo sapiens
  misc_feature: GYAE6OF02HNVYY.51.40.D07.1.454.CMB.1.raw
  modified_base (401)..(401): a, c, t, g, unknown or other
  misc_feature (401)..(401): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacagggtcccatcaaggttcagtggaagtggttctgggactagtattttactttcacctatcagcagtccttcaccctgaacgtntcttgcaactatattactgtacaactagtatgaataatcctcccactcctacgtttccggacggaacgggaccgtaagggtcggaagtacgtacgaaacgtactggtacggcgtacgccacctacg

SEQ ID NO: 253486 - DNA, 493 bp, Homo sapiens
  misc_feature: GYAE6OF02JISO0.51.40.D07.1.454.CMB.1.raw
  modified_base (319)..(319): a, c, t, g, unknown or other
  misc_feature (319)..(319): n is a, c, g, or t
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
  modified_base (465)..(465): a, c, t, g, unknown or other
  misc_feature (465)..(465): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacngggtcccatcaaggttcagtggaagtggttctgggacagtattttacttcacatcagcagccttcaccctgaacgtntcttgacaacatattacngtcaacagtatgaatatcctccactcacttcggcggaaggaccaaggtganaatacgaaacgacgtgtggctgacacta

SEQ ID NO: 253487 - DNA, 556 bp, Homo sapiens
  misc_feature: GYAE6OF02IHUOR.51.40.D07.1.454.CMB.1.raw
  modified_base (270)..(270): a, c, t, g, unknown or other
  misc_feature (270)..(270): n is a, c, g, or t
  modified_base (319)..(319): a, c, t, g, unknown or other
  misc_feature (319)..(319): n is a, c, g, or t
  modified_base (346)..(346): a, c, t, g, unknown or other
  misc_feature (346)..(346): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaacngggacaagacccctaaactcctgatctacgatgcatccaattggaaacngggtccatcagttcagtgaagtggtcngggacagtattttacttcactatcagcagtccttacaccctgaagtctcgttgactaactatacttactgtacaactagttatagaacttaatcctacccacttactacgtttccgggaccgggtaagggaacccgtaaagggttgggaacgtaacgttaaccgaaaaccggtacttcgggttacgggccttaggaccctaactaaccgg

SEQ ID NO: 253488 - DNA, 605 bp, Homo sapiens
  misc_feature: GYAE6OF02HUGCJ.51.40.D07.1.454.CMB.1.raw
  modified_base (401)..(401): a, c, t, g, unknown or other
  misc_feature (401)..(401): n is a, c, g, or t
  modified_base (424)..(424): a, c, t, g, unknown or other
  misc_feature (424)..(424): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaatgtatcagcagaaaccagggacaagcccctaaaatcctgatctacgatgcatccaattttaggaaacacgggtcccatcaaggttcagtggaagtggttctagggactagtatttttacttcactatcagctagccttcaccctgaagtntcttgactaaactataacttacncgttactaaaccgagttaatcgaaacttaacgttacccttaccccaaacttacccgttaacgttttacccggggacgggtaaaccggggtaaccccgtaaaggggttcgggtaaagtaaccgttaaccgaaaaaccggttacgttagggtaccggttaccgtggtaccctaaccgttaacg

SEQ ID NO: 253489 - DNA, 484 bp, Homo sapiens
  misc_feature: GYAE6OF02F8NN3.51.40.D07.1.454.CMB.1.raw
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaatcctgatctacgatgcatccaatttggaaacagggtcccatcaaggttcagtggaagtggttctgggacagattttacttcacctatcagcagccttcaccctgaagatcttgcaacataattactgtcaacagtatgatatctccactcacttcgcgaggaccaaggtgagatacgaacgaactgtacgctgcactac

SEQ ID NO: 253490 - DNA, 549 bp, Homo sapiens
  misc_feature: GYAE6OF02HH2U7.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacagggtcccatcaaggttcaaggtggaagtggttctgggacagtatttttacttcaccatcagcagtccttacaccctgaacgtattcttagactaaactattaactttactgtacaaacgtagttaatagaattaactccttacccaactcctaacgtttccggacggtacgggaccgaaagggtggaagataaccgaaacgtactcggtacggacgtacgaccacctaac

SEQ ID NO: 253491 - DNA, 581 bp, Homo sapiens
  misc_feature: GYAE6OF02F13RT.51.40.D07.1.454.CMB.1.raw
  modified_base (277)..(277): a, c, t, g, unknown or other
  misc_feature (277)..(277): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccgggcaagacagaacatggcagctatttaaatggtatcagcagaaaccagggaaacncccctaacctcctgatctatgctgcagcctactttgactaaagtcggacgtcccagtcgaggttcaggtgcaggtgggtctgggacagtatttctctcttcacctattacggctagtctgacctaaccgttagaaacgttattttacgaccttaaactttactacttacgtactaaactacgtaagtttaacctaaacgttttcgacccttattaccgtaccgttttaccggaacccgtaagggacctaaccggtacgttaggaacgttaagttaaaaccgacgtagggttacggcgtaaccgg

SEQ ID NO: 253492 - DNA, 748 bp, Homo sapiens
  misc_feature: GYAE6OF02I2Y28.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagatcaccatcacttgccaggcagtgaggacattagtaactatttaaatggtatcagcaagaaccagggacaacgacccctaaactcctgactctacgattcgactatacctaaagtttcggaaaaccgacggggtaccccaagttaccgtaagggtttccaagggttagggtaaaggtttcgggtttaccgtagggggtaacctaaggtttaactttttttaacccgtttaccgtaacccgttacttaccgtaacggtacctaaccggttaccccttttaccaaaccccgtttaggaaaaccgttacttaccgttaaggaccctaaaacgttactttaaactttaccgttaacggttacccaaaagttacgtttaacgtaacgttaaactttaaaccgttcccttaaccccgtaacttacccgttaacggtttttacccgggggacggggtaacgggtaacccggtaaggggttacgggaacgtaacttaaccggtaaaaccggttacgtcgggttacggaccttacgggacctaccccgttaag

SEQ ID NO: 253493 - DNA, 539 bp, Homo sapiens
  misc_feature: GYAE6OF02F0S0I.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaccagggacaacgcccctaaactcctgatctacgatgcatccaatttacggaaactacggggtacccatcgaaggttcagtaggtaagtgggttcgtgggactagtattttacttactaccatcagtcacgtccttacaccctgaacgtattcttgacaactatacttactgtacaactagtatagaataactcctaccctactcctacgtttcgggcgacggaccgtaagggtaggacgactacgaaacgactggtcggctcgaccactacg

SEQ ID NO: 253494 - DNA, 562 bp, Homo sapiens
  misc_feature: GYAE6OF02GNF2B.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaatggtatcagcagaaaccagggcaagcccctaaactcctagactctacgatgcatcctaatttggaaacagggtccatcaagttcagtggaagtgtctgggacagtattttacttcaccatcagcagtccttacaccctgaacgattcttagactaacgtactattacttacgtactaacaacgttagtataagtaacttaccttccctacctactaccgttaccggttaccgggacggtaacggtaacggtaagggtacggtaacgtacgtaaaccgaacgttcggtacgtaccggtcgtacgacctaac

SEQ ID NO: 253495 - DNA, 633 bp, Homo sapiens
  misc_feature: GYAE6OF02HHPKG.51.40.D07.1.454.CMB.1.raw
  modified_base (277)..(278): a, c, t, g, unknown or other
  misc_feature (277)..(278): n is a, c, g, or t
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
  modified_base (364)..(364): a, c, t, g, unknown or other
  misc_feature (364)..(364): n is a, c, g, or t
  modified_base (485)..(485): a, c, t, g, unknown or other
  misc_feature (485)..(485): n is a, c, g, or t
tcagcgatcgtatacacgaccggtgctcgatttagtgatagagcgtaacaacagagggggagtcgagtccaaccaggacacagcatgacatgagggtccctgctcagctccgtgggctcctgctgctctggctctcaggtgccagatgtgacatccgagatgacccagtctaccatccctcccgtgtcctgcctatcgtgtaggagacagacgtcaccagtccacttgccaggcgtagtgaggactattaagtattaatttaaattcggtaatcgannaagaaaacgnggactaacgacccctaaatccgagtanacctaagatgacctataccggtaattacgggaaaactcgggtacccaanaccgtaaagtttccgaaggtaggaagtttggtactgggaactagtttattttactttacaacctatcgaacgtagacctacttaccacttaaccgaagtactcgttaactcgaaacttaanaactttacggtactactaaacgttataacgtagtaattaactaccgtaccttacaaccgttacttccggtaccgaagggtaacccgtaaaggtgtaacggtaaagtacaaaacccggaagttcgaaggtactttcgaccacggttacc

SEQ ID NO: 253496 - DNA, 771 bp, Homo sapiens
  misc_feature: GYAE6OF02I5EZ6.51.40.D07.1.454.CMB.1.raw
tcagcgatcgtatacacgaccggtgctcgatttagtgatagagcgtaacgaacgagaggggggagtcagtcccaaccaggacacagcatggacatgagggtccctgctcagctctggggctcctgctgctctggctctcaggtgccagatggtgacatccagatgacccagtctccatcctccctgtctgcatctgtacggagacagagtcaccgtatcacttgccaggcagtgaggacattagtaactattaaagtgtatcagacagaaaccgagggacaacggtacccctaaaactccgtagtactaccgtacgtaatcggactaacttacccgtaaagtttagggaaaaccgtacggggttacccctaaagttaccgaaaggtttacccaagggttaacgggtaaacggttcgggttaccgtagggggaaccttaagggttaacttttttaaccgtttaccgaaccgttaacgtaccgtaaacggtccgtaaaccggttacccgtttaccgaaaccccgttagggaaacgttactttccgttaacggtaaccctaaaacgttacttaaacgtttaaccgtcggttaaccaaagttacggtaattaacgtaactttaaaccgttcctaccccgtaacgtttaaccgttaccggttttacggggaccgggtaacgggtaaacccgtaaggggttaccgggaagtaaaccgtaaccgtaaaacggttaccgttcgggttaccgtacggtttaccgaaccgtaccgttacgg

SEQ ID NO: 253497 - DNA, 728 bp, Homo sapiens
  misc_feature: GYAE6OF02F9THF.51.40.D07.1.454.CMB.1.raw
  modified_base (201)..(201): a, c, t, g, unknown or other
  misc_feature (201)..(201): n is a, c, g, or t
tcagcgatcgtatacacgaccggtgctcgatttagtgatagagcgtaacaacagagggggagtcgagtcccaaccaggacacagcatggacatgagggtccctgctcagctcctggggctcctgctgctctggctctcaggtgccagatgtgacatccagatgacccagtcctccatcctccctgtctgcatctgtagganacagagtcaccatcacttgcccaggcgagtgaggacattagtaactaattttaaatggtaatcagtcaagaaaccagggcaacgacccctaaactcctagaatactacaatacgactactccaaatttcgggaaaaccacggggttaccccaagttaccgtaaaggttccgtaaggtacgggtaaaggttcgggtttaacgtcggggtaaacgtacggtttaactttttaccgtttactaaccgttaactttcgaaacggtcctaaccggtacctttacccgtaaccccgttaaggtaacgtactttaccgttacgacctaaacttacttaaacgtttactaggtttaccaaaccgtagttaaacttacgtaacttaacttcccttaacccctatttaacccgtaccgtttcggggtacccggtaaacggggttaaccccgaagggttaccggtaaagggaccctttaaaccggaaaaccggttacttacgggtacccggtatacccgggtactaaccccggttaac

SEQ ID NO: 253498 - DNA, 577 bp, Homo sapiens
  misc_feature: GYAE6OF02HLM4O.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattaagtaactatttaaattggtatcagcagaaacagggcaagcccctaaactcctgatctacgatgcataccaatttaggaaacgagggtcccatacaaggttcagtggaagtggttctagggacagtattttacgttacacatcagtcacgtccttcacccgtagaagtactcgttgacaaactattattactagtcaaacgtagttatagtaataacttccctaccctaaccttacttaccgttttaccgggaccgggtacggggtaaccgtaagggttacgggaagtacgtaaccgaaaacggttactagggtccggtacgtcgaccgtaaccgtacg

SEQ ID NO: 253499 - DNA, 705 bp, Homo sapiens
  misc_feature: GYAE6OF02IGTLQ.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagacagaaaccagggcaagcccctaaactcctagatctacgatcgacactacctaatttacgggaaacacggggtacccaagtactaaggttcgaaggttgggaaagttgggtttcgtaggggaacctaggttaacttttttaccgttaccgtaaccacgttacaacggtcctaacgtcccgtttcctaacccgttacggaaacgtacgtacctttacgaccgtaactaacgtttaactttaaccttacggttaacaaaccgttaaggttaatttacggtaaactttaacgttacccttaccctaccttaccgttaaccgttttacccgggggtaccgggtaaccggggtaacccgtaaacggggttacgggtaacggtaaacgtaaccggtaaaacggtaacgtttacgggtaccgggtaccgtacggtaccctaccttaaccg

SEQ ID NO: 253500 - DNA, 779 bp, Homo sapiens
  misc_feature: GYAE6OF02HZM98.51.40.D07.1.454.CMB.1.raw
  modified_base (261)..(261): a, c, t, g, unknown or other
  misc_feature (261)..(261): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaacttattaaattgtatcancaagaaaccagggacaacgcccctaaactcctagactctacgatgactactacctaagtttacggaaaccgtacggggtaccccattaccgtaaggtttacgaaggttcgggtaaaggttcggggtttaccgtagggggtaacctaaggtttaacgttttttttaacccgttttaccgaaccgttaacttacccgtaaacgtcccgtaaccggttaccccctttacctaaacccccgttaggtaaaacgttaacgttcccgtttaaggaaccctaaaacgttaactttaaacgtttaccgttaacggttactaaaaccgtaagtttaacgttaacttaaacgttaaccttcccttaacccctaaccgtttacccgttaaccgggtttttacccggggaccggggttaaaccggggtaacccggtaaaaggggttccgggtaaacgtaaccgtttaaacccgaaaaccgggtaacgtttacgggtaccgggtaccgtacggtacccctaaccgttaacg

SEQ ID NO: 253501 - DNA, 634 bp, Homo sapiens
  misc_feature: GYAE6OF02FNJBN.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaattggtatcagcaagaaaccagggacaacgcccctaaactcctagactactacgatcgactactacctaagtttacggaaacgtacgggtacccagtacgtaaggttacaggttacgggtaaggttagggttcgtaggggaactaggtttactttttaccttacaacctatacgagctacgtcccttaccaccgttagaacgtacttacgttacgactaactattaacttacgtacgtactaacgtagttatagtaataccttcctaccctacttaccgtaccgtttacgggaccgggtaacgggtaaccggtaagggtacggtaacgtaacgtaacgtaaaccggtacgttacggtaccggtacgtacgtacctaccgttacg

SEQ ID NO: 253502 - DNA, 556 bp, Homo sapiens
  misc_feature: GYAE6OF02HP4AM.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattgtatcagcagaaaccaggcaagcccctaaatcctgatctacgatgcatccaatttggaaacagggtcccatcaaggtcagtgaagtggtctgggactagtattttacttacactatcagcacgtccttcaccctgaagtatcttagacaactataacttactagttacaaactacgtaatagtaattaacttcccttacccattacctacgtttaccgggaccggaaggggtaaccctaaaggggtacggaacggaagttaccgaaaacgtaacgttggtacggactacggacaacccgtac

SEQ ID NO: 253503 - DNA, 552 bp, Homo sapiens
  misc_feature: GYAE6OF02GIJID.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaacgcccctaaactcctgatctacgatgcatccaatttagaaacagggtccatcaagttcagtggaagtggttctggacagtattttacttacaccatcagcacgtccttcaccctagaacgattcttagcctaaacattaattactgtacaataagtatgaattaatcctacccacttactacgtttaccgggcggtaacgggaccgaagggttacggaagtaacgttaaccgaaaccggtaacttagggtacggaccgttcgaccgtaccctacg

SEQ ID NO: 253504 - DNA, 702 bp, Homo sapiens
  misc_feature: GYAE6OF02JX23R.51.40.D07.1.454.CMB.1.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
  modified_base (687)..(687): a, c, t, g, unknown or other
  misc_feature (687)..(687): n is a, c, g, or t
tcagcgatcgtatacacgaccggtgctcgatttagtgatagagcgtaacaacagagggggagtcagtcccaaccaggacacagcatggacatgagggtccctgctcagctcctggggctcctgctgctctcggctctcaggtgccagatgtgacatccagatgacccagtctccatcctccctgtcctgcatctgtagganacagacgtcaccatcacttgcaggcgagtgagacagttagtaactattaaagttgtatacgagtcaacgaaccgaggcaacgcccctaaactcctgtaactcaacgtatacncacgttacctaaagtttacggaaaacgtcggggtaccctaagttaaccctaagggttcctaaagggttcggaaaggtttcggttacgtacggggtaacctaaggttatttttttaaccctttacaacccgttacgtaccgtaacgtaaccgtaacgtaccccgtttcctaacccggttaggtaaaccgtcgtttaccctttaagtccctaaacgtaacttaacgttttactaaccgttactaaagtaccggttatagttaacttaactacccttaacccggtaccttagtaacccggttttaccgacggggtaaccgggttaccgtaaagggtcgtaaacgtacggttaaccaaagggtactcggtacggtacncgtacgaccttaacg

SEQ ID NO: 253505 - DNA, 662 bp, Homo sapiens
  misc_feature: GYAE6OF02JOZ87.51.40.D07.1.454.CMB.1.raw
  modified_base (206)..(206): a, c, t, g, unknown or other
  misc_feature (206)..(206): n is a, c, g, or t
  modified_base (510)..(510): a, c, t, g, unknown or other
  misc_feature (510)..(510): n is a, c, g, or t
  modified_base (520)..(520): a, c, t, g, unknown or other
  misc_feature (520)..(520): n is a, c, g, or t
  modified_base (622)..(622): a, c, t, g, unknown or other
  misc_feature (622)..(622): n is a, c, g, or t
tcagcgatcgtatacacgaccggtgctcgatttagtgatagagcgtaacaacagagggggagtcagtcccaaccaggacacagcatgacatgagggtccctgctcagctcctgggctcctgctgctctggctctcaggtcgccagatgtgacatccagatcgacccagtctccatccctccctgtcctgaccagttctggtagganaccagacgtcaacccattacgacctttcgacccgaggaccggagtacggagggaacctaagtttaagtaaacttaattttaaacgtttggtattacgagtacaaacgtaaaccgaggggtaccaaacgtaccccctaaatcctagtaacttacctacgaatcgtacctatacctaagttaggaaaaccgtacgggtacccagttacgaggttacaggtacggtagtaggttcagggaactagttacttttacctcaactattacagtctacgtacccttcgaccgtagtaacgtcttacgttanccttaaacgntttacttaacctgtaacaaaccgttagttactagaaaccgttactaccgttacccaattccgttacgttccggacggtaacggactaacgggttgacctaanacccgaaagttacccgtggtagcgtttaccgatacccgta

SEQ ID NO: 253506 - DNA, 610 bp, Homo sapiens
  misc_feature: GYAE6OF02I0MWF.51.40.D07.1.454.CMB.1.raw
  modified_base (507)..(507): a, c, t, g, unknown or other
  misc_feature (507)..(507): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgaccgaggcgagtgaggacattagtaacttaatttaaattggtatcagcaagaaaccgagggacaacgacccctaaactcctagactctacgatgctactacctaaagtttacgggaaaccgcggggtacccagttacgaaaggtttcgagtaggtaaggttggttacgtaggggactaaggttactttttacttacgaccctaatacgagcctacgtcccttaccaccgtagaacgtacttcgttagacctaactattacttactgtacaactagtatagtaattacnccttaacccacttaccgttacgtttaccgggacggacggtaacccgtaaagggtggaagtactaccgaaacgtacgttcgtaggcctacggtccaccgttacg

SEQ ID NO: 253507 - DNA, 591 bp, Homo sapiens
  misc_feature: GYAE6OF02FXXCC.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaattggaaacagggtccatcaaggttcagtggaagtggtctgggacagtattttacttcacctactacgacacgtaccttctacctacgtaagactacttcgtactactaatattaacttacgtactaactaagtaagtagtaacgttaaattacttaccctaacccttaccttaaccgtttaccgggtaccgggtacgggaacccggtaagggttaacgggaaggtaacgtaccgtaaaccgaaacgttacggtacgggtaccgtacggccacctacttaccg

SEQ ID NO: 253508 - DNA, 656 bp, Homo sapiens
  misc_feature: GYAE6OF02JU2DE.51.40.D07.1.454.CMB.1.raw
  modified_base (214)..(214): a, c, t, g, unknown or other
  misc_feature (214)..(214): n is a, c, g, or t
  modified_base (630)..(630): a, c, t, g, unknown or other
  misc_feature (630)..(630): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcattctgtaggagacagacgtcaccntcactcgccgaggcgagtgaggacattaagtaacttaatttaaatggtatcagcaagaaacacgggctaaacgccccttaaactccgtagtatacctaacggtatcgttaactaccgtaagtttaggaaaacgtacggggtacctaagtacgttaaggttcgaaggttagggaaacggtttcggttcgtacgggtaactaaggttacctttttacgtttaccctaacgtattacccgtaagaccgtacgttacccttacctaaacccgtgaaacgtacttcgtttaacgacctaaactctttaaacttcgtactacctaacgattactagtaacttaacttcctaccctattacctacggtttcggacggtacgggaacccgtaaggtaaggaacgtaagtaaccaacggtaacgngttacgggccttcgctaacctgttcg

SEQ ID NO: 253509 - DNA, 627 bp, Homo sapiens
  misc_feature: GYAE6OF02GN5OW.51.40.D07.1.454.CMB.1.raw
  modified_base (200)..(200): a, c, t, g, unknown or other
  misc_feature (200)..(200): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatcacttgccaggcgagtgagactattagtaacttatttaaatggtatcagcaagaaccgagggacaacgacccctaaactcctagactctaacgatcgctacttactaaagtttagggaaaccgtacgggtacccaagttaccgtaaaggttctaggtaggtaaggttcggttacgagggaactagttactttttacttacacctaatcagactacgtcccttaccacccgtagaacgtacttcttacgacctaaacgtatttacttacgtactaacgtaaactagttaactagtaacttaacgttccctaccctaactcgtaccgtttacggggaccggtacgggaacccgtaaggggtacgagtaacgtaaccgtaaacggtaacgttcggtacggtacgtcgacctactacg

SEQ ID NO: 253510 - DNA, 688 bp, Homo sapiens
  misc_feature: GYAE6OF02JURDN.51.40.D07.1.454.CMB.1.raw
  modified_base (207)..(207): a, c, t, g, unknown or other
  misc_feature (207)..(207): n is a, c, g, or t
  modified_base (260)..(260): a, c, t, g, unknown or other
  misc_feature (260)..(260): n is a, c, g, or t
  modified_base (542)..(542): a, c, t, g, unknown or other
  misc_feature (542)..(542): n is a, c, g, or t
tcagcgatcgtatacacgaccggtgctcgatttagtgatagagcgtaacaacagagggggagtcgagtcccaaccaggacacagcatggacatgagggtccctgctcagctcctggggctcctgctgctctggctctcaggtgccagatggtgacatccagatgacccagtctccatccctccctgtctgctatctgtagacacagntcaccatcacctgccagcgagtgagactattagtaactatttaagtgtatcanacaagaaccgagggtaccaaacgtacccccttaaagtccctagacttaccgtacgtatacgacctataccgttaacgttaaggaaacccggagggttcccccaaagttacctaaagggttacctaggtagggtaacgttggggtttacgagggtaccttaaggtttactttttaacctttaccgtacctaatcgaacgtctaccggttcccttaccaaccgttacggaacttacgttactacggtaaccctattaacttacttacgtacgtactaaaccgtntttaagttactaaattacgttaccctacccgtaccttacttaccgggtttaccgtaccgggaaggtaacccggtaaaggtacgtaagggtaaaccttaacgaaacggttaacccgttggtaccggtagtcccgtaaccgaccttcg

SEQ ID NO: 253511 - DNA, 703 bp, Homo sapiens
  misc_feature: GYAE6OF02H792N.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctcatcctccctgtctgcatctgtaggagacagagtcaccatcacttcgccaggcgagtgaggactattaacgtaacttaattttaaattggtatcagcaagaaaccgagggacctaacgtcccctaaactcctagtactacgtacgattgactatacctaattttacggaaacgtcgggtacccagtacgtaacggtttcaaggttacggaaggttcgggtttcgtaaggggtacgtaagtttaatttttttaccctttaccgaacccgtataccgtaacgtctaaccgttccctttacccgaacccgttaggaaagttacttaccgtttacggaacctaaaacttaacgtttactttacgtacggttaacctaaaacgttaggttaattacggtaaacttaacccttccctttaacccgaaccttttaccgtaacggttttccgggaccgggtaccgggaaaccggttgggtaacggtagtaaacgtaccgaaaaccggttgtacggttggacctacggtaccctacgtcg

SEQ ID NO: 253512 - DNA, 561 bp, Homo sapiens
  misc_feature: GYAE6OF02GZPLN.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaacgcccctaaactcctgatctacgatgcatacctaattaggaaacagggtcccatcaaggttcagtaggaagtggttctgggactagtattttacttcacctatcagcagtccttacaccctagaacgattcttgactaactattaattactgtactaaacagttatagtaattaattcctaccctacttccttaccgtttcgggacgggtaacgggaccgtaaagggtaggtaacgacgttaaccgaaacggtaacgtggtacggtactcggacctaccctacg

SEQ ID NO: 253513 - DNA, 646 bp, Homo sapiens
  misc_feature: GYAE6OF02JRS9Z.51.40.D07.1.454.CMB.1.raw
  modified_base (200)..(200): a, c, t, g, unknown or other
  misc_feature (200)..(200): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatcacttgaccaggcgagtgaggacattaagtaacttatttaaatggtatcagacaagaaaccagggacaacgacccctaaactcctagactacgtacgaatcgactattacctaaagtttacgggaaaacgtacgggtacccaagttacgaacggtttcgaaggtacggtaaggttcgggttagtagggacgtagttacttttacgttcactatcagtcagtccttacaccgtagactatcgttagactaacgtattacttactgtacctaaagtagttaatagtaacttaactccttaaccccgtaacttaccgtaaccggtttccgggacggggtaacggtaaccggtaaggggttaccggtaaagtaacgtaaccccgtaaaaaggttaccggttagggtccggtaacgtacgtacccggtaaccttaacg

SEQ ID NO: 253514 - DNA, 823 bp, Homo sapiens
  misc_feature: GYAE6OF02HO78V.51.40.D07.1.454.CMB.1.raw
  modified_base (200)..(200): a, c, t, g, unknown or other
  misc_feature (200)..(200): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatcacttgccaggcgagtgagacatagtaactattaagttgtatcagcagaaccgaggacaacgacccctaaactcctgactactacgatcgactatacctaagtttacggaaacgtacggggtaccccaagtacgtaacgggttaccaaggtttacggaacggttcgggtttaccgttacgggggtaaccgttaaaggtttaacgtttttttacccgtttaccgaacccgtactttaccgaaccggtaccgtaacccggttccccttttacccgtaacccccggttaggtaaaccgttacgtttaccgtttacggaaccctaaacgttaacctttaaaccgtttaccgtttaccggttaacctaaaaccgttaacgtttaacgtaaacgttaaacgttaaacccgttttaccccttaaccccgtaaccgtttacccgttaaccccgggtttttaccgggggaccccgggggtttaaaccggggtaaaccccgggttaaaggggttaaccggggtaacggttaaacccgttaacccgggttaaaaaccggtaaccgggtttacgggtacgggtaaccccggttaccggttaccccgaaacccgtttacccgg

SEQ ID NO: 253515 - DNA, 732 bp, Homo sapiens
  misc_feature: GYAE6OF02HIPJ0.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgacccagtcctccatccctccctgtctgcattcgtaggtaggagactagaacgtccaacctatacctacttcgaccgaggcgaggtacgaggactatttaagtaacttaattttaaagttggttaatcaagtcaaaggaaaccgacgggacaaccgtaccccttaacctcccgtagacttactacgactgactactacctaagttacggaaaacgtcgggtacccagtacgtaacggttacgacggttaggtaacggttggttacgtaggggtaactagtttaacttttttacctttaccgtaccctaagtctaacggtacctacgttacccgttacctacccgtagtaaacgtacttaccgttacggtaaacctaacgttaacttaacctttacttacgttaaaccgtacgtaaagttcgtaataactttaaccttccttaacccctacgttaccttaaccggtttccgggacgggttaacgggtaaccgggtaagggtacgggtaacgtacggttaaaccgaaacggtacgtacgggttaacgtaccgacgtacccgaacgttaccg

SEQ ID NO: 253516 - DNA, 755 bp, Homo sapiens
  misc_feature: GYAE6OF02F22L9.51.40.D07.1.454.CMB.1.raw
tcagcgatcgtatacacgaccggtgctcgatttagtgatagagcgtaacaaacagaggggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtcaccatcacttgccaggcgagtgaggacattagtaactatttaaattggtatcagcagaaaccagggacaacggcccctaaactcctagactctacgatgacatacctaaagtttacgggaaacgtacggggttaccccaagtaccgtaaacggtttcaagggttacgggtaaggttcggtttaccgtaggggaacgtaaggtttaacctttttttaaccttaccgaacctaactaccgtaacggccctaacggtcccctttaaccgaccccgttaggtaaacgtacttaccgttacgaacctaaaccgtaactttaacgtttaaccttacggtaactaaaccgtaaggttaacttaggtaaactttaaccgttacccttaacccctaactttaccgttaaccggtttttccggggaccgggtaaacgggtaacccgggttaaaggggttacgggtaaacggttaaccgttaaccggtaaaaacggttaaccggtttaggggtaccgggtaaccgtttaccggtacccgtaacccgtttaacccgg

SEQ ID NO: 253517 - DNA, 616 bp, Homo sapiens
  misc_feature: GYAE6OF02IA7FF.51.40.D07.1.454.CMB.1.raw
  modified_base (205)..(205): a, c, t, g, unknown or other
  misc_feature (205)..(205): n is a, c, g, or t
  modified_base (442)..(442): a, c, t, g, unknown or other
  misc_feature (442)..(442): n is a, c, g, or t
  modified_base (563)..(563): a, c, t, g, unknown or other
  misc_feature (563)..(563): n is a, c, g, or t
tcagcgatcgtatacacgaccggtgctcgatttagtgatagagcgtaacaacaggaggggggagtcagtcccaaccaggacacagcatggacatgagggtccctgctcagctcctgggctcctgctgctctggctctcaggtgccagatgtgacatccagatcgacccagtctccattccctcccgtgtctgcattctgtagganacagactcaccatcctacgttgccaggcgtagtgaggactattaagtaacttatttaattggtatcacgacaacgaaaccgagggaacaacgtaccctaactccagtactccacgatgacactaccgaagtttgggaaaccgagggtcccaagtcgaaggttcaggtggtaagtcgggtactagggacttacgttacttttaacttcgaacctagtaccagtacctataccccttanacccggtataaccgtacttaccttacggaccttaactagttacttactactacgaactagtactagtaactactacgtcccaggttcctacgttccgggacggtacggtaacgtaggggtntaaacgacgtttaacgaacggttacgttcggtcgtacgtagaccctacgttac

SEQ ID NO: 253518 - DNA, 758 bp, Homo sapiens
  misc_feature: GYAE6OF02FSADH.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgacccagtctccatccctccctgtctgcatctgtaggagacagagtcaccatcacttcgcccgaggcgaggtgaggactaattaagtaacttaattttaaaagttggtaatcagacaacggaaaccgagggaccaaccggacccccttaaaccgtcctacgacttaccgtacgtattcgactactacccttaagtttaacggaaaccggtacgggttacccacgtacgtaaggtttaccgaagggttaggtaaacgggtttcgggttacgtacggggtaacgttaaggtttaaccttttttacctttaccgtaacccttaagtaccgtaacgtccgtaaccgttaccctttacccgtaacccgttagtaaacgtaccgtttacgttaacgaccttaaaccttacgtttaactttaacgttaccgtaacgttaaacgtaacgttagttaacggttaacttaaccgttacccttacccctaacgtttacccgttaccgttttaccgggaccgggtaaccgggaaccgggtaagggtaccggtaagtaaccgttaacgaacggtacgttcggtacggtaccgtggaccctacttacgg

SEQ ID NO: 253519 - DNA, 598 bp, Homo sapiens
  misc_feature: GYAE6OF02IVQK4.51.40.D07.1.454.CMB.1.raw
  modified_base (497)..(497): a, c, t, g, unknown or other
  misc_feature (497)..(497): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaattggtatcagcaagaaccagggcaacgcccctaaactcctgatactacgatcgacatacctaagtttaggaaacgacgggtacccatacgaaggttcaggtaggtacgtggttcgtgggactagttattttacttacactatcagctacgtccttacacccgtagaagtactcttagacctaagtacttaacttaccgttacgtaactaaacgtaggttaatagtaacttaacgttccctaacccnccgtttactacgtttccggggacggtaacggaacccggtaagggttaccggaagtaactaaccgaaacggtacgttacggaggacgttcgaccctactacg

SEQ ID NO: 253520 - DNA, 655 bp, Homo sapiens
  misc_feature: GYAE6OF02FTU2C.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgacccagtctcccatccctccctgtctgcatctgtaggagacagagtaccaccatcacttgccgaggcgagtggaggactattaagtaacttaatttaaagttggttatcagcaacgaaaccgagggaccaacgtacccctaaacctccgtagtactacctacgtatcgactacgttaccttaaggttaacggaaaccggtaacgggtcccaagtacgtaaggttacgaggtagggtacgtgggttacgtagggaactagttacttttacgttacactagtcagtacctcgtacccttaccacccttagaacgtcttacgtacgacctaaagtacttaactttacctaggttaacaagtaacgttaagtataacgtacttaccccttactaacccttgttacccgtttccggggacggtaacgggtaaccgtagggggtacaacggtaacctaacggtaaaccgagttcgggtacgctacgtaccacttacg

SEQ ID NO: 253521 - DNA, 677 bp, Homo sapiens
  misc_feature: GYAE6OF02FRELL.51.40.D07.1.454.CMB.1.raw
  modified_base (660)..(660): a, c, t, g, unknown or other
  misc_feature (660)..(660): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtccaccatccacttgccaggcgagtgaggacattagtaacttaattttaaattggtatcgagcaagaaaccgagggacaacgacccctaactcctagactacgtacgatcgactactacctaagtttacggaaaccgtacgggtaccctaagtaccgtaacggttacgtaaggtacggtaaggttcgggttacgtaggggtaactaaggtttacgttttttaaccgtttaccaacccgttagtacccgaaggtccctaacggttccccttaaccgaccccgttaaggaacgtacgtttaccttacgaccttaaacgtacttaactttactaggtaccaaagtagttaactataaactttactcccttacccgtattccgtaaccgtttccgggacgggtaacggaccgtaaggggtcgaacggtactaaccgaaacggtcgttcgggtaccgtntacggacctaccgtacg

SEQ ID NO: 253522 - DNA, 873 bp, Homo sapiens
  misc_feature: GYAE6OF02I2K2R.51.40.D07.1.454.CMB.1.raw
tcagcgatcgtatacacgaccggtgctcgatttagtgatagagcgttaacgtaacggagaggggggagtccagtcccaaccagggactaccaggtctactggtacgagtagtacgggtccctgcttcaagcctaccgtggggccttcctcgcttggctttcgtggtctactccgtaggggttttcgtccgtaaggtactttaggttttaaggacctacttaccgagtaagtcggtaacccgagttcctacctagttcccgtcccttgtcgtaggcgtactcgtgtacggagaccgtagggtaccgtaccaccgacttcctaccgttacggcccagggaccgtacggttacggtaggtaaccaaggtttaacgttaaacgttaagttttaaagtttggtaactttacgacgtaccgtaaacggaacccgtacgggaccaaccggtaccccttaaacgtaccggtacggacttacgtacgtagtcgtactacttacgttaagtttaacggaaccgtacgggttaacctaactaccggttaacgttacgaacggttaggtaacggtttaccggttcgggtaagggtaaccgttacgtttaaccttttttacgttacctaacccgtacctaaggacgtaccgttaaaccgtccccttaaccgtaaccctacggttactacctttcgttaaacgactaaccttaacctttacgttaccgtaacgtaaccgaactaccggtttagaaccggttatacgttacccttacgcggttacctacgggttcgggacgtaggccggtttaagggtacttaacggtaacgttaaacgaaccgtttaaccggtttcgaccggttcggaccttaccggtaccttacgg

SEQ ID NO: 253523 - DNA, 713 bp, Homo sapiens
  misc_feature: GYAE6OF02I8PPC.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgacccagtctccatcctccctgtctgcatctgtaggagacagagtccaccatcacgttgccgaggcgagtgaggatattagtaacttaatttaaattggtatcgagacaagaaaccgagggacaaccgacccctaaactcctagactctacgtatacgactactacctaaagtttacgggaaaaccgtcggggtaccctagtaccgtaaggtttacgaggttacggtaaggttacgggtttcgtaggggtaacctaaggttaacttttttaaccgttttacgaaccctaataccgagtacctaacgttcccctttaccaacccgttaggaaacgtacttccgttaaggaacctaaaacgttatttaaacctttacgttacgttaaccgaaaattacggtttaactaaggttaaacttacttacccttaacccctacgtttaaccgtaccgttttaccgggaccgggtaacggtaacccggtaaggggttacgaaggtaaccgtaacgtaaaaccgtaggtacggttacggccgtacgactaacccgtacg

SEQ ID NO: 253524 - DNA, 667 bp, Homo sapiens
  misc_feature: GYAE6OF02IR78E.51.40.D07.1.454.CMB.1.raw
  modified_base (512)..(512): a, c, t, g, unknown or other
  misc_feature (512)..(512): n is a, c, g, or t
tcagcgatcgtatacacgaccggtgctcgatttagtgatagagcgtaacaacagaggggggagtcagtccccaaccaggacacagcatggacatgagggtccctgctcagctcctggggctcctgctgctctggctctcaggtgccagatgtgacatccagatgacccagtctccatccctccctgtctgcatctgtaggagacagacgtcaccatcacttcgccaggcgagtagaggactattagtaacttaatttaattggtatcagacaacgaaaccgagggacaacgtacccctaacctccgtagatacctacgtatcgacactacctaaagttacggaaacgtacggggtacccaagttaccgtaaacggtttacgacggtaggtaaggttacgggttcgtaggggaactaaggtttactttttaacctttacctaacctaactacgtaacgtacctaaccggtaccccttacccgaacccgttaggtaaaccgtcttaccggttanaaccgtaactaattaacttactacgtaacaacgtagtatacgtaataacctcctaccctactactaccgttacggacgggacggtaaccgaggggtagaacggtaactaccggaaaccgtacggtaggtacgggtactaccgtaccgacttaccg

SEQ ID NO: 253525 - DNA, 720 bp, Homo sapiens
  misc_feature: GYAE6OF02JJ82R.51.40.D07.1.454.CMB.1.raw
  modified_base (152)..(152): a, c, t, g, unknown or other
  misc_feature (152)..(152): n is a, c, g, or t
  modified_base (169)..(169): a, c, t, g, unknown or other
  misc_feature (169)..(169): n is a, c, g, or t
  modified_base (205)..(205): a, c, t, g, unknown or other
  misc_feature (205)..(205): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
  modified_base (703)..(703): a, c, t, g, unknown or other
  misc_feature (703)..(703): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagtatgngacatccagatcgaccngtctccatcctcctgtctgacatctgtaggagtacngacgtcaccatacaccttgaccgaggcgaggtgaggtaacatttagtaaacttattaaagttggtatacacggtanaacggaaaccgnggacgaaccgtaccctaaacgtccgngtaactctacgactagacctactacgtaaacgtttacgggaaaacgtaccgggtacctaacgtaaccgttaacgggtttacgtaaggtaacggggtacggtttacggggttaaccgtaacggggtaacttaacggttttaaccgtttttaacccgttaccgtaccttaacggtacctaccggtaaccgtaaccggtttcccctaaacgtacccgttaaaggaaccggtacttaccgtagtaacctaagtactttaacgtaactcggtaactaacgtagttactagtacaactttaccgaccctgttacccgtattccgggacgtacgggacgtacggtataccggtaactaaaccggacgtaacggttcgacgttacccgggtntaccctacgttaaccgg

SEQ ID NO: 253526 - DNA, 675 bp, Homo sapiens
  misc_feature: GYAE6OF02IH8YE.51.40.D07.1.454.CMB.1.raw
  modified_base (205)..(205): a, c, t, g, unknown or other
  misc_feature (205)..(205): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
  modified_base (525)..(525): a, c, t, g, unknown or other
  misc_feature (525)..(525): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatcgaccccagtcctccactcctccctgtctgccatctgtagganacagatcacatcacttcgccaggcgagtggagactagttaagtaacttaatttaaatggtatcagcaacgaaacgnggacaacgcccctaaactcctgtactctaacgntacgtacaacttacctaaagtttacggaaacgtacgggtaccctaatacgtaacgggttcgaaggttacgggtaacggtttgggttacgttacgggggtaacttacggttttaacgttttttacttttaacccaaccttaggtaacccgtagaccgtaccgttcccttacgtaacccgtagaaacgtactttccttaacgtacctaaattnttaactttacgtacgttaacaactagtaatacgtaattaccttcccttacctacttcccgttagtaccgggacggtaacgggtaccgaaagggttcgaacaacggttaccaaaaggtccgtacggttcgaccgtacgtaccaacgttccg

SEQ ID NO: 253527 - DNA, 841 bp, Homo sapiens
  misc_feature: GYAE6OF02J1MP1.51.40.D07.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
tcagcgatcgtatacacgaccggtgctcgatttagtgatagagcgtaacaacagagggggagtcagtcccaaccaggacacagcatggacatgagggtccctgctcagctcctggggctcctgctgctctgctctcaggtgccagatgtgacatccagatgacccagtctccatcctccctgtctgcatcgtgtaggancagactcaccatctacttcgccgaggcgagngaggactagttacgtaatatttaactggttaatcgagtcgaacgtaaaccggaggaccaacgtaccccccgttaaaatcccgttacggacttaccgtaccgtaagtcgacctaactaccctaaagttttacgggaaaaccgtcggggtaccctaacgttaccgtaaacggtttacgtaagggtacggtaacggttacggggtttaccgttaggggtaaaccgttaacggttttaactttttttaaacccgtttacccgaaaccggttacgtaacccgtaacggtacccgtaaccgttacccccgtttaaccgtaaccccgttaaggtaaaccgttaccgtttaaccgttaccggaaaacccttaaaccgtaaacgttttaccgtttaaaccgttaccgggttaaaccctaaacgtaacggtttaaacgtaaccggtttaaacttaaacctttaccccgtaacccttaaccgttacccgttaaccggttttaacccggggtacgggaaccgggtaacccggtaaaggggtacgtaaaccggtaaccgtaaaccgtaaacggtaaccggtttcggtaaccggttacaccgggttaaccctaccggttaacccg

SEQ ID NO: 253528 - DNA, 746 bp, Homo sapiens
  misc_feature: GYAE6OF02FLVFN.51.40.D07.1.454.CMB.1.raw
tcagcgatcgtatacacgaccggtgctcgattttagtgatagagcgtaacgaaccaacgagggggacgtcaggtcccaaccacggacacagcatggacatcgagggtccctgctcagctcctaggggccttcctggctgctctggctactcgaggtcgccagatgtgtacatccagatggacccagtctccatcctccctgtcgtgctatcgtagtaggacgactaggacgttaccaaccgattacgtacgtttgacccgaggtccgagtagaaggtactagttaagtaacttaattttaagttggtactacgagaccgaacgaacggaggtacgaacggtcccgtaaacgtcctagacgttctacggtagtacgactactaccgtaattacggaaaccgtacgggtaccctaagtacgtaaggttacgaacggttacggtaaggttcggttccggtacggacgtaacggttacctttttaaccgtacctaaccgttagtaccgtacgtaccgtacgtacccgttaacccgtaccgttacggaacgtactttcgtaacgaccttaaacacgtttaacgtccgtaacggtacgtaaccgttagttaacgttacttaagttaccgttaccctaccgttacgttacgtttaccgttaccgggtacggaacggtaccgttaaggtacggttaacgtaagttaccgaacgttacggttacgggtaccgtacgtccgttaccaccggtaacg

SEQ ID NO: 253529 - DNA, 591 bp, Homo sapiens
  misc_feature: GYAE6OF02FUNV6.51.40.D07.1.454.CMB.1.raw
  modified_base (200)..(200): a, c, t, g, unknown or other
  misc_feature (200)..(200): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtagganacgagagtcaccatcacttgccaggcgagtgaggacattagtaactaatttaattggtatcagcaagaaaccgagggacaacgaccccctaaaactcccgtagactacgtacgatcgcatacctaagtttaggaaacgacgggtacccagtacgtaacggttcaggtaggagttggttactgggactaggtacttttacttcactatcagcgacgtccttcacccgtagaacgtcttcttacgactaactatattactgtactaacgtagtatacgtaattacgtcctaccctacttacgtaccgttcgggacgggtacggtaccggtaagggtcggaagtaacgtaccgtaaacggacgttcggtaccggtcgtacgaccctacgtaacg

SEQ ID NO: 253530 - DNA, 603 bp, Homo sapiens
  misc_feature: GYAE6OF02HREP6.51.40.D07.1.454.CMB.1.raw
  modified_base (482)..(482): a, c, t, g, unknown or other
  misc_feature (482)..(482): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagatacaccatcacttcgccaggcgagtggaggactattaagtaaacttaatttaaagttaggtatacagtacaagaaaccgagggaccaacgaaccccctaaactcctagtactactacgatcgactactactaagttacgaaacggtacggtacccagtacgtaaggttctaaggtaggtaaggtggttacgtaggtaactagttacgttttacttcgaacctatacagctactccctacgtaaccgtagaactattctagactaactatacttactntacaacgtatatagaacttaactaccctacctacgtactaccggttcgggacgggtaacggtaaccgaaggggttgaacgtaagaacctaaggttacgtcggtacgtcctacacctacgtc

SEQ ID NO: 253531 - DNA, 687 bp, Homo sapiens
  misc_feature: GYAE6OF02HU1UW.51.40.D07.1.454.CMB.1.raw
tcagcgatcgtatacacgaccggtgctcgatttagtgatagagcgtaacaacagagggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagtacgtacaccatcctacttcgccgaggacgagtggaaggactaattaagtaattaatttaagttagtatagagacaacgaaacgacgggacaaccgtacccctaaactccgtagtactactacgtatagtactaactacgtaagtttacgggaaaccgtacgggtaccctaagttaacgttaacggtcgtaaggtacggtaaaggttcgggtacgttagggtaactaacggtttacttttttaaccgttacctaaccgtaattaccgacgtaaccgtacgttacccttaacccgtaccgtaacgtaacgttacgttaacgttacgaacttaaacgtaaactttaacttacgtacgttaactaacgtaagttaatagtaacttactacctaccactaccgtacgttcggacgggtacggaaccggtaggtaacggtaagtaacgttaacgaacgtagtacggtgtaccgtcgacctataaccg

SEQ ID NO: 253532 - DNA, 706 bp, Homo sapiens
  misc_feature: GYAE6OF02H8XPU.51.40.D07.1.454.CMB.1.raw
  modified_base (673)..(673): a, c, t, g, unknown or other
  misc_feature (673)..(673): n is a, c, g, or t
tcagcgatcgtatacacgaccggtgctcgatttagtgatagagcgtaacaacagagggggagtcagtccaaccaggacacagcatggacatgagggtccctgctcagctcctgggctcctgctgctctgctctcaggtgccagatgtgacatccagatgacccagtctccatcctccctgtctgcatctgtagagacagagtcacatcacttgcacggcgagtgaggactattagtaactatttaattggtaatcgagacgtaacgaaaccgagggactaaccgaccccgtaaaactctacgtactacctaacgtatacggactaactccgttaaagtttacggaaaccgtaacgggtacccctaagtaccgtaaacggttacctaagggtacggaaacggtttcgggttaacgttacgggggaaactacgggttttaaactttttacccgttttacaaccgtacgtttacgaacggtaccgtaagttccctttaacccgtacccgtaaaggtaagttaactcgtttaccgaactaaatagtttacttagctactaaactagtactacgaattaaaccttcctacccaacgtttaccgtacgtttacggggacccggaaggggttaacccaaaggggttaggaaccctaagttaacccaacgggtttaaccgngggttaccccgaagttccgaacccggacttccg

SEQ ID NO: 253533 - DNA, 681 bp, Homo sapiens
  misc_feature: GYAE6OF02FVPM7.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatccacttgccaggcgagtgaggactattagtaactatttaaattggtatcagcaagaaacgagggacaacgtaccccctaaactcccgtagactacctacgatgacctatacccgtaaagttttacggaaaccggtacggggttaccccaagtacggtaacggtttcggtagggtaaggttcggttcgtagggtacgtaagttacgttttacctttacctacaacttcgacgtacgtacgtcccttaccgtacccgttacggtaactaacgttcgtttacgacctaaacttacgtttaaacttaacgttacgttaacctaaacgtaacgttattaggtaactaacgttacctaccctacttaccgttacgttaccgggtacgggacgggtaaccggagggttacggaacgtacgtaaccggtaaacgtaacgttcgtacgggtacctcggtcccctaactacgttaccg

SEQ ID NO: 253534 - DNA, 677 bp, Homo sapiens
  misc_feature: GYAE6OF02JDV6Q.51.40.D07.1.454.CMB.1.raw
  modified_base (200)..(200): a, c, t, g, unknown or other
  misc_feature (200)..(200): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatcacttgccaggcgagtgaggacattagtaactattaattgtatcagcagaaaccagggacaacgacccctaaatcctgatctacgatgacataccgtaatttaggaaacgtacgggtaccctagttaccgtaaagggtttacgaaggttacgggtaaggttcgggtttacgtacggggacgttaagtttaacgttttttaaccgtttcccgaacctaacgttaccgacgtccgtaaccgtccccgtttaccaaccccgttagaaacgtacttaccgttacggaacctaaacgttacttaactttaccgtacgttaactaaacgtagttaagtacgtaacttaactacccgttaccaccttacgtaccgtttccgggacggtaacgggaacccgtaagggtacggaaggtaacgtaacccgtaaaggtacgttacggtaccggtacgtcgtacccgtaccttacg

SEQ ID NO: 253535 - DNA, 673 bp, Homo sapiens
  misc_feature: GYAE6OF02HHC8N.51.40.D07.1.454.CMB.1.raw
  modified_base (223)..(223): a, c, t, g, unknown or other
  misc_feature (223)..(223): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagcgatcgtatacacgaccggtgctcgatttagtgatagagcgtaacaacaggagggggggagtcagtcccaaccaggacacagcatggacatggagggtccctgctcagctccgtggggctcctgctgctctggctctgaggtcgaccagatgtgacatccagatcgacccagtccaccatccctcccgtgtcagctatcgtaggaaggagactaaggtntacaccaattccaacgttcggaccgagggacggtaggtagaacggtaataagtttaaagtaaactttaaagttttaaaattggtaataccgaagaacaaacgaaaaccgagggaccaaccgtaaccccctaaaatccgtataactaccgtaaggtactacgacctaactaccgttaaagttacgggaaaacgtacggtaccctaatacgtaacgttacgaaggtaggtaaggtttcgtagtacgggaatacgttacttttttacgactaacntaaccgngactacgtcctacacgtagaacgtatactcgaataaactagttaattacgataaccgaatagtaatataacttaactctaccctaagttcctaagttccgggaggtaacggacgtaaggtaccgaaagttaacaaccgtaaacgtcgtggaccgtagacccgataaccctg

SEQ ID NO: 253536 - DNA, 591 bp, Homo sapiens
  misc_feature: GYAE6OF02HHZ2Z.51.40.D07.1.454.CMB.1.raw
  modified_base (172)..(172): a, c, t, g, unknown or other
  misc_feature (172)..(172): n is a, c, g, or t
  modified_base (458)..(458): a, c, t, g, unknown or other
  misc_feature (458)..(458): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtcnccatcctccctgtctgcatctgtagagacagagtcaccatcacttgccaggcagtgaggacattagtaacttaatttaagtgtatcagcaacgaaacgagggacaacgaccccttaaatccctagacttacgtaacgatacgacctataccctaagtttacgggaaacgtaccgggtacccagtaaccgtaaggttaccgaggtaggtaacgttggttacgtagggactaagttactttttacttacactatcacgtcacgtccttacacctagaactctcgttanacaatacttaacttctacgtactaactaagtatacgtattaactaccttaccgacttccgtacgtttcgggacggtacggtaacggtaaggtacgaagtactacgaacgtcgtgacgtacacgtaccacgtac

SEQ ID NO: 253537 - DNA, 678 bp, Homo sapiens
  misc_feature: GYAE6OF02FI3N3.51.40.D07.1.454.CMB.1.raw
  modified_base (148)..(148): a, c, t, g, unknown or other
  misc_feature (148)..(148): n is a, c, g, or t
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
  modified_base (452)..(452): a, c, t, g, unknown or other
  misc_feature (452)..(452): n is a, c, g, or t
  modified_base (531)..(531): a, c, t, g, unknown or other
  misc_feature (531)..(531): n is a, c, g, or t
  modified_base (548)..(548): a, c, t, g, unknown or other
  misc_feature (548)..(548): n is a, c, g, or t
  modified_base (583)..(583): a, c, t, g, unknown or other
  misc_feature (583)..(583): n is a, c, g, or t
tcagcgatcgtatacacgaccggtgctcgatttagtgatagagcgtaacgaacagaggggggagtcagtcccaaccaggacacagcatggacatgagggtccctgctcagctcctggggctcctgctgcctcgtcggctctcagggtnaccagtatggagacctatcccagactacgaaccctagtcctccattcccgtcccgtgtcctgcctatccgtagacggnaccagtactccacctntccacttgccaggcaggctagacctattagtaactatttaaanggtanacgtncgtaacgaaccnggtaccaactacccgtaatctagactaccggtaacntacggttaccaagttttcccgaagttacgggaaaaccncgggtttaacccngttaaccgtaggttaccaacggttcggtaaagttccgggttccgaacgggtttaaccnttttaaacggtttcctaaccgacgttacgtaccactaacgtcgtaccctactaccgtacgtacaactcgttacacctanaactcgtactcggtaanacgtaacgtgtacacgtaactcctaaactccgttnaaccgggtttacgaccgggtaactacgggtacttaggaccgttagaaaccgtagttaacccgcggtaccgaggtacccggaccgttaccgtaccg

SEQ ID NO: 253538 - DNA, 706 bp, Homo sapiens
  misc_feature: GYAE6OF02GI979.51.40.D07.1.454.CMB.1.raw
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
tcagcgatcgtatacacgaccggtgctcgatttagtgatagagcgtaacaacagaggggggagtcagtcccaaccaggacacagcatggacatgagggtcctgctcagctcctggggctcctgctgctctggctctcaggtgccagatgtgacatccagatgacccagtcctccatcctccctgtctgcatctgtagganactagactcaccatccacgttgccaggcgagtgaggacattagtaactatttaatgtatcagcaanaaaccgagggacaacgcccctaaaactcctagtactctacgatcgactattaccgtaaatttacgggaaaccgtacggggtaccctaagtaccgtaaaggtttaccgaaggttagggtaaacggttcgggtttacggtacggggtaacgtaaggtttaacttttttaaccgtttacccaaccgtataccgaagtcgtaaccgtccctttaccaaccccgttaggaacgtacttaccgttacgaactaaactactttaatttacctacggtaactaaacggtagttaactagtaaccttaattaccctacccgtaccttaccgttacgttttaccgggaccgggtaagggtaccgtaaacggggttacgggtaagtaacgttaaaccggtaaacgttaacggtcggtttacggaccggtttaccgacccgtaccttaacgg

SEQ ID NO: 253539 - DNA, 614 bp, Homo sapiens
  misc_feature: GYAE6OF02I71MV.51.40.D07.1.454.CMB.1.raw
  modified_base (122)..(122): a, c, t, g, unknown or other
  misc_feature (122)..(122): n is a, c, g, or t
  modified_base (141)..(141): a, c, t, g, unknown or other
  misc_feature (141)..(141): n is a, c, g, or t
  modified_base (146)..(146): a, c, t, g, unknown or other
  misc_feature (146)..(146): n is a, c, g, or t
  modified_base (150)..(150): a, c, t, g, unknown or other
  misc_feature (150)..(150): n is a, c, g, or t
  modified_base (190)..(190): a, c, t, g, unknown or other
  misc_feature (190)..(190): n is a, c, g, or t
  modified_base (458)..(458): a, c, t, g, unknown or other
  misc_feature (458)..(458): n is a, c, g, or t
  modified_base (516)..(516): a, c, t, g, unknown or other
  misc_feature (516)..(516): n is a, c, g, or t
  modified_base (602)..(602): a, c, t, g, unknown or other
  misc_feature (602)..(602): n is a, c, g, or t
  modified_base (614)..(614): a, c, t, g, unknown or other
  misc_feature (614)..(614): n is a, c, g, or t
tcagcgatcgtatacacgaccggtgctcgatttagtgatagagcgtaacaacagaggggggagtcagtcccaaccaggacacagcatggacatgacgggtcctgctcagctctgggcttccngctgctgtgctctgaggtnccagntgtnactgccagtatcgacccatctaccagtcctcccgtgttcncgactatcgtaggagaatactagacgtaccacctatacgtacgtacgcgaggctagagacgaattattaagttaattaagtttaagtcggtactagaacgagtaacggaacctaggaacctaacctaaccctaagtcgtacactacgtaacgatcctactactaacgtaacgttacggaaccgtacggaccgtaagtacgtaaggttacgaggttaggaacgttcggtacgtaggtaacttacgtttaatttcctaccattacggtanaccgtactcgtacctacgctaacgtatcttacgtactactaatctaacttacagtaanactataattacacgtactacctccgtattacgtaccgaaggcgtaacggacggtaacgagtacgaacttaacggaatacgtgactnacgtactacgtn

SEQ ID NO: 253540 - DNA, 697 bp, Homo sapiens
  misc_feature: GYAE6OF02F62CA.51.40.D07.1.454.CMB.1.raw
  modified_base (200)..(200): a, c, t, g, unknown or other
  misc_feature (200)..(200): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccatcacttgccaggcgagtgaggacattagtaacttaatttaattggtatcagcaagaaaccgagggacaacgacccctaactcctagatctacgatgacatacctaagtttacggaaacgtacggggtacccagtacgtaaggttacgaggttaggtaaggttgggttacgtagggtaacgtagttaacgtttttacctttacgaacctatacgaacgtcctacgtcccttaccaacccgtaggtaactacgttccttagacctaaacttaattaacttaccgttagttacctaaacgtaaggttatacgtaacttaacgttacccttacccgtaacccttaccgttaccgttttaccgggggaccgggttaaccggggtaaccggtaaacggggttacggggtaaagtaaccgttaaacccgtaaaaccggtaaccgttacgggtaccggttaccggtaccggtacccgtaacccgttaacccgg

SEQ ID NO: 253541 - DNA, 621 bp, Homo sapiens
  misc_feature: GYAE6OF02FS215.51.40.D07.1.454.CMB.1.raw
  modified_base (309)..(309): a, c, t, g, unknown or other
  misc_feature (309)..(309): n is a, c, g, or t
tcagcgatcgtatacacgaccggtgctcgatttagtgatagagcgtaacaacagaggggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtccaccatcacttcgccaggcgagtgaggactattagtaacttaatttaaattggtatcagcaagaaccgagggacaacgcccctaaactctagatctacgntgactactacctaagttacggaaacgtacgggtaccatacgtaggttacgaggtaggtaaggttggttcgtagggtaacgtagtttacttttacgttaccactagtacagtcacgtcccttaccgacccgtagtaactcttacttcgaactaactacttacttacttacgtactaactagttaactagtaacttaaccgtccttaccctaacgttccttaccggttcgggtaccgggaacggtaccggtaaacgggtaggaacggtaacctaacgaaaccggttacgtcggtacgcgtacgtaccgtactcg

SEQ ID NO: 253542 - DNA, 666 bp, Homo sapiens
  misc_feature: GYAE6OF02JC6UF.51.40.D07.1.454.CMB.1.raw
  modified_base (345)..(345): a, c, t, g, unknown or other
  misc_feature (345)..(345): n is a, c, g, or t
  modified_base (403)..(403): a, c, t, g, unknown or other
  misc_feature (403)..(403): n is a, c, g, or t
  modified_base (465)..(465): a, c, t, g, unknown or other
  misc_feature (465)..(465): n is a, c, g, or t
  modified_base (539)..(539): a, c, t, g, unknown or other
  misc_feature (539)..(539): n is a, c, g, or t
tcagcgatcgtatacacgaccggtgctcgatttagtgatagagcgtaacaacagaggggggagtcagtcccaaccaggacacagcatggacatgacgggtccctgctcagctcctggggctcctgctgctcgtggctctcgaggtcgccagatgtagacatccagatgaccctgtctccacgtccctcctagtctgctactcgtaggtacgacgacgaggtactccacctacgtcctacgtttcgacgacggtacgagtcgagtaactagttaacgtaacttaattaacgtggtaactagacgacaacgaaccgagggacctaaccgtaccccttaactccgtanactcgtactacgtcgtacacgttaacctaagtaccgggaaacgtccgggttaaacccntaacggtacggttaggaggtacggtagttcggtacgaggtaccgtaacttttcgttttaccnccactgtaccagtcaaccggtcctacgtactacgtactacttcctacggactaaacgttgtaacttaaccggtntaacctaaggacttaaggacttaactaacgtaccctttaccgtaccttacggtacgttcggacggtacgtacggtaggtaccgaagttactaacggtaactcgttacgcgtactaccgacaccttag

SEQ ID NO: 253543 - DNA, 955 bp, Homo sapiens
  misc_feature: GYAE6OF02I5ZUK.51.40.D07.1.454.CMB.1.raw
tcagcgatcgtatacacgaccggtgctcgatttagtgatagagcgtaaacaacagaggggggagtcagtcccaaccaggacacagcatggacatgagggtccctgctcagctcctggggctcctgctgctctggctctcaggtgccagatgtgacatccagatcgaccccagttcctcctacttcccttccccttgtcttcgacattcgtaggtagggacgacgtagacgtaccaacctactacctaaccgttcgaccggaaggacggtaggttaggaacggaacttaatttaacgtttaaaaccgtttaaaatttttaaaacgtttggttaacgtaccgaagtacggaaacgtaaaacccgaacggggaacccaaaccggtaacccccttaaaaccgttccggtaaccgtaacttacccgtaacgaacgttcgtaacctaaccgtttaacctaacggttttaaacgggaaaacccgggttacggggttaacccccgtaaacgtttaaccggtaaccggttttaggtacgggttagggggtttaaacgtttcggggtttaccggtacgggtaaaccgtttaggttttaaccgtttttttaacccgtttacccgtaaacccttaccggttacgaaccggtacccgtaccggttacccccgtttaaccctaacccggttaaacgttaacgttcgttttaacccgttacgtaaccttaaaccgttaacttttaaacgtttacccggttaacggttaactaaaccgttagttaacgttaaacggttaaccttaaccgttaccccttacccgtttaaacccgttaacccgtttaccgggttacggggaaccgggttaaaccggggtaaccggggttaaagggtaaccgggtaaggaaacccggttaacgtaaacgtaggtacgggttacccgtaggtacccgtacccgtaccgtaaccgg

SEQ ID NO: 253544 - DNA, 863 bp, Homo sapiens
  misc_feature: GYAE6OF02IRZN1.51.40.D07.1.454.CMB.1.raw
tcagcgatcgtatacacgaccggtgctcgatttagtgatagagcgtaacaacagaggggggagtcagtcccaaccaggacacagcatggacatgagggtccctgctcagctctggggctcctgctgctctggctctcaggtcgccagatggtgactatccagatcgacccagtcctccacttccctccctgtctgctattcgtagtaaggacgacaggtaactccgaactactccgtacttggacccgtagggcgtaggtacggaggtaactaacgtttaaagttaaacgttaaattttaaagtttacggttaacttacgtaacgtacgtaaaccgggaaaaccggtaacgggggaacctaaacccgggtaacccccttaaaacccgttacccgttaacggtaacctttacccggtaaccgtaacgttacggaaccttaaccgttaaaccgttaaacgttttaaccggggtaaaaccggtaaacccgggggttaacccctaaacgtttaacccggttaaagggttaccgtttaaacgggttaagggtaaacggggtttacggggtttaccggttaacgggggtaaccgttaaggttttaacctttttaaccgttttaccgtaaccctaacgtttaaccgacgtaaccgtacgttacccgttcccgtaacccgttaacggtaacgttactttacgttaccgtaacctaacggtaacttaacgtttacgtaccttaacttaacggtacttataacgtaataacttacctacctacttccttacgttaccggtcggaacgggtaaccgtaagggtacggacgtacgtaaccgtaaacgtcgtacggtacgctacgacctacgtacg

SEQ ID NO: 253545 - DNA, 765 bp, Homo sapiens
  misc_feature: GYAE6OF02J01S6.51.40.D07.1.454.CMB.1.raw
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
  modified_base (569)..(569): a, c, t, g, unknown or other
  misc_feature (569)..(569): n is a, c, g, or t
tcagcgatcgtatacacgaccggtgctcgatttagtgatagagcgtaacaacagaggggggagtcagtcccaaccaggacacagcgatggacatgagggtccctgctcagctcgtgggctccgtgctcgctctggctccgtcaggtcgccaagcgtgtacgactatccaagtatcgacccagtcctccactccctcccttgtctgctatccgnggtaggacgtaccagtagtacccaacctnttaccgacgttacggaccggaggaccgaggttaggaacgtactagttaagttaacgttaattttaagttggtaactacgaagacgaaacgtaaccgagggacctaccgtaacccctaactcctagtactacgttagactactacgtaacctacgttaaaccgttacgggaaaccggtacccggtacgtaccgtaacggttaaccggttacgtaagggttaggtaacggttcgggttacggttacggaacggtttaacgtttacgttttacccgtaccttaacggactaccgtcgtaacgtacccgtccgttaaccgtaccggttaanaacgggtttccttaccgttacccggaattaaacccggttattaaacttccgtacgttaaacgtacgtaaacgttctaacgttaactaccgttaccctaccgttacgtacgttcccgggttaagggaccgtaacggtaagaacggttagaacgttaacgaaccgtaagtacgtcgtagtccacgtaccttacgtacg

SEQ ID NO: 253546 - DNA, 821 bp, Homo sapiens
  misc_feature: GYAE6OF02GFSRT.51.40.D07.1.454.CMB.1.raw
  modified_base (567)..(567): a, c, t, g, unknown or other
  misc_feature (567)..(567): n is a, c, g, or t
tcagcgatcgtatacacgaccggtgctcgatttagtgatagagcgtaacaacaggaggggggagtcagtcccaaccaggacacagcatggacatgagggtccctgctcagctcctggggctcctgctgctcgtgctctcaggtcgccagatgtacgactactaccagatacgacccacgttcctacctacttccccttaccctgtcgtgacctagttcgttagggtaagggagtaacgtaggacgtaccacctactacctaccgtcggccggacgggacgtacggggtagaacggtacgttaacgttttaaacgttaaacttttaaagttttaaagttacggtattacgaaggtaaccgaaacggtaaccggaacgggaacccgaaccctaaccccgttaaacttcgtacgtactaccgtagtactacgtaactaaccttacgtaaacggttaaccgtaacggtccgggtaactacggtaacgtaaggttacggtaagacgggtaggttcggttacggaagtacgttaacgttttacctttaatcctaacgttaacgcgaacccgtntaccctttacccgtacctaaccgtaacgtaacgtaccttagtacgtacttaaactagttaccgttaatccgtaacaaacgttcgtaaagtacttaaaccgtacttcccgtttaccgtaaacggtcccttaaccgggggttacggaccgggtaaccggtaaccggtaaggggtaacggttaaccctaaggttaaacccggacgggtttaaacgttcgggtaccgttaacgtaacccgtaaccgtacccgtttacc

SEQ ID NO: 253547 - DNA, 771 bp, Homo sapiens
  misc_feature: GYAE6OF02IXHGK.51.40.D07.1.454.CMB.1.raw
tcagcgatcgtatacacgaccggtgctcgatttagtgatagagcgtaacaacaggaggggggagtcagtcccaaccaggacacagcatggacatgagggtccctgctcagctccgtggggctcctgctgctcgtggctctcaggtgcctagatgtgactatccgagatcgacccagtcctaccagttcccttccctgtcgtcgactacttcgtacggtaaggacgtacgaaggtacgttaccaaccgtaacttaccgtaaccgttccggacccggaagggtccggaggtaggacggtaactaaacgtttaagttaaaaccttttaaagttttaaaacggttaggttaacgtacgtaacggaacctaaacggtaaaacccggtaacggggaacccgaaacccggtaaccccttaaaccgttccgtacggtaacgttaccgtacgtaacgtcgtactacgtacgtaaggttacggaaaccgtacgggtacctagtacgtaaggttacgtaggtaggtacggttggtacgtacggtacgttacgtttacttttacctacgtactactacgtacgcgtaccttacctacgtaaccgttagtaagtacgttacgtacgtactaacgttaatttaacctaccgtaagtacgtaaacgttataacgtactacgttactacccgtcctaccgttaccgttacggttacggtacggtaacggtacggtaggtaacgagtaactaacgaacgttacgtcggtcgtacgtcgtactagtacg

SEQ ID NO: 253548 - DNA, 661 bp, Homo sapiens
  misc_feature: GYAE6OF02HTA1F.51.40.D07.1.454.CMB.1.raw
  modified_base (148)..(148): a, c, t, g, unknown or other
  misc_feature (148)..(148): n is a, c, g, or t
  modified_base (173)..(173): a, c, t, g, unknown or other
  misc_feature (173)..(173): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
  modified_base (462)..(462): a, c, t, g, unknown or other
  misc_feature (462)..(462): n is a, c, g, or t
tcagcgatcgtatacacgaccggtgctcgatttagtgatagagcgtaacaacagagggggagtcagtcccaaccaggacacagcatggacatgagggtccctgctcagctcctgggctcctgctgctctggctctcgaggtcgccagntgtgacatccagatcgacccagtcnccactccgtccctggtctagcctatccgtaggtacggagtaccaaggtcttacccaactattacctacgttcgaccgacggggtacaggttaggacggtaatacgttaagtaacttaagtttaaattcggtatcgacgacgtaacggaaacccgagggtactaacccggtacccctaacgtctagtactccgtaagtatcgactataccgtagttacggaaacgtaccggtacacgttagaagtcgagtagaggttcgtacgnggaacgttnttactttacgtcacgtntacacgtcacgtctacctacgtagactacgttctacgtactaaactacgttaattacgacgttacctaagtacgtactataccgtaacttacctacctacttaccgtacgtaccggtacgggaacggtaccgtaacggggtcaacggtaccgttaacgaacgtaacggcggttacggtcgtaccgtactaccgttaccg

SEQ ID NO: 253549 - DNA, 508 bp, Homo sapiens
  misc_feature: GYAE6OF01B7Y0Q.43.6.A06.1.454.CMB.1.raw
  modified_base (391)..(391): a, c, t, g, unknown or other
  misc_feature (391)..(391): n is a, c, g, or t
  modified_base (505)..(505): a, c, t, g, unknown or other
  misc_feature (505)..(505): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagaggcccggccgctctccaagacttctcctgtctggggcttgtcagtcgggaagccggagtccctgaccgcttctcgtggcggcggctcgtggaagaacttcactctcaccatctctgccctgganactgatgacgtggctacttattactgtcaacagttgttatcgggtccgttcccattccaccgttcgggccgggggaccaggaactcgactatcagacgaactgtcggctgcacntcg

SEQ ID NO: 253550 - DNA, 508 bp, Homo sapiens
  misc_feature: GYAE6OF01BOTAE.43.6.A06.1.454.CMB.1.raw
  modified_base (357)..(357): a, c, t, g, unknown or other
  misc_feature (357)..(357): n is a, c, g, or t
  modified_base (505)..(505): a, c, t, g, unknown or other
  misc_feature (505)..(505): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagaggccccggccgctctccaagcttctcctgtctgggcttgtcatcgggaagccggagtccctgaccgcttctctggcggcggctctggaanaaacttcactctcaccatctctcgccctggagactgatgacgtggctacttattactgtacaactagtgttagtggtccgttccattccaccgttcgggcgggggaccagaacgtcgacatcgacgacgaacgtgtcggctgcaccgntcg

SEQ ID NO: 253551 - DNA, 517 bp, Homo sapiens
  misc_feature: GYAE6OF01DYAI6.43.6.A06.1.454.CMB.1.raw
  modified_base (514)..(514): a, c, t, g, unknown or other
  misc_feature (514)..(514): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagaggcccggccgctctccaagacttctcctgtctgggcttgtcagtcgggaagccggagtccctgacccgcttctcgtggcggcggctctggaagaaacttcactctcaccatctctgccctggagactgatgacgtggcttacttattactgtacaactagttgttagtcgggtccgttcccattccgaccgttcgggaccgggggaccagactcgacatcgagacgtaatggtggacctgccacgtntcg

SEQ ID NO: 253552 - DNA, 578 bp, Homo sapiens
  misc_feature: GYAE6OF01C969R.43.6.A06.1.454.CMB.1.raw
  modified_base (573)..(573): a, c, t, g, unknown or other
  misc_feature (573)..(573): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctcgtgggcgagagggccgtcatcacctgctcgtccaaccgaggtctttcatacaacttatatagaattattggccttggttccagcagacggcccggccgctctccaagtacttctcctgtctgggtcttgcagtcgggaagccggagtccctcgaccgtcttcgtcgtcgggcggccggcgttacgtacggaaacgtaaacttccaacgttcctacacctatcctcctcgcccgtggacgtacgtgtatcgtacggttggtaccttacttaacttactgtacaacgtagttagttacgtcggtccgttacctagtccgtaccggttcgggaccggggacaaggtaactcgaacgtatcgaacgtaaccgactggtcggactagcctaccgnttccg

SEQ ID NO: 253553 - DNA, 571 bp, Homo sapiens
  misc_feature: GYAE6OF01D3BCR.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcactcgcctcactgagcctgtctcgtgggcgagagggccgtcatcacctgctcgtccaaccaggtctttcatacaacttatatagaattattcggccttggttccagcaggacggccccggccgctcctccaagtacttctcctgtcgtggggtcttgtcagtcgggaagccggacgtcccgtgaccgtcttccgtcgtcgggccggcggctcgtaggaacgtaaacttcacttctaccacctactctctcgccccgtggacgtactgatggaccggtgtccttacttatttactgtacaacgtgttgttatcggtccttacccattccgtaccggttcggggaccggggtaccaaggaactcggaacatacgaacggtacgaaccgttggtacggtctcggccaccgtacg

SEQ ID NO: 253554 - DNA, 764 bp, Homo sapiens
  misc_feature: GYAE6OF01CP9DQ.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtcgtccccggagacatcgtcttcgacccaggccacccgcctcactgacgcctgtcctcgtggggcgaggacgggccgtcatccacctgcctccgtaccaaccgtaggttctttacaataactaacttatatagaattgttcggcctggttccagcaacggccggccccggacgtcctaccgtacctaaagtcctttccgtccgtgtcggttcggggtctttcggtacgacggttaccggggaacggtccccgggtaacgttccccgtacggaccccggttcctttcggtccggtcgggggcccggtccgggtcttacggtaacgggaaaacctaaacctttccaaaccgtcctaaccctaccgtacttccgttccgtaccggtaccccgttaggaacgtaaccgttggtaacgttcgggtaaccggttcggtaacctttaacgtttacgttaccgttagtaacctaacgtcgtttacggtttacgtccgggtacctttacccgtacgttacccggtaccgggtttacccgggggacgggggtaacccagggtaaacccgttccggaaacgtaaccgttacggaacggtaacccgtaagttcggtacggtacgtacgacctaaccgtgttacccg

SEQ ID NO: 253555 - DNA, 622 bp, Homo sapiens
  misc_feature: GYAE6OF01C28EU.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccaggtctttcatacaacttatatgaatattggcctggttccagcagaggcccggccgctctccaagacttctcctgtctgggcttgtcagtcggaagccggagtccctgaccgcttctctggcggcggctcgtggaagaaacttcactctcacctatcctctcgcccgtaggacgactgagtcgacgtcggtacttactttacttacgtcgttaccaacgtagttagtttaagtccggttcccgtttacccctagttacccgtacccgggttaccgggggacccggggggtaacctaacgggtaacgttacccggtaaaccgtacgttaaccggaaacggtaaaccggtaacgttacgggttcgggtaacccgttcggaacccctaacccgttagtttaccccg

SEQ ID NO: 253556 - DNA, 595 bp, Homo sapiens
  misc_feature: GYAE6OF01BQ54Z.43.6.A06.1.454.CMB.1.raw
tcagtgtgagtagtcacgaccggtgctcgatttagatctactgacagggggagctacaacaggcaggcaggggcaacaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagaggcccggccgctctccaagacttctcctgtctggggtcttgtcagtcgggaagccggagtccctgaccgcttctcgtggcggcggctcgtaggaagtaaaccttcgactcgtccacctactcctctcgcccgtggacgtacgtgactgacgtggtcttacttattacgtgtacaactgttgttacgtcggtccgttacccagttcccgtaccggttcgggaccgggggtaaccaacggtactacggaccgtaacgtaccgaacggtaaccggaacgttcgggtacggtacccgtacggtaccccgtaacccgtagtcccgtttaccgg

SEQ ID NO: 253557 - DNA, 505 bp, Homo sapiens
  misc_feature: GYAE6OF01EJLX2.43.6.A06.1.454.CMB.1.raw
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagacggcccggccgctctccaagacttctcctgtctggggcttgtcatcgggaagccggagtccctgaccgtcttcgtctggcggcggctcgtaggaagaacttcactctcaccatctctgcccgtggacgactgatgacgtggctacttattctgtcaactagtgttagtggccgttccacttccaccgttcgggcgggggaccaggaatcgacatcgagacgaactgtgctgcncgntc

SEQ ID NO: 253558 - DNA, 305 bp, Homo sapiens
  misc_feature: GYAE6OF01B4JIW.43.6.A06.1.454.CMB.1.raw
  modified_base (299)..(305): a, c, t, g, unknown or other
  misc_feature (299)..(305): n is a, c, g, or t
tcagtgtgagtagtcacgaccggtgctcgatttagatctactgacaggggcttgtcatcgggaagccggagtccctgaccgcttctctggcggcggctctggaagaaacttcactctcaccatctctgccctggagactgatgacgtggctacttattactgtcaacagtgttatggcgttcccatcaccgttcgggcgggggaccagaatcgacatcagacgaactgtggctgcaccatctgtcttcatcttcccgcatctgaactactcacactgagcgggctggcaaggcgcatgnnnnnnn

SEQ ID NO: 253559 - DNA, 599 bp, Homo sapiens
  misc_feature: GYAE6OF01EHYMH.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttcgacccaggccacccgcctcactgagcctgtctcgtgggcgaggacgggccgtcatcacctgcctcgtccaaccgaggtcttcatacaacttatatgaatatttggcctggttccagcagacggcccggcgctctccaagtacttctcctgtcgtggggtcttgtcagtcgggaacgccggacgtcccgtgaccgtcttcctcgtcgggcggcggctcgtagggaactaaacttcactctcacctatctcgtcgcccgtggacgtactgagtgacgttggccttattacttactcgtactaagtagttagttagtcgggtccgtttaccctacgttcccgtacccggttccggggaccggggggaacctaaacggtaacgtccgaaacgtagtaccgaacggaacggtacgttcggtacgggtacctacggacctaccgtcgttcccg

SEQ ID NO: 253560 - DNA, 590 bp, Homo sapiens
  misc_feature: GYAE6OF01AIYSG.43.6.A06.1.454.CMB.1.raw
  modified_base (340)..(340): a, c, t, g, unknown or other
  misc_feature (340)..(340): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggccacccgcctcactgagcctgtctcgtgggcgagagggccgtcatcacctgctccgtccaaccgagggttcttcatacaacttatatgaattatttcggcctggttccagtcaggacggccccggcgctctccaagcttcctctgtcgtgggtcttgtcagtcgggaagtccggacgtccngaccgtcttctcgtcgggcgcgctcgtgaaagtaacttcactctccactactctctcgcccgtggacgtacgtgatggtacggtggtaccttactttacttacgtcgtaccaacgtgttagttacgtcggtaccgtttcccacttccgtacccgttcggggaccgggggtaccgtagtaacgtaccggtaacagttaccgaaggaacccggtaacgtggtaccggaccgttagaccctcgtaaccttccg

SEQ ID NO: 253561 - DNA, 724 bp, Homo sapiens
  misc_feature: GYAE6OF01BMUFL.43.6.A06.1.454.CMB.1.raw
  modified_base (225)..(225): a, c, t, g, unknown or other
  misc_feature (225)..(225): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtcccggagacatcgtcttcgacccaggccacccgcctcactgacgcctggtctcgtcgggcaggcgggccgtcatcacctgctcgtccaaccnggtcttcatacacttatatgaactattggctggttccagcagacggccgcgctctcaagtctctcctgtcgtcggggtcttgtcagtccgggaaacgcccggtagttacccgaggtaccgtccgtttcggccgtggggccgggtccgggtctaccgtaagggaaacgtaaaccctttcaaccgttcctacctaaccctacttaccttccgtaccggtaccccgttagggaaccgtacggttagtacggttacgtaaccggttcggtacctttaactttacgtttaacgtttacgtaaccgtaaacgttacggttagttttaacggtaccgggttacccgtttacccgtaacgttacccgtacccgggtttacggggtacccggggggtaaccctaacgggttaaaccgtaccggtaaccgtacggttaaccgtaacggtaacccggttaaaccgtcgggttaaccggcggttacggaccctaacccgtagtttacccgg

SEQ ID NO: 253562 - DNA, 820 bp, Homo sapiens
  misc_feature: GYAE6OF01C9A98.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtcgtccccggagacatcgtcttgacccaggccacccgcctcactgacgcctgtcctcgtgggcgaggacgggccgtcatccacctcgctccgtaccaaccgtagggttcctttacaactaactaactttatagtagtaaattagtttcggccgttggttacccaggaccgaacgggaccgggcccccggtaccgtcccttaccgtacccgaaacggttcctttccgttcccgttcggttccggttcgggggtcttttcggtaccgacggttaccggggaaacgggtcccggtaacgttccccgtacggtaccccgttctttcggtccgtcgggaccggtcggtcctacgtacggaaaccgttaaacttccgaaccttcctaccaacccgtacttccgtcgtccgtccccgtagggaacctacgtacggtacgtacggtaccggttacggtacctttaacgtttagtttaccgttacgttaactaacgttacggttacggtttaacgttccgggtacccgtttacccctacgttacccggtaacccggggtttccgggggaaccggggggtaaccctaaacgggtaaccgttaaccgggtaaccgtaacggttacggaaaccgggtaaaccgtaacggttacggggttacgggtaccttacggtaaccccgttacgtaacggttttcccgg

SEQ ID NO: 253563 - DNA, 693 bp, Homo sapiens
  misc_feature: GYAE6OF01EFTSM.43.6.A06.1.454.CMB.1.raw
  modified_base (688)..(688): a, c, t, g, unknown or other
  misc_feature (688)..(688): n is a, c, g, or t
tcagtgtgagtagtcacgaccggtgctcgatttagatctactgacagggggagctacaacaggcaggcaggggcagcaagatgatgctgcagacccaaatcttcatttctctaaaaagctgctctggatctctggtcgtccccggagacatcgtctcgacccaggccacccgcctcactgacgcctgtcctcgtgggccgaggacgggccgtcactccacctgcctccgtacccgaaaccgtgggttcctttacacttaacctaactttatatagtaattagtttcggccttagggttccagacgacggacggccccggccggtccttcctaccgtaaacgtccttttccgttcccgttcggttccggttcgggggtccttttggttaccgaagggttacccgggggaaacggtcccgggtaccgttcccgtacggaccccgttctttccgttccggtcggggtcccggcggtccgttcgtaacgggaaacgttaaaccgttcaaccgttctaccaccgttactcccgtctccgccgttggaacgactgactggacgtcgtaccttattacgttacgtatacctaagtcgttacgttgtaccggtccttacccattccgacggttcgggaccgggtacgagaacgtcgactagacacggacgtacgtcgggtacgtccgcgactccgnttccg

SEQ ID NO: 253564 - DNA, 793 bp, Homo sapiens
  misc_feature: GYAE6OF01BA2VP.43.6.A06.1.454.CMB.1.raw
tcagtgtgagtagtcacgaccggtgctcgatttagatctactgacagggggagctacaacaggcaggcaggggcagcaagatgatcgctgcacgacccaaagtcttctatttctctgctgctcgtggactctcgtggtcgtcccggagacatcgtctacgacccgacggccacccgcctccacgtcgacgcctcgtcgtcgtcgggacgaggacggccgtacactcaccgtcggctaccgtaccgaacgtaggtcttacacttactaacttatatagtaattagttcgcgttacggtaccacgacgacggaccggccggtacccgtctacccgtacaacggttcctttacccgtccgttacggtccggttcggggtaccgttttcggtaccgtaacggtcccgggggtaaacggtccccgggtacggttccccgtacggtacccgtccgttccgtcgggtacgggccggtcggtaccgttaccggtaaggaaaccgtaacctccgacttaccctacgaacccttcttacccgtccggtaccgtacccggtagggaacgttaaccgtacgtaacgttacggtaaccggttacggttaccctttaactttaacgttaacgtacgttaacccgtaagttacggttacggttaccggtccggttaaccccgttaccgaacggttacccgtaccggggttaccggggaccgggtaacctaccgggtaaactcccggaaacttagaaccggtaacgtaaccgtacgtacggtcgacccgtagaccgtacctaagttccg

SEQ ID NO: 253565 - DNA, 638 bp, Homo sapiens
  misc_feature: GYAE6OF01B0N94.43.6.A06.1.454.CMB.1.raw
  modified_base (313)..(313): a, c, t, g, unknown or other
  misc_feature (313)..(313): n is a, c, g, or t
  modified_base (630)..(630): a, c, t, g, unknown or other
  misc_feature (630)..(630): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgaccaggcacccgcctcactgagcctgtctcgtgggcgaggacgggccgtcatccacctgcctccgtaccaaccgtagggttctttacaatacaaactttatactagaattatttcggccttggttccagcaggacggccccggccgctctccaagtcttcncctgtcgtgggtcttgtcagtcgggaacgtccggacgtcccgtcgacccgtcttccgtcgtcggcggcgtctcgtagggaaacgtaaacttccacctcgtaccacctatcctctcgccctggacgtactgacgtgtacgtggtaccttaacgttacttacgttacgtacctaacgtacggttgttaacgtcgggttacccgttaccctactcccgttaccggttccggggacggggggtaaccacggtaacgtacccgaacgtactacggtaacggtaaccgtaacgttcggtacggtccgtaggacctacccggtnttacccgg

SEQ ID NO: 253566 - DNA, 655 bp, Homo sapiens
  misc_feature: GYAE6OF01CPJVI.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtcgtccccggagacatcgtcttcgacccacggccacccgcctcactgacgcctgtctcgtgggcgaggacggccgtcatccacctgcctaccgtacccaaccgtacgggttctttacaacttaactaaacttatatagtaattagttcggtctcggtccagcgaggaccggccgccgcctcacctaatacttcctctgtcgtgggtcttgtcgacggtacgggaacgtccggtacgtcccgtcggacccgtcgttccgtcgtcggcggtccggtcgtaccgtaggaaactaaaccgttcaacctcctaccaccgtactccttccgtacgtcccgtagaacgtacgtagagtacggtacgtcgtaacttattaaccttacgttacgaactaagttacggtatttacggccggttccgtaccattacccgaccgggttaccgggaccggggtaacaaggtaaccgtcgaacgtacgtaacgacggtaaccgaacgttcgggctacgaccgacctaccgtaattcccg

SEQ ID NO: 253567 - DNA, 810 bp, Homo sapiens
  misc_feature: GYAE6OF01C8BME.43.6.A06.1.454.CMB.1.raw
  modified_base (756)..(756): a, c, t, g, unknown or other
  misc_feature (756)..(756): n is a, c, g, or t
tcagtgtgagtagtcacgaccggtgctcgatttagatctactgacgaggggggagctacaacaggcagggcaggggcagcaagatgatgctgcagacccaaatcttcatttctctgctgctctggatctcgtggtcgtcccggagacatcgtcttcgacccacggccacccgcctcactgacgtcctgtccgtcgtgggcggacggacgggtcctcactccacctcgcctccgtaccaacgtcggttcttcaatactaacttatatagtaattacgttcggtaccgttcggttccgacgtaccgaacggtaccgggcccccggtcccgtccgttaccgtaacccgtaaacgtacccgtttccgttcccgttcgggttccggttcgggggtccgtttacgtaccggtaacggtaccggggaaaccgggtcccgggtaacgttccccgtcggtacccgttccgtttccggtccggtccggggtcccgggtccggtaccgttaccggtaaacgggtaaaaccgtaaaccgttaccgtacctaccctacgaacccttaccttcccgtccgttaccgtaccccgggtaggtaaccgtacgttacggtacgtcgggtaacggttaccgtacctttaaccgtttacgtttaaccgtacgttaaacctacggtttaacgtttacggttacggtccggttacccttccgacgttaccggttccgggtaccgggggaccgggtaaccaaggtacgtaccggtaacncgtaacgacggtaaccgtatcgggtacggtactacggaccctacgtcgttcccg

SEQ ID NO: 253568 - DNA, 588 bp, Homo sapiens
  misc_feature: GYAE6OF01BPABH.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtcttcatacaacttatatgaattatttggccttggttccagcagacggccccggccgcctctccaagtacttctcctgtcgtggggcttgtcagtcgggaacgccggacgtcccgtgacccgtcttctcgtcggcggtcggctcgtacgggaaagtaaaccttcgactctacacctattcctctcgccctggactacgtgactgacggtgtcttacttattactgtacctaacgtgttagttagtcgggtcctttacccagttcccgtaccggttcggggaccgggggtaaccctaggtaacgttccggaactacgtacgaacggaccggtaacgtggtcggtactcgacctaaccgtcgttccg

SEQ ID NO: 253569 - DNA, 805 bp, Homo sapiens
  misc_feature: GYAE6OF01AHU8I.43.6.A06.1.454.CMB.1.raw
  modified_base (796)..(796): a, c, t, g, unknown or other
  misc_feature (796)..(796): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgctcactgagcctgtctcgtgggcgaggacgggccgtcatccaccgtgcctcgtaccaaccgtagggtctttcaatactaacttatatgaattagtttcggccttggttaccagtaccgaggtaccgggccccggccgccgttcctaccgaaacgtacctttcctccgttcggtcgtcgggggtcttacggtcgtaaggttccggggaacgtccggtacgttcccgcggtacccgtctttcgtccggttcgggaccggtccgggtcttaccggtagggtaaaaccgtaaaccctttccgacctttacccgtaccgtaacccgttaccgttaccgttccgttaccggtccccgttaagggtaacgtaccgttaacgggttaacgttaccgggtaccgggtttaccgggtacccttttaaccgtttaacgtttaaccgtttaccgtaaccgtaaaccggttacggtttaacggttttaacggtccgggttccccgtttaccctaccgttacccggtaaccgggtttccgggggaacccggggtaaccgaaccggttaacgtacccggtaacgtacgtaccggtaaacggtacccgttaaaggttcggtaccggtacaccggtccctaacccgtnttacccggg

SEQ ID NO: 253570 - DNA, 629 bp, Homo sapiens
  misc_feature: GYAE6OF01AW5XV.43.6.A06.1.454.CMB.1.raw
  modified_base (288)..(288): a, c, t, g, unknown or other
  misc_feature (288)..(288): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggccacccgcctcactgagccctgtctcgtgggcgaggagggccgtcatccacctgctcgtccaacctagggtcttcatacaacttatagtgtaattatttcggcctggttccagtcagacggcccggccnctcctaccaagacttcctcctgtcgtgggcttgtcagtcgggaanccggagtccngaccgcttcgtcgtggccggcggtctcgtacggaagaaacttcgacctctaccgacctatcctcgtcgcccgtaggacgtactgtaacgtcgtacggtcggtacttacgttacttacgtagtacctaacgtagtacggttagttcgggtaccgtttacccgtacttacccgtaccggtttaccggggacccggggtaaccgacggtaaacgtccggtaactacgttaccgaacggtaaccgtaacgtcggtaccggtacgtaccgaccgtacccgtaagtttcccg

SEQ ID NO: 253571 - DNA, 716 bp, Homo sapiens
  misc_feature: GYAE6OF01EI0AS.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctcgtggtcgtccccggagactatcgtcttcgacccaggccacccgcctcactgacgtcctgtcctcgtgggcgaggacgggccgtcactccacctgcctccgaccaaccgtggttcttacatactaacttatatagtaattagtttcggccttaggttaccagtcgacggaccggccccggccgtcctctaccgaacgtcctttccgtccgttcggtcggtcggggtcttcgtacgacggtaccgggaacgtcccggtacgtcccgtcgtacccgtcgttcgtccggtcgggccggtccggtaccttacggtaacgggaaacgttaaacccttccgtaaccgttcctacccgtaaccctaccgttacccgttccgttaccggtacccgtacggtacgtacgtacgtacgtacgtacggggggttactaccgttaacgtttacttacgtacgtactacgtagttacgttacgttcggttaccgttaccgtacgtccgtaccgggtcggggtaccggggtaccgtacgtaacgtaccgtactacgtacgacggtacgtacgtacggtcgtacgtacgacctacgtcgttaccg

SEQ ID NO: 253572 - DNA, 660 bp, Homo sapiens
  misc_feature: GYAE6OF01B40L4.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgacgcctgtctcgtgggcgaggagggccgtcatcactcgctcgtccaacgaggtcttcatactaacttatatagtaattatttcggcctcggttaccagtcaggacggcccggcgctctaccaagtcctctcctgtcgtgggcttgtcagtcgggaagccggtacgtcccgtcgaccgtcttctcgtcgggcggcggtctacgtaggaaacgtaacttcacttctacacctatcctctcgcccgtggactacgtggatacggtcgtgtaccttaacttattacgttgtaaccaacgttaggttacgtttacgttacgggtacccgtttaccccgtaagttcccggttaacccgggtttccggggggacccggggggttaaaccaacgggttaaaccgtcccgggtaaacgtacgtacccggtaacggtaaacccggtaaacgttcgggtaccggtacttaccggtacccgtaaccgtaacgttcccgg

SEQ ID NO: 253573 - DNA, 740 bp, Homo sapiens
  misc_feature: GYAE6OF01BKOE0.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtcgtccccggagactatcgtcttcgacccaggccacccgcctcactgagtcctgtctcgtcgggcgaggacgggccgtcactccaccgtcgcctccgtacccgaaccgtcgggttcctttacgacttaacctaacttatacttagtaattacgtttcggtccgttcggttccgacgaccgtacggaccggccccggcccgtctcctaccgtaacgtaccttccgtccgttcggtccgtggggtccttcgtcgtacggtcgggaacgtccgtacgtcccgtcggtaccgtcttccgtcgtcgggccggtcgtccgtacggtacggaaactaaccgttcctaccgttaccgtacctaccgtacttcccgttccgtccggtacccgtaggtaaccgtcgtacgtacgttacgtccggttacgttacctttaacgtttactttaccgtacgtaacgtaacgtacgtttaggttaccgtccgttacccgttccctaccgttacccggtacccggggttccggggaaccgggggttaaccaacgggttaacctaccggtaacgtacgtacgaacgggaccgtacgtcggttacgacggttacacctacgtattccg

SEQ ID NO: 253574 - DNA, 705 bp, Homo sapiens
  misc_feature: GYAE6OF01COOMJ.43.6.A06.1.454.CMB.1.raw
  modified_base (54)..(54): a, c, t, g, unknown or other
  misc_feature (54)..(54): n is a, c, g, or t
  modified_base (149)..(149): a, c, t, g, unknown or other
  misc_feature (149)..(149): n is a, c, g, or t
  modified_base (233)..(233): a, c, t, g, unknown or other
  misc_feature (233)..(233): n is a, c, g, or t
  modified_base (333)..(333): a, c, t, g, unknown or other
  misc_feature (333)..(333): n is a, c, g, or t
  modified_base (692)..(692): a, c, t, g, unknown or other
  misc_feature (692)..(692): n is a, c, g, or t
tcagtgtgagtagtcacgaccggtgctcgatttagatctactgacgaggggganctacaacaggcaggcaggggcagcaagatgatgctgcagacccaaatcttctattttctctgctgctctggatcttcgtggtccgtaccccgganactacttcggtccttcgaccccgaggcccaccccgcctcaaccgtgaccgtcctcgtccgtcggcgggcgaggacgggtccctnacgtccaccgtcgtacctccgtaacccgaaccgtcggttccttacaataactaacttatatagtaattgttacgctgtccagcgacggaccggcccggcncctctacctaagtccttccgtcgtcggtcgtcggtacttcgtacggtacggtaccggggacgtcccggtacgtccccgttaacggccgttcgtttcgccggtcgggccggtccgtacgtacgtagaaaccgtaacttcgtacctcgtaccactctccgtctcgcgtagtactacgtgagtcggcgttacggtaacttacgttagtaccgttagtaccgtaagttcgttagttccgtacgttcccgtaccgtaccgtaccggtccgggttaaccgggggaccggtaaccgaacgtcggtaacccaggtacgtaacccgtaggtaaacccgttacggtgtaccggtaccgacctaacccgngttccgtttaccg

SEQ ID NO: 253575 - DNA, 564 bp, Homo sapiens
  misc_feature: GYAE6OF01AL3I2.43.6.A06.1.454.CMB.1.raw
  modified_base (338)..(338): a, c, t, g, unknown or other
  misc_feature (338)..(338): n is a, c, g, or t
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
tcagtgtgagtagtcacgaccggtgctcgatttagatctactgacagggggagctacaacaggcaggcaggggcagcaagatgatgctgcagacccaaatcttcattttctctgctgctctggatctctggtgtccccggagacatcgtcttgacccaggccacccgcctcactgagcctgtctctgggcgagaggccgtcatcacctgctcgtccaacgtaggtcttcatacaacttatatagtaacttatttcggccttggttccagcgagacggcccgcgtcctctccaatacgttctctgtcgtgggcttgtcagtcggaagccggacgtccgngtaccgtcttcgtcgtggcgacgctcgtagaagtaaactcgactcncacatctncgccgtgacgtctgacgtcgacgtggtacttaacttattacgtgtacaagtgttacgttagtcgtaccgttccacgttccgaccggttcgggcggggtaccaacgtaacgtcgaactacgttacgaacgtaacgtaaacgttcggtcggactacggacctaacgtcttaccg

SEQ ID NO: 253576 - DNA, 743 bp, Homo sapiens
  misc_feature: GYAE6OF01BY061.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctcgtggtcgtccccggagacatcgtcttcgacccaggccacccgcctcacctgacgcctgtctcgtgggcgaggacgggccgtcactcaccgtgccttccgtaccaaccgtagggttcctttacaactacctaaacttatacttagtaaattagtttacggccgttggttcccaggtccgaggaccggccccggtccgcctccgtaccaagtacctttccgttccttggtccgttcggggtcttcgtcgtaacggtccggggaacgcccgggtacgtcccgtacgacccgtctttcgtcgtcgggcggccgggtctacggtacggaaacgtaaccttcgacctcgtacccactactcctccgtaccgtccccgtaggacgtaccgtgtacgtacgggtacgttcggtacctttacgttaacgtttaactcgttaaccgaacgttacggtttacgtttacgtcgggttacccgttaccgttaccgtttacccggtaccgggttcccgggggaccccgggggtaacctacggtaaacggtacccgtaacgaccgttaacggaccgtaaaccgggaacgtttcggtacggtctaccgggacctaaaccgttcggttacccg

SEQ ID NO: 253577 - DNA, 812 bp, Homo sapiens
  misc_feature: GYAE6OF01CQ05G.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtcgtcccggagacatcgtcttgacccaggccacccgcctcactgacgcctgtctcgtgggcgaggacgggccgtcatccacctgcctccgtaccaaccgtagggttcctttcactactaacttatatagtaattagtttcggtccttggttccagtcgacggaccgggccccggccgcctacctaccgtaacgtacctttcctcccgttcggttaccggttcgggggtcctttggtaccgtacggtacggggaaccgggtcccgggtaccgtccccgtcggtaccccgtcgtttccgtcggtcgggccgggtccggtcgttcggtacgggtaaaaccgttaaaccttcctaccttcctacccgtaacctactttcccgtccggtcggtaccccgtagggtacgtacgttacggtacgttacgggaccggtttacgggtaccttttaacgtttaacgttttaccgtcggttaaaccgtaacggttaggtttaggttacccggtaccggggttacccgttcccgttaacggttacccccgttaccggggttacccgggggggacccgggggtaaaccctaaacggttaaacggtaccccggaacgtaacccgtacggtaaacgggtacccggtaaacggttcgggaaccggttccgtacgaccccgttaaacgtcgtttacccg

SEQ ID NO: 253578 - DNA, 650 bp, Homo sapiens
  misc_feature: GYAE6OF01BL9YI.43.6.A06.1.454.CMB.1.raw
  modified_base (223)..(223): a, c, t, g, unknown or other
  misc_feature (223)..(223): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgaggagggccgtcatccacctgctcgtccaaccgngggtcttcatacaacttatatagtaattatttggcctggttccagtcagacggcccggccgctctaccgaacgtaccttcctcctgtcgtggggtcttgtcagtcgggaacgccggacgtcccgtgaccgtcttcgtctgggcggcggctcgtaggaacgtaacttcacttctacaccgtattccgtactcgcccgttaggacgtctggacttcggacggttggtacccttaagtttacgttaacgttcgtaactaaacggtgttacggtttaacgtccgggttaccctttaccccgaacttacccggtaccccggttccgggggggaacccgggggtaacctaacggtaaaccgtccggtaaccgattacccgaaacgggtaccgtaaccgttggtacggtaccacggtccctaaccgtattcccg

SEQ ID NO: 253579 - DNA, 667 bp, Homo sapiens
  misc_feature: GYAE6OF01B52NL.43.6.A06.1.454.CMB.1.raw
  modified_base (150)..(150): a, c, t, g, unknown or other
  misc_feature (150)..(150): n is a, c, g, or t
  modified_base (191)..(191): a, c, t, g, unknown or other
  misc_feature (191)..(191): n is a, c, g, or t
  modified_base (349)..(349): a, c, t, g, unknown or other
  misc_feature (349)..(349): n is a, c, g, or t
  modified_base (523)..(523): a, c, t, g, unknown or other
  misc_feature (523)..(523): n is a, c, g, or t
  modified_base (648)..(648): a, c, t, g, unknown or other
  misc_feature (648)..(648): n is a, c, g, or t
tcagtgtgagtagtcacgaccggtgctcgatttagatctactgacgagggggagctaacaacaggcaggcaggggcagcaagatgatgctgcacgaacccaatcttctatttctctgctgctctggactctcgtggtacgcccgagactntcgtctcgaccacggtccaccgctcacgtgacgtcctgtcncggtaggacgacggcgggcctacactaccaccgtcgacgtaccgtaccaacggtcggttactacaaactactaagttatagtagtaaattggttcgaccgttcgtaccagccgaggtccggcccgctctactaacgattcctcgactgtaggtccgtntcgtacgcggtaacgggacgtcggtctaccgtcgtcgtccttcggccggagggtccccggtacgtactacgggaaacggtaaacttaacctcgacttaccactacctacgtcgttaccgtcgaccgtaggactagagtacgtacgggacgttcgtactttaacgtattacgtanaaccgttaagtcgttacgtaaccggtccgttaacccgtccgtaacgttacccgggtaccggtaccggggaccgggtaaactggtaaacctacggactacgaaccggacgacgtagtacgtaccgnggtacacgtcgtaattccg

SEQ ID NO: 253580 - DNA, 978 bp, Homo sapiens
  misc_feature: GYAE6OF01BWA2B.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtcgtccccggagacatcgtcttcgaccaggcacccgctcactgagcctgtctcgtgggcgaggacgggccgtcaactccaccctgccttaccgtacccgaaaccgtagggttcctttacaactaacctaaactttatacgttagtaaagtttacgtttcgggcccgttcgggttacccaggtaccgaacgggacccgggcccccgggcccggtcccttaccgtaccccgtaaacggttacccttttcccgttcccgtttgggttccgggtttcggggggttaccttttcgggtacccgtaacgggttaccgggggaaaccggtcccgggtaaccgttccccgttcggaacccccgttcgtttcccgttccggtccgggggccgggtccgggtaccgttacggttaaacggggtaaaaaccgttaaccgtttacccgaacccttccctacccgtaaaccctactttcccgttccgtaccggtccccggttacgggtaacgtacccggttagtacggttaccggtaaccgggttaccggttaacccgtttaacgttttaacgtttaccgttacggttacccgttaaacggtacggttttacgggtttaaccggtttccggggttaaccccgttttaccccgaaccgtttaccccgggttaacccggggtttaccccgggggggaacccgggggggttaacccctaaacggggttaaacccggttacccgggtaaaccgttaacccggttaaccccgggtaaacgggtaaaccgggttaaaccgggtttccggggttaacgggtaccccgttaacccggtaccccgttaaaccccggtaacgtttccccgg

SEQ ID NO: 253581 - DNA, 799 bp, Homo sapiens
  misc_feature: GYAE6OF01AU8UX.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctcgtggtcgtccccggagacatccgtcttcgacccaggccacccgcctcactgagcctgtctcgtgggcgaggacgggccgtcactcaccgtgcctccgtccaaccgtagggttcctttacacttaactaaactttatatagtaagttacgtttcggccttggttaccagtcgacggacgggccccggccgccttcctaccgtaaacggtcctttccgttccgtttcggtccggttcgggggttcctttcggtacgtaacggtaccgggggtaaacgggtcccgggtaaccgtttcccggtacggtacccgtccgtttccggtccggttcggggccgggtccgggtaccgttcggtaaacggggaaaacgttaaaaccccgtttccgaacccgttccctaacctaacccgtaaccttcccgttccgtcccggttaccccgggtaggaccgttaaccgtcgggtaattcggggtaaccgttaccgggtacctttaccgttttaaacctttcgttacggtaacctaacgggttgttacgttaccggtcggttcccgttacctaacgttacccggacgggttacgggggaccgggttaccgaagtacgtaccgtactaccggtacgacggttaacccggaagttccgggtacaccgttaggaccctacgtccgttcg

SEQ ID NO: 253582 - DNA, 744 bp, Homo sapiens
  misc_feature: GYAE6OF01D5UDE.43.6.A06.1.454.CMB.1.raw
  modified_base (727)..(727): a, c, t, g, unknown or other
  misc_feature (727)..(727): n is a, c, g, or t
tcagtgtgagtagtcacgaccggtgctcgatttagatctactgacagggggagctacaacaggcaggcaggggcagcaagatgatgctgcagacccaaatcttctatttctctgctgctctggatctcgtggtcgtcccggagactatcgtcttcgacccgacggccacccgcctcactgcgtcctcgtcctcggtgggcggaggacgggccgtcactccaccgtcgcctccgtaccaaccgtacggttcttacaactactaacttatatagtaattagttcggtccgttcgttaccacgacgacggaccggccccggccgtcctccgtaccgacgtaccttccgttccgtcggttcggtcgggtcttcgtcgtacggtacgggaacggtccggtacgtccgtcgtaccgttccgttcgtcggtcgggccggtcggtaccgttacggtaacgggtaaaccgttaaccttacctaccgttaccctacccgtacctaccttcccgttacccgtccggtaccccggttaggaacctacggttacgacggtttcggtaccggttcgttaccttttaactttacggttaccttacggtaaccttaaggttcggtttaggttacgttccggggtttacccttaccgtaacgttcccgggtaccggggtcggggggaccggtaactacgtaacgtaccgacgtacggaacgtaggaccgtacgtggtccgtacnccttaccagttctaccg

SEQ ID NO: 253583 - DNA, 858 bp, Homo sapiens
  misc_feature: GYAE6OF01DF6X8.43.6.A06.1.454.CMB.1.raw
tcagtgtgagtagtcacgaccggtgctcgatttagatctactgacagggggagctaacaacaggcaggcaggggcagcaagatgatgctgcagacccaaatcttcatttctctgctgctctggatctctggtcgtcccggagactatcgtctcgacccaggcacccgctcactgacgtcctgtctcgtgggcgaggacggcctcactccacgtcgcctccgaccgaaccgtaggttcttacactactaacttataatagtaaattgttcggccttacggtaccagcgaacggaccggcccggccgtcgtacctaccgtaacgtccttcgtccgtggtccggttaggggtcttacgtcgtaacggtaccgggtaacgggtcccggtaacgttcccgtacggaccccgtccgtttcgtcggtcggggaccggtccgggtacctacggtaacgggaaaccgttaaaccttcccgtaacctttccgtaaccctaaccgtaccttccgttacccggtccggtacccgttagggacgttaaccgttacgaaccggttaccgggttacggttacggtttaacctttaacgttttaacccgttacggttacgttaaaacggttaacgtttacgggttttaccggttaacgggttccgggttaaccccgtttaccgtaacccgggtttacccgggtaaccccggggggtttccgggggggaaaccccgggggttaacaaaccggttaccgggtaacccgtaaaccgggtaaacttaacccgggtaaaaccggttaaaccgggttaacggttcccgggtacgggtaacccctacgggttaaaccctaacccgtttaggtttaccccgg

SEQ ID NO: 253584 - DNA, 690 bp, Homo sapiens
  misc_feature: GYAE6OF01AZ2D9.43.6.A06.1.454.CMB.1.raw
  modified_base (206)..(206): a, c, t, g, unknown or other
  misc_feature (206)..(206): n is a, c, g, or t
  modified_base (484)..(484): a, c, t, g, unknown or other
  misc_feature (484)..(484): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtcgtccccggagacatcgtcttgacccaggccacccgcctcactgagcctgtcctcgtgggcgaggacgggccgtnatccacctgcctccgtaccaaccgtgggttcctttcgaactaactaaactttatatagtaattagtttcggccttggttccagtccgacggaccgggccccggcctccgtacctaccgtaacgtacctttccgttccgttcggtccggttcggggttcctttcggtacgtacggtaccggggaacggtcccgggtacgttccccgtacgtacccgtcctttcgtccgtcgggccggtcgcgtcgtaggaactaacctcaccttcaccactactcctcncgtccgtggactacgtcgtatcggtacgttgtactttacttactactacgtactaacgttagttacgttaggtccgttaccgttaccctactacccgtaccggggttccggggaaccggggtaaccaaccggtaacgtaccggaacgtacgtaccggtaacggaacgttaccgtggtcgtacctacgaacccttcgtcgtttaccg

SEQ ID NO: 253585 - DNA, 349 bp, Homo sapiens
  misc_feature: GYAE6OF01B4A0C.43.6.A06.1.454.CMB.1.raw
  modified_base (135)..(135): a, c, t, g, unknown or other
  misc_feature (135)..(135): n is a, c, g, or t
  modified_base (321)..(321): a, c, t, g, unknown or other
  misc_feature (321)..(321): n is a, c, g, or t
  modified_base (324)..(349): a, c, t, g, unknown or other
  misc_feature (324)..(349): n is a, c, g, or t
tcagtgtgagtagtcacgaccggtgctcgatttagatctactgacagggggagctacaacaggcaggcgaggggcagcaagatgatgctgcaacgaacccaaattcttctattttctctgctcgcttcgtaggtnttcttccgttcgggtccggtcccccgggaaggtacctacgttccgttccgttacggaacccgaacgggaccctccccggcctccaacgtcgaacgtccttcggtctcggtcgggcgagggtacggcgtcaacttcaccgtcgcctaccgtaccgaacgtaggttcttacgtaactaactaatatanagnnnnnnnnnnnnnnnnnnnnnnnnnn

SEQ ID NO: 253586 - DNA, 808 bp, Homo sapiens
  misc_feature: GYAE6OF01CSCE4.43.6.A06.1.454.CMB.1.raw
  modified_base (148)..(148): a, c, t, g, unknown or other
  misc_feature (148)..(148): n is a, c, g, or t
  modified_base (664)..(664): a, c, t, g, unknown or other
  misc_feature (664)..(664): n is a, c, g, or t
tcagtgtgagtagtcacgaccggtgctcgatttagatctactgacagggggagctacaacaggcaggcaggggcagcaagatgatgctgcagaacccaaatcttcatttctctgctgctctggatctcgtcggtcgtccccggagacntcgtctcgacccgaggccacccgcctcactgacgtcctgtctcgtgggaccgaggacgggccgtacactccaccgttcgccttaccgaccacgtacggttcttacaactactaacttatactaagtaacttagttcggtaccttcggttaccaggtaccgacggtaccgggccccggtaccgtcctaccgtacccgaaacgttccctttccgtcccgttacggtccgggttcgggttacgtttcgtaccgtaaccgggtacggggaaaccggtcccggtaaccgttcccgtacggtaacccgttcgtttacgccgggttacggggcccggtccggtacgtttacgtaacgggtaaaacctaaaccgttccctacgttaccctacgaccttacgttcccgtccgtaccgtccggaaggtacgtacgtcggtaagtccggtacggttcgtaacctttacgtttaagactttgtaaacgtaacgttgggtttacgtccggttacgttccccgttaaccncgttacccggttacccggggtaacggggggtacccggaaacctaccggttaacgaccggtaaccgtaacggtaaccggaaacgggttaaacccggtgttccgggtccgacgttacccggaaccttaccggtccgttttacccgg

SEQ ID NO: 253587 - DNA, 909 bp, Homo sapiens
  misc_feature: GYAE6OF01CEWE8.43.6.A06.1.454.CMB.1.raw
tcagtgtgagtagtcacgaccggtgctcgatttagatctactgacgagggggagctaacaacaggcaggcgaggggcagcaagatgatgctgcacgacccaaatcttcatttctctgctgctcgtggatcgtcgtggtcgtcccggagacactcgtcttcgacccgacggccacccgcctcgacgtcgacgtccgttgtcgtcgtgggcgaggacgggccgtcgactcctaccgtcgccgttccgtacccgaaccgtaggttacctttacgaacttactaacttagttaacttacgtaacgtttacgtttaccggtccgttcggttaccgacggtacgtaacgggacccggggtcccccggaccgtcccgttacccgtaacccgtaaacggttaccctttccgttcccgtttcgggttaccgggttcgggttccgttttcggttaacccggtaacgggtaccggggtaaaccggttccccgggtaaccggttacccccggttcgtaacccccggttcgttttacccggttaccgggttcggggtcccgggtccggtaccgtttaaccgggtaacggtaaaaccggttaaccctttacccgtaccgttacctacccgtaacccgttcttaccccgtccgtaccggtcccggttaagggtacgtaaccgtcggtacgttacgggtaaccgtttcggttaacctttaacgttacgtttaacgtcttaacgtaacgtttcggttaacggtttccggtccgtttaccgttaccgtacgttacccggtaccgggttccgggggaaccgggttaaccgacgggttaaacctccgggaacccttaggaacccggttaacgaacgggttacccgttcggtccgggtaccttaccggaccttaaccgttccgttaccgg

SEQ ID NO: 253588 - DNA, 572 bp, Homo sapiens
  misc_feature: GYAE6OF02IHGUB.43.6.A06.1.454.CMB.1.raw
tcagtgtgagtagtcacgaccggtgctcgatttagatctactgacagggggaggctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagaggcccggccgctctccaagaccttctcctgtctggggcttgtcatcgggaagccggagtccctgacccgcttctctggcggcggtctcgtggaacgtaacttcacttctacacctatcctctcgtccctggacgactgatgacgttcgtccttacgtttacttactgtacaacgtagttgttaagtcggtcgttcccattccgtaccgtttccggggaccgggggaccgacgtaacgttccgaactacctacgaacgtaaccgtaacgttcggtcggtccgttacggacctacccgtagttccg

SEQ ID NO: 253589 - DNA, 517 bp, Homo sapiens
  misc_feature: GYAE6OF02IA176.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagaggcccggccgctcctccaagacttctcctgtctggggcttgtcatcgggaagccggagtccctgaccgcttctctggcggcggctcgtagaagaaacttcactctcaccatctctcgccctggagactgatgacgtgcttacttattactgtcaactagttagttatggtccgttccctatcctacgttccgggacgggggacctagaacgtcgaactactcgacgtaacgaactggcgcgtgcacatcg

SEQ ID NO: 253590 - DNA, 510 bp, Homo sapiens
  misc_feature: GYAE6OF02GWKCJ.43.6.A06.1.454.CMB.1.raw
  modified_base (361)..(361): a, c, t, g, unknown or other
  misc_feature (361)..(361): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagaggcccggccgctctccaagacttctcctgtctggggcttgtcagtcgggaagccggagtccctgacccgcttctctggcaggcggctctggaanaaacttcactctcaccatctctcgccctggacgactgatgacgtggctacttatactgtcaacagttgttaatggtccgttcccatctaccgttcgggacgggggaccaggaacgtcgacacgtcagacgaacgtgtgctcgcactacg

SEQ ID NO: 253591 - DNA, 540 bp, Homo sapiens
  misc_feature: GYAE6OF02JLWXR.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagaggccgtcatcacctgctcgtccaaccagggtcttcatacaacttatatgaatattggctgttccatcagaggcccgcgctctccaagacttctcctgtctgggtcttgtcatcgggaagccggagtccctgaccgtctctcgtggtccggcggctcgtggaacgaacttcactctcaccatcctctcgccctggactactgactgacgttcgcttacttattactgtacaactagtcttagtcggtcgttcccattccgtaccgttcgggtaccggggtaccgtagaacgtacgaacgtacgtacgacgtaaccgtaacgtacgtcggactcggacctaccgataccg

SEQ ID NO: 253592 - DNA, 583 bp, Homo sapiens
  misc_feature: GYAE6OF02JWGEI.43.6.A06.1.454.CMB.1.raw
  modified_base (219)..(219): a, c, t, g, unknown or other
  misc_feature (219)..(219): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaacnggtcttcatacaacttatatgaatattggccttggttccagcagacggcccggccgcctctaccaagtaccttctcctgtcgtgggtcttgtcagtcgggaagccggtacgtccctgaccgtcttcgtcgtcgggcggcggctcgtggaaacgtaacttcgactctcaccactctctcgccgtggactactgtacgtcgacgttcggtaccttacttacttacgtagtaccaacgtagttgttacgtcggtccgttaccctacgttaccgtaccggttccggggaccggggacctacggtaacgtccggaactactacgtacgaaccgtacgtcggtcggtaccgtacgacctaccgtcttacg

SEQ ID NO: 253593 - DNA, 582 bp, Homo sapiens
  misc_feature: GYAE6OF02I7YDU.43.6.A06.1.454.CMB.1.raw
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (517)..(517): a, c, t, g, unknown or other
  misc_feature (517)..(517): n is a, c, g, or t
tcagtgtgagtagtcacgaccggtgctcgatttagatctactgacagggggaggctactaacaggcaggcaggggcagcaagatgatgctgcaggacccaaatcttcatttctctgtctgctctggatctctggtgtccccggagaacatccgtacttgacccaggcacccgcctcactgacgcctggtctctgggcgagacgggccgtcatcacctgcctcgtccaacnggtcttcatacaacttntatgaatattggctgtccagtcagaggccgcgctcgtccaagcttctcctgtctgggcttggtcatcgggaanccggagtcccngaccgcttcgctggccggcggctcgtggaacgaaacctttcgactctacaccgatctctgccctggacgactgatgacgtggactacttattactgtacaacgtagtgttaacgtggtaccgttacccgattccgaacccgtttcggggacccggggggtacctaacgggtaacgttaccggaacncgtaaccgtaacggtaacggtaacgtaacggttacggtaccgtacggtaccgtaccgtacgtacg

SEQ ID NO: 253594 - DNA, 586 bp, Homo sapiens
  misc_feature: GYAE6OF02GQR45.43.6.A06.1.454.CMB.1.raw
tcagtgtgagtagtcacgaccggtgctcgatttagatctactgacagggggagctacaacaggcaggcaggggcagcaagatgatgcgtgcagacccaaatcttcatttcgtctgctgctctggatctcctggtgtccccggacgacatcgtcttgacccaggcacccgcctcactgacgcctgtctcgtgggcgagacgggccgtcactcacctgcctcgtccaaccgagggtctttcatacaacttatactgaatatttggcctggttccagcagtacggccccggaccgctctccaagtaccttccgtacctgtcgtggggcttgtcagtccggggaacgccggtagtcccgtggacccgtctttactcgttgggcggcggctcgtagggaaactaacttcactctcaccatctctcgggccctggactactgactcgacgttcggcttacttacttacgtgtacacgtagttagttagtcggtccgttacctagttcctaccgttcgggaccggggtaccaggtacgtacgactactacgaacgtaacgtacgtggtcggtcgtcgacgtaccgtgttaccg

SEQ ID NO: 253595 - DNA, 546 bp, Homo sapiens
  misc_feature: GYAE6OF02GR783.43.6.A06.1.454.CMB.1.raw
  modified_base (274)..(274): a, c, t, g, unknown or other
  misc_feature (274)..(274): n is a, c, g, or t
tcagtgtgagtagtcacgaccggtgctcgatttagatctactgacagggggagctacaacaggcaggcagggcagcaagatgatgctgcagacccaaatcttcatttctctgctgctctggatctctggtgtccccggagacatcgtcttgacccaggcacccgctcactgagcctgtctctgggcgagagggcctcatcacctgctcgtccaaccagggtctttcatacaacttatatgaatatttggcctggttccagcagacggcccggcnctctccaagacttctcctgtctgggcttgtcagtcgggaagccggagtcccgtgaccgtcttctcgtggcggcggctcgtaggtaactaacgttcactctcacctatctctcgccctggacgtctgactggacgtggtacttacgttacttacgtcgtacaacgtgttagttacgtcggtacttccagttccgtacgttacgggcggggtaccaggtactacgactagtacgaacgtacgaacgtcgtacggcgtacgctaccgtagttccg

SEQ ID NO: 253596 - DNA, 492 bp, Homo sapiens
  misc_feature: GYAE6OF02GSGIV.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagaggcccggccgctctccaagacttctcctgtctggggcttgtcatcgggaagccggagtccctgaccgcttctctggcggcggctctggaagaacttcactctcaccatctctgccctggacactgatgacgtggctacttattctgtcaacagtgttatggcttcccatcaccgttcggcgggggaccagatcgacatcagacgactgtcggctgacaccatccg

SEQ ID NO: 253597 - DNA, 680 bp, Homo sapiens
  misc_feature: GYAE6OF02JLD7D.43.6.A06.1.454.CMB.1.raw
  modified_base (332)..(332): a, c, t, g, unknown or other
  misc_feature (332)..(332): n is a, c, g, or t
  modified_base (357)..(357): a, c, t, g, unknown or other
  misc_feature (357)..(357): n is a, c, g, or t
  modified_base (381)..(381): a, c, t, g, unknown or other
  misc_feature (381)..(381): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggccacccgcctcactgagcctgtctctgggcgagacgggccgtcatcacctgctcgtccaaccagggtcttcatacaacttatatgaatattggccttggttccagcagacggccggccgctctccaacgtacttctcctgtcgtgggcttgtcagtcgggagccggacgtccncgccgtcttctcgtggcgcggctcnggaacgtaacttcactctcacctntactccgtcgtcctggacgtctagacgtcgtacgttcggtccttaacgtttacgttacgttacgtacctaaacggtacggttacgtttaaacgtcgggttacccgttaccccgtaacgtttacccggttaacccggttaccgggggtacccgggggggtaaaccctaacgggttaaccgtaacccgggtaaacccgttaacgttaccggtaaaccgggtaaacccggttaaaccggttaccggggttaccggtacccggttaccggtaacccggttaaccccgtaccgttttaacccgg

SEQ ID NO: 253598 - DNA, 578 bp, Homo sapiens
  misc_feature: GYAE6OF02HMMTF.43.6.A06.1.454.CMB.1.raw
  modified_base (238)..(238): a, c, t, g, unknown or other
  misc_feature (238)..(238): n is a, c, g, or t
tcagtgtgagtagtcacgaccggtgctcgatttagatctactgacaggggagctacaacaggcaggcaggggcagcaagatgatgctgcagacccaaatcttcatttctctgctgctctggatctctggtgtccccggagacatcgtcttgacccaggcacccgcctcactgagcctgctctgggcgagagggccgtcatcacctgctcgtccaaccagggtctttcatacaacttanatgaatattgctggtccagcagacggtccggccgctctccaaggtaccttctaccctgtcgtcggggtctttgtcagttccgggaagtccggagtcccgtgacccgctttcgctgggcggcgcttcgaggaagaacttcgaactcgtcacctctctcgtcgcctggacgactgtagtcgacggttcggacttacgttattcgtacgtacaactagttcgttacgtcgggtccttaccgtacttccgtaccgttcggggaccgggggtacctagggaacctccggaactaacgtaccgaacgtaaccgagtcggtaggccgtacggactaccgtattcccg

SEQ ID NO: 253599 - DNA, 539 bp, Homo sapiens
  misc_feature: GYAE6OF02HVWB5.43.6.A06.1.454.CMB.1.raw
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccaggtctttcatacaacttatatgaatatttggcctggttccagcagaggcccgccgctctccagacttctcctgtctgggcttgtcatcgggaagccggagtccctgaccgcttctctggcggcggctctggaanaacttcactctcacatctctnccctggatactgatgacgtgctacttattactgtcaacgtagttacttagtggtccgttcccattccgaaccgtttccggggaccggggggtaccagtaacgtccgaaccgtataccgaagaaccgaactacggtcggtaccgttcggacctaccgtattcccg

SEQ ID NO: 253600 - DNA, 644 bp, Homo sapiens
  misc_feature: GYAE6OF02H3BQD.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggccacccgcctcactgagcctgtctcgtgggcgagagggccgtcatcacctgctcgtccaaccgagggtctttcataccaacttatatagtaattattggccttggttccagcaggacggccccggccgctcctaccaagtaccttctcctcgtcgtcgggtcttgtcacgtacgggaacgccggtacgtcccgtcgacccgtcttcgtcgtcgggccggcggtctcgtaggaaacgtaaccttcactcctactacctactcctctcgtcccgtaggacgtacgtagacgtggtaccgttggtaccttaacgttacttacgtcgtaacctaacgtagttagttacgtcgggttacccgttccctaacgttcccgtaccggttacccgggggaccggggaaccacgggtaacgtaccggaacgttacgaccgtaacggtaaccgtacggttcggtacggtccgtacgtaccgacccgtagttacccg

SEQ ID NO: 253601 - DNA, 494 bp, Homo sapiens
  misc_feature: GYAE6OF02JATQW.43.6.A06.1.454.CMB.1.raw
  modified_base (360)..(360): a, c, t, g, unknown or other
  misc_feature (360)..(360): n is a, c, g, or t
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggccacccgcctcactgagcctgtctctgggcgagagggccgtcatcacctgctcgtccaaccagggtctttcatacaacttatatgaatattggccttggttccagcagaggcccggccgctctccaagacttctcctgtcgtggggcttgtcagtcgggaagccggagtccctgaccgcttctcgtggcggcgctctgaanaacttcactctcaccatctctcgccctggagactgactgacgtgcttacttattactgtcaacagtgttatggccgttccatcaccgttcggcggggaccngaatcgactanacagacgaatgtgctgcacatc

SEQ ID NO: 253602 - DNA, 180 bp, Homo sapiens
  misc_feature: GYAE6OF02IPJ14.43.6.A06.1.454.CMB.1.raw
  modified_base (177)..(180): a, c, t, g, unknown or other
  misc_feature (177)..(180): n is a, c, g, or t
tcagtgtgagtagtcacgaccggtgctcgatttagatctactgacaggggcttgtcatcgggaagccggagtccctgaccgcttctctggcggcggctctggaagaaacttcactctcaccatctctgccctggagactgatgacgtggctacttattactgtcaaacagtgttatnnnn

SEQ ID NO: 253603 - DNA, 498 bp, Homo sapiens
  misc_feature: GYAE6OF02GNUIM.43.6.A06.1.454.CMB.1.raw
  modified_base (392)..(392): a, c, t, g, unknown or other
  misc_feature (392)..(392): n is a, c, g, or t
  modified_base (495)..(495): a, c, t, g, unknown or other
  misc_feature (495)..(495): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagaggcccggccgctctccaagacttctcctgtctggggcttgtcatcgggaagccggagtccctgaccgcttctcgtggcggcgctcgtggaagaacttcactctcacctatctctcgccctggacnctgatgacgtgctacttattactgtcaactagttgttatggtcttccatcaccgttcgggcggggaccagactcgacatcgagacgaacgtgtcggctgcacntcg

SEQ ID NO: 253604 - DNA, 654 bp, Homo sapiens
  misc_feature: GYAE6OF02IDAJG.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatattggcctggttcagcagagccgcgctctcagcttctcctgtctgggcttgtcacgttcgggaacgccggtacgtcccgtcggacccgtctttcgtccgtcgggccggcggccgtcgtacggaaacgtaaccgttccaccttctaccaaccgtacttacccttcgtcgaccccgttgggaacgtaccgtagagttcggaaggttcgggtacctttaactttaactttaaccgtgtaccaaacgtagtttaacgttacgttacgggtccgtttaccccaacgtttcccgtaaccccggttttacggggggacccggggggtaacctaagggtaaccgtccggaactaacgttaccgaaacggtaccgtaaacgtcggtacgggtccttacggacctacccgtattcccg

SEQ ID NO: 253605 - DNA, 596 bp, Homo sapiens
  misc_feature: GYAE6OF02IJ532.43.6.A06.1.454.CMB.1.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (389)..(389): a, c, t, g, unknown or other
  misc_feature (389)..(389): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagaccatcgtcttagacccaggccacccgctcactgagcctgctcgtgggcaggaggccgtcatcacctgctcgtcaacnggtctttcatacaattntatgaatattgcttcggtcagacagacggcccgcgtctctccaaagcttctcctgtcgtgggccttgcagtcgggaagtccggatcccaggccgctttcgtcgtacgggcggcggcttcgagggaaaccaactttccgaactctacgaacctntccgtctcgtcccgtagacgtactgatcgacgtggtacttaacttagttaactgtaacctaagtacgttagttacgtcggacccgtttacctagttcccgtacggtttaccgggggacgggggtaaccctaggaaccgttaccggaaacctgttacccgaaaggtaacccgtaagttacggtcggccgttagccctacgtactccgg

SEQ ID NO: 253606 - DNA, 532 bp, Homo sapiens
  misc_feature: GYAE6OF02FJCSO.43.6.A06.1.454.CMB.1.raw
  modified_base (240)..(240): a, c, t, g, unknown or other
  misc_feature (240)..(240): n is a, c, g, or t
tcagtgtgagtagtcacgaccggtgctcgatttagatctactgacagggggaggctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttntatgaatatttggcctggtttccagcagaggcccggccgctctccaagacttctcctgtctggggcttgtcatcgggaagccggagtcccgtgaccgcttctctaggcggcggctcgtggaacgtaaacttcactctcaccatctctcgccctggacgactgatgacgttggcttacttacttactgtcaactagtagttagtcgtcgttcccatcctaccgttcgggacgggggaccagaactcgaacactctaagtaccgaacgtcggtcggtctgcctacctattaccg

SEQ ID NO: 253607 - DNA, 646 bp, Homo sapiens
  misc_feature: GYAE6OF02HQHUO.43.6.A06.1.454.CMB.1.raw
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (378)..(378): a, c, t, g, unknown or other
  misc_feature (378)..(378): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggccacccgctcactgacgcctgtctcgtgggcaggacggcctgatcacctgctcgccaaccgtagggttcctttccaatacctaacttagtactaggaattacgttggccttggttccagcgtagacgggcccggccncctctaccgaaacgtccgttctcccgtgtccgngggtcttgcagttccgggaacgtccggactccgacgaccgtctttacgngtcgggcggtcggctcggtacggaaactaaccttcaacttctaccaccgtactcttcgtcgcccgtagacgtacgtcgagtcgtacggtcggtacttactttacgttaacgtcgtaacctaacgtacgttacggtacgttcggtccgttaccctagttcccttacgggtaccgggtaccgggggacctacggtaacgttcccgaaactcgtaacgaaccggtaacgtaaccggtcgtcggtaccgttacggacctccgtaacgttccg

SEQ ID NO: 253608 - DNA, 562 bp, Homo sapiens
  misc_feature: GYAE6OF02GEO4H.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagacggcccggccgctctccaagacttctcctgtctggggcttgtcagtcgggaagccggagtccctgaccgcttctcgtggcggcgctctggaagaacttcactctcaccatctctgccctggacgactgatgacgttggccttacttacttactcgttacaactagttgttagtcggtaccgtttcccattcctacccgttccggggaccgggggaacctaggtaactaccggtaacacttaccgaacgtaccggtaaacgttcggtacggtccgtcggacctaccgtacgttccg

SEQ ID NO: 253609 - DNA, 611 bp, Homo sapiens
  misc_feature: GYAE6OF02GNRKG.43.6.A06.1.454.CMB.1.raw
  modified_base (269)..(269): a, c, t, g, unknown or other
  misc_feature (269)..(269): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (337)..(337): a, c, t, g, unknown or other
  misc_feature (337)..(337): n is a, c, g, or t
tcagtgtgagtagtcacgaccggtgctcgatttagatctactgacagggggtaggctactaacaggcaggcaggggcagcaagatgatgctgcaggacccaaatcttcatttctctgtctgctctggatctctggtgtccccggagaacatccgtacttgacccaggtcacccgcctacactgacgtcctggtctctgggccgagtacgggccgtcactcacctgcctccgtccaaccgcgggtctttcacgtacaacttatatgaatnttggccttggtccagcaggngccggtcnctctccagtcttcnctgtcgtgggcttgtcagtcgggaanccggagtccctagaccgtcttctcgtcggccggcggtctcgtaggaacgtaaaccttccactcctactaccctataccgttacgtcggacccgttgggacgtactaggtacgtcggaccggttcgtccttaactttacttactaggttaccaacgtagttagtttagtcgggtccgttacccgaattcccgtaccggttcggggaccgggggtaaccaggtaactcggaactacgtacaagtaaccgtaagtggtcggtctaggccacacttcg

SEQ ID NO: 253610 - DNA, 603 bp, Homo sapiens
  misc_feature: GYAE6OF02G9ESZ.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtcccggagacatcgtcttgacccaggccacccgcctcactgacgcctgtctcgtgggcgagacgggccgtcatcacctgtcctccgtaccaaccgtagggtctttcatactaacttatatataattatttggtcctggttccagtcgaggacgggccccggccgccttctacccgaaacgtacctttccgtcccttggtcgtgggtcttgtcacggtcgggacgccggacgtcccgtcggtacccgtcttctcgtcgggcggccggtcttacgtacgggtaaacgtaaaccgtttccaccgtttcctccaccctagttcctaccgtccgtccccgtaggtactacgtggacttggacgttcgtacttacgtttactctgtacagtagttagtctggtcctaccactcgtcgtccggggcgggactagactcgctatcgaggtaccacggtgtcgactccgactcctagtcg

SEQ ID NO: 253611 - DNA, 739 bp, Homo sapiens
  misc_feature: GYAE6OF02JKOZP.43.6.A06.1.454.CMB.1.raw
  modified_base (206)..(206): a, c, t, g, unknown or other
  misc_feature (206)..(206): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtcgtccccggagacatcgtcttcgacccaggccacccgctcactgacgcctgtctcgtgggacgagacgggccgtnagtccacctgcctcgtaccaaccgaggttccttacaatactaaacttatactagaaattagttcggccttggttacccagtccgaaggacggccccggaccgtccttactacccgaaaggtacctttccgtacctggtccgtggggtctttggtacaagttaccggggaacgccggtaacgttccccgtggaacccgtccgttttctccggtggggtcccggcggtccttacgtaacggggaaaacgttaaaccgttcccaaccgttcctaaccgtaaccctacttcccgttaccgtccggtacccgttaggaacctacgtagtaacgtcggtaacggttcggtacctttaacgtttaagtaccgttagtaacctaaacgtacggttacgtttaccgtacgggttacccgttacccgtattacccggtaccggttaccggggacggggtaaccctagggtaacttaccggaactacgtacgaaacgtaccgtaacgtacggtacggtccgtaacgtacctacgtaccgttacg

SEQ ID NO: 253612 - DNA, 609 bp, Homo sapiens
  misc_feature: GYAE6OF02FN86S.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgaggagggccgtcatcacctgctcgtccaacagggtcttcatacaacttatatgaatatttggctggttccagcagaggcccggcgctctccgaagacttctcctgtcgtgggcttgtcgtagtcgggacgccggtacgtccgtcggaccgtcttcgtcgtgggccggtcgtctcgagaaacgtaactcgactcgcactactcgtacctcgtcccgtagggaactcgtagtacgtacgtaccgggttacgtacgtttaactttagttacccttaggtaacctaaacgttagtttacggtttaacgtcgggttcccttacccgtacgttacccgtaccggttcggggaccggggtacgtaagaacgtgaacctagtaccggtaacgacggtaacgtggtacggtcacgacctacgtcttacg

SEQ ID NO: 253613 - DNA, 533 bp, Homo sapiens
  misc_feature: GYAE6OF02JZD6I.43.6.A06.1.454.CMB.1.raw
  modified_base (199)..(199): a, c, t, g, unknown or other
  misc_feature (199)..(199): n is a, c, g, or t
  modified_base (218)..(218): a, c, t, g, unknown or other
  misc_feature (218)..(218): n is a, c, g, or t
  modified_base (272)..(272): a, c, t, g, unknown or other
  misc_feature (272)..(272): n is a, c, g, or t
  modified_base (330)..(330): a, c, t, g, unknown or other
  misc_feature (330)..(330): n is a, c, g, or t
  modified_base (423)..(423): a, c, t, g, unknown or other
  misc_feature (423)..(423): n is a, c, g, or t
tcagtgtgagtagtcacgaccggtgctcgatttagatctactgacagggggagcgtacaacaggcaggcagggcagcaagatgatgctgcagacccaaatcttcatttctctgctgctctggatctctggtgtccccggagacatcgtcttgacccaggcacccgctcactgagcctgtctctgggcagtagggccgtnatcacctgctgtccaaacnggtctttcatacacttatatgaatattaggcctggttccagccagagccggccncgtctcaagactctctgtcctgggccttgtcatcggaagccggtagtccctgacccgnttctctcggcggacgcgtctaggagaaacttcactctacaccatctctgccctgagtactgaatcggaacgtggtactacttaatttaccgtntaccgtaaacagttgttaacgtgggtcttccctaatccgaacttcgggacgggggtaccagaacgtcgaacgtatcaagaccgtaatcggtcgtcgtagccgtacagtcc

SEQ ID NO: 253614 - DNA, 792 bp, Homo sapiens
  misc_feature: GYAE6OF02JVV11.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtcgtccccggagacatcgtcttcgacccaggccacccgcctcactgagcctgtctcgtgggcgaggacgggccgtcactcacctgtcctccgtacccgaaccgtacggggttcctttacgaattaacctaaactttactaatagtaattagtttcggccttggttccaggcgtacggaccgggtcccggccgtccgttacctaccgtaacgtaccttccgttcccgttggttaccggtcggggtcctttgtaccgtacggttaccgggaacggtcccgggtacgtccccgtacggtacccgtcctttcgtccgtcgggccgggtccggtccgttacgtagggtaaaacgtaaccgttccctaaccggtcctacccgaacctacgttcccgttacgtccggtccccgttagggaacgtaccgttaggtaccgttacggaacccggttgtaacccgtttaaccgtttaacgtttaccgtccggttaaacctaaccggtttaagggtttacggttacgttacccggggttccctttaaccccgtaacgtttacccgggttaccgggttaccgggggacccgggggttaacaacggttacgtacccggacgtacctacgaaccggtacgtacggttagtcgggcctacggaccctactcggttacg

SEQ ID NO: 253615 - DNA, 594 bp, Homo sapiens
  misc_feature: GYAE6OF02GSBUU.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtaccaaccagggttccttcatacaacttatatgaattagttggccttggttccagcaggacggccccggccgctctccaagtacttctctgtcgtgggcttgtcagtcgggaagccggtagtccctgacccgtcttcgtcgtcgggcggcggctacgtaggaaacgtaacctttccaccgtctaccacctactcctcctcgtcccgtggaactacgtgacgtcggtaccggttggtacttaactttacttacgtcgttacaacgttgttagtttagtcgggtccttccgtattccgtaccggttcggggaccgggggtaccaggtaactcggaactactacggaacgtacgtacgttggcggtactcggactaccgtattcg

SEQ ID NO: 253616 - DNA, 782 bp, Homo sapiens
  misc_feature: GYAE6OF02ITH9G.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtcgtccccggagacatcgtcttcgacccaggcacccgcctcactgagcctgtctcgtgggcgaggagggccgtcactccaccgtgcctccgtaccaaccgtagggttcctttacaactacctaaacctttataattagtaaattagtttcggaccttcggttccaaggcgaggacggcccccggccgtccttacctaccgaacgtacctttccgtcccgttcggttccggttcgggggtcctttcggttaccgtaacggttaccggggaaacggtcccgggtaaccggttccccgtacggtaccccggtcctttaccgtccggtcggggtacccgggccgggtccgttacggtaacgggtaaaacgttaaacccgtttcccgtaacgttccctaccgtaaccctagttccctaccgtccggtacccgtaggtaaccgtacgttacggtagtcggtaccggttcgtaacctttacgtttacttacgtcgtaacgtaacgttggttacgttacgtcgggttacccttaccttacgttacccggtaccggttcgggggaaccggggtaacctaggtaacgtccgaacctacggtaaccgtaccggtaaccgtacggttacggtaccggtcgacggtaccctaccgtagtttccgg

SEQ ID NO: 253617 - DNA, 776 bp, Homo sapiens
  misc_feature: GYAE6OF02G18B2.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctcgtggtcgtccccggagacatcgtcttcgacccaggccaccccgcctcactgacgcctgtcctcgtgggcgaggacgggccgtcatccacctgcctccgtacccaaccgtacggttctttcaactacctaacttatattagtaattagtttcggccgttacggttaccacgcgacggaccgggcccccggccgtcctccgtacctaacgtaccttccgtccgtcggttccggtcggggtcctttcggtaccgtacggtaccgggggtaaccggtcccgggtaaccgtccccgtacggtaccccgttccgtttccgtccggtcgggtcccgggcggtccgttacggtaacgggtaaaccgtaaccgttacctacccgttcctaccctaaccgtaccttccgttcccgtaccggtaccccgtaggtaccgtacgttacggtaacgtacgggtacggttaccggttacctttaaccgtttacttacgtaccgtaacctaaagttcggttacgttacggtccggttcccgttaccgtacgttaccggtacccggtacggggtaccggggtactacggtaaccgtacggtaacctacgtaacggaacgtaaccgtacgttacggtcgtaccgtacgacccgtacgtacgttccgg

SEQ ID NO: 253618 - DNA, 607 bp, Homo sapiens
  misc_feature: GYAE6OF02JJ32L.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggccacccgcctcactgagcctgtctcgtgggcgaggagggccgtcatcacctcgctccgtaccaaccgaggttcctttcatacaacttatatagaatattcggtccttggtcctagcgagtacggcccggccgtctcctccgaagtaccttcctcgtcgtcgtggggtcttcgtacgtacgtccggggaacgccggtacgtcccgtacgtacccgtctttcgtcgtcgggccgggcggtcttcggtagaacgtaaacttctaccgtctccgaaccgtctctacgtcgaccccgtggaactccgtgacgtcgtacggtcgtccttaacgttctacgtcgtactaacgtcgttgttacgtcgtaccgttcctacgtctcggtccggggacggacctagaactcgtacattacgacgtacgtacgtcgtcggtccacgacctacgtattcgg

SEQ ID NO: 253619 - DNA, 729 bp, Homo sapiens
  misc_feature: GYAE6OF02GXFXV.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtcgtcccggagacatcgtcttcgacccaggccacccgcctcactgacgcctgtctcgtggggcgaggacgggtccgtcacgtcaccgtgcctccgtacccaacgtacgggttctttcactaacaacttaatactagtaaattagtttcggccttcggttccaaggacgtacggacgggtcccccggtccgtccgtctacccgaacggttaccttcctcccggttcggttcggttccggggtcttttcgggtacctacgggttaccggggaacggcccgggtaccgtcccgtcggtacccgtctttcgtccggtcggggccggtcgtcgtcgtaacgggtaaacgtaaacctcctaccgtcctacacctactcgtccgtccgccgtaggacgtacgtggtactcggtacgttcgtactttaacgttaccgttacgtagttacctaaacgttcggttacgttacggtccggttaccgtacccttaacgttcccgtaccgggttacggggaacccgggggtacctacggtaaccggtacgactaacgtacgtaacggaaccgttaacgtcggtacggtccgacgtaccgtaccctgttaccg

SEQ ID NO: 253620 - DNA, 806 bp, Homo sapiens
  misc_feature: GYAE6OF02JV5SG.43.6.A06.1.454.CMB.1.raw
  modified_base (146)..(146): a, c, t, g, unknown or other
  misc_feature (146)..(146): n is a, c, g, or t
  modified_base (214)..(214): a, c, t, g, unknown or other
  misc_feature (214)..(214): n is a, c, g, or t
tcagtgtgagtagtcacgaccggtgctcgatttagatctactgacagggggagctacaacaggcaggcagggcagcaagatgatgctgcagacccaaatcttcatttcctctgctgctctggatctcgtggtcgtccccggagacntcgtcttgacccaggccacccgctcactgagtcctggtcctacgtcggggcgaggacgggtccccgtnacgtccgccgtggccttaccggtacccgaaacccggtgggtttcccttttacaacgttaaacctaaccttttagtaagttacgtaaatttacgtttacggtccgttcggtttaccccgaaggtaccgaacgggtaacccggggcccccgggtaccccgtccttacccgtaacccgtaacgttaaccctttacccgttccgttacggtttccgggttacgggggttcctttcggtaaccgtacggttaccggggaaaccggtcccgggtaacgtcccccgttacggaacccgttcccgttttcggtccgtacggggtccgggtccggtctaccggttacgggaaaacgttaacccgtctaaccttcccgtacaccgtactccctacgtccgtaccgtcgactcgtagtcgtcgtacggttcgtaccttacgttacttacgtcgtaacctaacgtacgtttagtacgttccggtaccgttcccgtaattcccgtacgtccggggtaccggggactaacgtccgtacgaacgtccgtacgaacgtaaccgttacgtacggttcggaccgtttaggaacccgtaccttacggtacg

SEQ ID NO: 253621 - DNA, 654 bp, Homo sapiens
  misc_feature: GYAE6OF02GXBUC.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctcgtgggcgagacgggccgtcactccacctgtcctcgtacccaaccgacgggttctttcactactaacttaatatacgaattagtttcggccttcggttaccagacgaaggacgggccccggtaccgccttccgtacctaacggtaccttcctccgtgtcggttacgggtccttgtcacgtacggggaacgccggtacgtcccgtcgtacccgtcttcgtcgtcgggccggtccggtccgttcgtacggtaaacgtaaccttcgtacccttcgtacctaccattcctacgtccggtacccgtagggactacgtagtacgtcggacggttcgtacttacgtttacttacgttcgactacgtagttcgttacgtcgtcccgttacctcgttaccgtccggttaccgggacggggtacctagtacacggactacgtacgaacgtacgaacgttcgcggtactccgactactgttcg

SEQ ID NO: 253622 - DNA, 563 bp, Homo sapiens
  misc_feature: GYAE6OF02F9JFT.43.6.A06.1.454.CMB.1.raw
  modified_base (330)..(330): a, c, t, g, unknown or other
  misc_feature (330)..(330): n is a, c, g, or t
  modified_base (558)..(558): a, c, t, g, unknown or other
  misc_feature (558)..(558): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtcttcatacaacttatatgaattatttggcctggttccagcagaggccccggccgctctccaagacttctcctgtctggggcttgtcatcgggaagccggagtcccngaccgtcttctcgtggcggcggctcgtggaagtaaaccttcactctccactactctctcgccctggacgactgatcggacgtggtcttaacttacttactgtaccaacgttagttgttaacgttcggccgttcccattcccgtaccggttccggggaccgggggtaccaggaactccggaactactacgaacgaacgtaaccgttggtacggacgtcgtaccaccgtnttccg

SEQ ID NO: 253623 - DNA, 1031 bp, Homo sapiens
  misc_feature: GYAE6OF02HS2CU.43.6.A06.1.454.CMB.1.raw
  modified_base (1021)..(1021): a, c, t, g, unknown or other
  misc_feature (1021)..(1021): n is a, c, g, or t
tcagtgtgagtagtcacgaccggtgctcgatttagatctactgacagggggagctacaacaggcaggcaggggcagcaagatgatgctgcacgacccaaatcttcatttctctgctgctactggacttcgtcgtcggtcgtccccggagactacttccgtcttcgacccgtacggccaccccgctcctaacgtcggacgtccttgtccgttcggtacggggaccgacgggtaccgggtccgttactaccttaccgtaacccgttggtcccgttaccggttaaccccgtaaaccgggttacgggttttaccctttaaccggtaaactttaaacccgttaaacgttttaagtaacgtttaacggtaaaacgttttaccggtttttccgggtaccccggttttacgggtttaccccgaacggttaacccggtaaaccggggtacccggggccccccgggtacccgttacccgttaaccccgtaaaccccgttaaaaccggtttccccgttttccccgttacccggttacggtttccgggttaccgggggttcttttacccgggtacgaccggggttaaccggggaaccgggttacccggttaacccggttcccggtacggttaaccccgtttcgtttaccggttccgggtttcgggacccgggtcgggtaccgtttaaccgggtaaacggtaaaccgttaaaccgttcccgttaacgtttcccgtaacgtaacccttaccggttcccttaccccggtcgttaaccccgggtaggtaaccggtacgtacgggtaccgttgggttaaccggttacgttttaaccgtaaacgttttaaccgttacggttacgtaaccgttaacggtttagttaacggtttacccgtacgggtttcccttaacccttggttaacccggtaccgggttaaccggggtaccggtaacgtacggttaacgaacccgttaagtaccgtaacggaacggttaaccgtaggttccgacggttaccgtacgggaccttaccggtntttaacccgg

SEQ ID NO: 253624 - DNA, 1124 bp, Homo sapiens
  misc_feature: GYAE6OF02IO0V5.43.6.A06.1.454.CMB.1.raw
  modified_base (159)..(159): a, c, t, g, unknown or other
  misc_feature (159)..(159): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctcgtggtgtccccggagacatcgtcttcgacccnggccacccgcctcactgacgtcctgtccgtacgtgggacgaggacgggtcccgtacactccgaaccgttcggtcccttaccgtaacccgtaaaccggtacgggtttaccctttaccgaacttaaccgttaaacttttaagtaacgttaacgttaaaagtttacggttttaccgggtccccgtttcggttacccgtaagggtaccgaaacggggtaccccgggtccccccggggacccgtacccgtttcccgttaaaccccggtaaaacggtttcccccgttttaccccgttcccggttttaaccgggtttcccggggtttaccgggggttaccgtttttccggttaaccgggtaaccggggtttaaccccggggggtaaaaccgggtacccccggggggtttaacccgtttaccccccggttaccgggtaacccccgtttccgttttccccggttccggggttaccggggggtaccccggggttcccgggtaccctttaaccgggggtaaaccggggtaaaaaacccggttttaaaacccgtttcccccgttaaaccgtttcccccgttaaacccggtaacccctttaaaccgtttccccgtttacccggttaaccccgttaccccggggttaacggggtaaccgttaacccgggttacggtaccgggtttaacccgggttaaccggtttaccgggtttaaacccgttttaaaccttttaccggttttaaacccgttaacggtacccgtttaaaagtttaccggtttaacggtttaccgggttacccgggtttaccccgtttacccgttaaacccggtttcccgggttaaacccggggtttcccgggggaacccgggggttaaaccgtaccggtaaaccgttccggaaaccggttaccgtaacggtaaccgtaaccggtacgttccgggttcgtacccgtacggacccgtacgttacgttacccg

SEQ ID NO: 253625 - DNA, 640 bp, Homo sapiens
  misc_feature: GYAE6OF02G3M1C.43.6.A06.1.454.CMB.1.raw
  modified_base (443)..(443): a, c, t, g, unknown or other
  misc_feature (443)..(443): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtgtccccggagacatcgtcttgacccaggcacccgcctcactgagcctgtctcgtgggcgaggacgggccgtcactccacctcgcctcgtacccaaccgtcgggttcctttacattaacgtaactttataatagtaattagtttcggccttacggttccagtcgaggcggccccggccgcctcctaccaagtaccttcctccgtggtccgtgggtcttgtcgacgtcgggaacggtccggtacgtcccgtcgaccgtcttcctcgtcggcggcggtcctcgacggtaacgtaacttccgactccgtacacctntcctcgtcgtccgtagacgtactggtacgtcgtaacggttcgtactttaacgttacttacgtactacgaacgttgttacgttacggtacgtccgttacccgacgttcccggtacggttccgggggacggggtacctaggtacgtacgtactacgtacgaagacccgtagtcggtacgtcgacgtacctactacgtcg

SEQ ID NO: 253626 - DNA, 733 bp, Homo sapiens
  misc_feature: GYAE6OF02JL8N7.43.6.A06.1.454.CMB.1.raw
  modified_base (215)..(215): a, c, t, g, unknown or other
  misc_feature (215)..(215): n is a, c, g, or t
tcagtgtgagtagtcacgaccggtgctcgatttagatctactgacagggggagctacaacaggcaggcaggggcagcaagatgatgctgcagacccaaatcttcatttctctgctgctctggatctctggtcgtccccggagacatcgtcttcgacccaggccacccgcctcactggacgcctgtccgtcgtcgggacgaggacgggcccgttanacgtccacctggaccttccgtacccaacccgtagggtttcccttttaccaacgttaacctaaactttattaagttacggtaaatttacgttttcggtaccgttcgggttaccagcctacggaccgggcccccggccgtccgtcctaccgaacgtaccttcctccgtagtccggtgggtcttcggctaacgggtccgggaacgccgggtactccccgttaggcccgtctttaccgtcggttccggggccggtccgggtcctacggtacggggaaacctaaacttccgaccgttcccaccctacctacgttccctacgtccgtcccgtaggtacgtccgtagtacgtcggtcggttacggtacttaccttacgttaccgtagtactacgttagttgttacgtcgttaccgtaccgtcgtacccgttaacgggtccggggtacggggtaccaggtaaccgtacggtaatacctacggtaacggaaccgtacgtgggtccgtacgcggacctaccgtactcg

SEQ ID NO: 253627 - DNA, 801 bp, Homo sapiens
  misc_feature: GYAE6OF02H9TPD.43.6.A06.1.454.CMB.1.raw
tcagtgtgagtagtcacgaccggtgctcgatttagatctactgacagggggagctacaacaggcaggcaggggcagcaagatgatgctgacacgaacccaaatcttcactttcctctgctgtctcgtgtacttctcgtgggtccgtcccggagcactccgtctcgaccacggccacccgcctacactgacgcctcgtccgtcgtaggggcgacgggcgggtccctacgactcctacctcggtcctaccgtacccgtaaccggtcgggttaccttttaacaacttaaccttaaaactttaagttaacgttaagttaactttacgtttacggggtaccctttcgggttaccgaacggtacgaaccgggtacccggggtccccgggtcccgtatacccgtaaccgtaacgtacccgtttcctaccggttcggtccggtacggggttcctttcggttaccgacggtacggggtaacggcccggtacgtcccgtacgcccgttcgttcgcggtcggccggtcggtacctgtacggtaaataacctctacctccgtacaccgtactttccgtaccgtcggacccgttagggaacgtaccgtacggtacgttccggtacggttacgtacctttaacgtacgttttacgacgtacgtaacgtttacgtagttacggttaccgttacccgttacctacgtaccggtccggttaccgggggaccggtactacggtaacctacgtacggtaaccaggtaaccgtaacggtacgttacggcggaccggttccgaaccggttacctaggtaccg

SEQ ID NO: 253628 - DNA, 542 bp, Homo sapiens
  misc_feature: GYAE6OF02HVYOV.43.6.A06.1.454.CMB.1.raw
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (309)..(309): a, c, t, g, unknown or other
  misc_feature (309)..(309): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
tcagtgtgagtagtcacgaccggtgctcgatttagatctactgacagggggagctacaacaggcaggcagggcagcaagatgatgctgcagaccaaatcttcattctctgctgctctaggatctctggtgtcccggagacatcgtcttgacccaggcacccgctcactgagcctgtctctgggcagaggcctnatcaccttgctcgtcaaccagggttctttnatacaacttnattgatatttggctggtccagcagaggcccgcgactctccaagacttccctgtctggggcttaggtcatcgggaanccggtagtccctagcccgcttcctactggccggcgctcgtggaaacgaactcgaactctacacatcgtcngccctganactagngttgaacgtggactacttnttaactgtcaagtcgttgttntacggtcgttccncttaccaccgttcgggtcgggggaccctaggtaacgtacgtaacgacgttacgaacgacgaaacctcggttaacggccttggaccttacgacttcg

SEQ ID NO: 253629 - DNA, 858 bp, Homo sapiens
  misc_feature: GYAE6OF02F2MDV.43.6.A06.1.454.CMB.1.raw
tcagtgtgagtagtcacgaccggtgctcgatttagatctactgacagggggagctacaacaggcaggcaggggcagcaagatgatgctgcagacccaaatcttcatttctctgctgctctggatctctggtcgtcccggagacatcgtcttcgaccacggcacccgcctcactgacgcctgtctcgtgggcggaggacggccgtacactccaccgtcgtcctccgtacctaaaccgacgggttcttacgactaactaacttattaatacgtaacttacgtttcggtccgttacgttaccgtacgcgaacggaccgggtccccggccggtcctccgtaacccgtaacggtacctttccgttccgttacgttccggttcggggttccgtttacggtaccggtacggttaccggggtaacgggtcccggttaaacggttcccccggttaacgtacccgttccgtttccgttccggtcgggtaccgggtccggtccgtaccgggtttaacggaaaccgttaaaccgttccctaaccgttaccctaacccgaaccgtttaacgtaccggttacctcccgggtaacccccgttagggtacgtaacccgtcgtaaacgtaccgggtacggtttaccgggtaaaccttttaccgttttaaacctaccgtttcggttaaacccaaacgggtttgttaacggtttaccggtacggtttacccttacccggttacgttacccgtaaccgggtttccggggggaacccgggtacgttaggaacccgttacggtaaccgtaaggtacccgtaaacggtaccgtacgttacgggtaccgtaccgggtactaaccccggtccttacggttacc

SEQ ID NO: 253630 - DNA, 764 bp, Homo sapiens
  misc_feature: GYAE6OF02F20OY.43.6.A06.1.454.CMB.1.raw
  modified_base (176)..(176): a, c, t, g, unknown or other
  misc_feature (176)..(176): n is a, c, g, or t
  modified_base (665)..(665): a, c, t, g, unknown or other
  misc_feature (665)..(665): n is a, c, g, or t
tcagtgtgagtagtcacgaccggtgctcgatttagatctactgacagggggagctacaacaggcaggcagggcagcaagatgatgctgcagacccaaatcttcatttctctgctgctctggatctctggtcgtcccggagacatcgtcttgacccaggccacccgcctcactgacncctgtctcgtgggcgtaggacgggccgtcactcctacctgcctaccgtacccaaaccgtagggttccttttacaacgttaacctaactttatagtaggtaaatttacgtttacggtccgttcggttaccagtaccgaaggtaccgggcccccggccgtccttacccgtacccgtaacgtaccctttccgtcccgttcggttccggttacggggtctttcggtacgtaacggttaccggggaacggtcccgggtaccgttccccgtacggtaccccgtacgtttccctacggtcggggtacccggtccggtccgttacgtaaggggtaaacccgtaaaccgtttccgtacccgttacctacccgtaacctacttcccgtttcctaccggtccccgtaaggaccgtaacgtggtaaccgtggtaaccggtcgttactttaacttacgttacgtcgtactaacgttgttacgttagtccggtaccgttaccngttaccgtaccggtcggggacccgggactacgacgtaccgtaataccgtaacgaacgtacgtacggtcgtcggtaccgtacgcccgtaactcgttaccg

SEQ ID NO: 253631 - DNA, 758 bp, Homo sapiens
  misc_feature: GYAE6OF02II50D.43.6.A06.1.454.CMB.1.raw
tcagtgtgagtagtcacgaccggtgctcgatttagatctactgacagggggagctacaacaggcaggcaggggcagcaaagatgatgctgcagacccaaatcttcatttctctgctgctctggatctctggtcgtcccggagacatcgtcttcgacccacggccacccgcctcactgacgcctcgtctcgtgggcgaggacgggccgtctactccaccttcgccgttccgtaccaaccgtacgggttcctttcaactaactaacttaatatagtaattacgtttcggtaccgttcggttaccacggtacgaacgggaccgggtcccccgggtcccgtaccttaccgtacccgtaaacggttaccctttccgttccgttcggttccggttcggggttcttcggtaccgtacggttaccggggaaccggtacccgggtaccgtcccgtcggtaccgtcctttcgtcggtcgggtcgggcgtcgtaccgtaaggaaactaaccttcctacctcctacctaccgtactccgtcgtcgtcccgtggtaaccgtacgtagtacgtcggtacggttcggttacctttaacgttacttacgtctaaacgtaacgtttgttacgtttacgtccgggttccctttaccgtaccgttcccggtaacccggttccgggggtacgggtaacctagtaaccggtaccgtaacgaacgtaccgtaacgtacccgttagtccgggtcgtccgtactacccgtacgtacggttcc

SEQ ID NO: 253632 - DNA, 244 bp, Homo sapiens
  misc_feature: GYAE6OF01B3C08.13.25.C03.1.454.CMB.1.raw
  modified_base (241)..(244): a, c, t, g, unknown or other
  misc_feature (241)..(244): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttcccgccctcctctagtacgtgactgagcgggctggcaaggcgcatagnnnn

SEQ ID NO: 253633 - DNA, 243 bp, Homo sapiens
  misc_feature: GYAE6OF01B3XKI.13.25.C03.1.454.CMB.1.raw
  modified_base (242)..(243): a, c, t, g, unknown or other
  misc_feature (242)..(243): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnn

SEQ ID NO: 253634 - DNA, 248 bp, Homo sapiens
  misc_feature: GYAE6OF01B2P64.13.25.C03.1.454.CMB.1.raw
  modified_base (238)..(248): a, c, t, g, unknown or other
  misc_feature (238)..(248): n is a, c, g, or t
tcagtcacgtactacacgaccggtgctcgatttagtagtgtagatttgggtttggggtggtggtggtctccactcccgccttgacgaggctgcctattactgctgctcatatgcaggttcttctgtggtcttcggcggaggtccaaagtgaccgtctaggtcagcccaaggctgtccctggtcactctgttcccacctcgtctagtacgtgactgagcgggctggcaaggcgcatagnnnnnnnnnnn

SEQ ID NO: 253635 - DNA, 240 bp, Homo sapiens
  misc_feature: GYAE6OF01B7Y7S.13.25.C03.1.454.CMB.1.raw
  modified_base (238)..(240): a, c, t, g, unknown or other
  misc_feature (238)..(240): n is a, c, g, or t
tcagtcacgtactacacgaccggtgctcgatttagtagtgtagattggttgggtgtggtggtctccactccgccttgacgaggctgcctattactgctgctcatatgcaggcagctacactgtactattcggcggagggaccaagctgaccgtcctaggtcagcccaaggctgcccctcggtcactctgttcccacctcctctagtacgtgactgagcgggctggcaaggcgcatagnnn

SEQ ID NO: 253636 - DNA, 243 bp, Homo sapiens
  misc_feature: GYAE6OF01D989S.13.25.C03.1.454.CMB.1.raw
  modified_base (242)..(243): a, c, t, g, unknown or other
  misc_feature (242)..(243): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnn

SEQ ID NO: 253637 - DNA, 244 bp, Homo sapiens
  misc_feature: GYAE6OF01D44JO.13.25.C03.1.454.CMB.1.raw
  modified_base (242)..(244): a, c, t, g, unknown or other
  misc_feature (242)..(244): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnn

SEQ ID NO: 253638 - DNA, 243 bp, Homo sapiens
  misc_feature: GYAE6OF01DE91L.13.25.C03.1.454.CMB.1.raw
  modified_base (240)..(243): a, c, t, g, unknown or other
  misc_feature (240)..(243): n is a, c, g, or t
tcagtcacgtactacacgaccggtgctcgatttagtagtgtagatttgggtttgggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttcccgccctcctctagtacgtgactgagcgggctggcaaggcgcatagnnnn

SEQ ID NO: 253639 - DNA, 244 bp, Homo sapiens
  misc_feature: GYAE6OF01DDC74.13.25.C03.1.454.CMB.1.raw
  modified_base (242)..(244): a, c, t, g, unknown or other
  misc_feature (242)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnn

SEQ ID NO: 253640 - DNA, 249 bp, Homo sapiens
  misc_feature: GYAE6OF01BKVSU.13.25.C03.1.454.CMB.1.raw
  modified_base (242)..(249): a, c, t, g, unknown or other
  misc_feature (242)..(249): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnnnnnnn

SEQ ID NO: 253641 - DNA, 241 bp, Homo sapiens
  misc_feature: GYAE6OF01A1ESP.13.25.C03.1.454.CMB.1.raw
  modified_base (241)..(241): a, c, t, g, unknown or other
  misc_feature (241)..(241): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttcccaccttcctctagtacgtgactgagcgggctggcaaggcgcatagn

SEQ ID NO: 253642 - DNA, 244 bp, Homo sapiens
  misc_feature: GYAE6OF01EFM82.13.25.C03.1.454.CMB.1.raw
  modified_base (243)..(244): a, c, t, g, unknown or other
  misc_feature (243)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnn

SEQ ID NO: 253643 - DNA, 244 bp, Homo sapiens
  misc_feature: GYAE6OF01DLQWE.13.25.C03.1.454.CMB.1.raw
  modified_base (244)..(244): a, c, t, g, unknown or other
  misc_feature (244)..(244): n is a, c, g, or t
tcagtcacgtactacacgaccggtgctcgatttagtagtgtagatttgggtttggagggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagn

SEQ ID NO: 253644 - DNA, 244 bp, Homo sapiens
  misc_feature: GYAE6OF01DNPE5.13.25.C03.1.454.CMB.1.raw
  modified_base (243)..(244): a, c, t, g, unknown or other
  misc_feature (243)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggaccaagctgaccgtcctaggtcagcccaaggctgccccctcggtcactctgttcccgccctcctctagtacgtgactgagcgggctggcaaggcgcatagnn

SEQ ID NO: 253645 - DNA, 244 bp, Homo sapiens
  misc_feature: GYAE6OF01EVWI0.13.25.C03.1.454.CMB.1.raw
  modified_base (243)..(244): a, c, t, g, unknown or other
  misc_feature (243)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnn

SEQ ID NO: 253646 - DNA, 242 bp, Homo sapiens
  misc_feature: GYAE6OF01D7ZMD.13.25.C03.1.454.CMB.1.raw
  modified_base (241)..(242): a, c, t, g, unknown or other
  misc_feature (241)..(242): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttcccaccctcctctagtacgtgactgagcgggctggcaaggcgcatagnn

SEQ ID NO: 253647 - DNA, 254 bp, Homo sapiens
  misc_feature: GYAE6OF01EBGEE.13.25.C03.1.454.CMB.1.raw
  modified_base (243)..(254): a, c, t, g, unknown or other
  misc_feature (243)..(254): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnnnnnnnnnn

SEQ ID NO: 253648 - DNA, 245 bp, Homo sapiens
  misc_feature: GYAE6OF01ALH5M.13.25.C03.1.454.CMB.1.raw
  modified_base (243)..(245): a, c, t, g, unknown or other
  misc_feature (243)..(245): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnn

SEQ ID NO: 253649 - DNA, 243 bp, Homo sapiens; identical to SEQ ID NO: 253636
  misc_feature: GYAE6OF01AC51J.13.25.C03.1.454.CMB.1.raw
  modified_base (242)..(243): a, c, t, g, unknown or other
  misc_feature (242)..(243): n is a, c, g, or t

SEQ ID NO: 253650 - DNA, 243 bp, Homo sapiens; identical to SEQ ID NO: 253636
  misc_feature: GYAE6OF01CP166.13.25.C03.1.454.CMB.1.raw
  modified_base (242)..(243): a, c, t, g, unknown or other
  misc_feature (242)..(243): n is a, c, g, or t

SEQ ID NO: 253651 - DNA, 267 bp, Homo sapiens
  misc_feature: GYAE6OF01EBGEH.13.25.C03.1.454.CMB.1.raw
  modified_base (247)..(267): a, c, t, g, unknown or other
  misc_feature (247)..(267): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtcccgactgagcgggctggcaaggcgcatagnnnnnnnnnnnnnnnnnnnnn

SEQ ID NO: 253652 - DNA, 243 bp, Homo sapiens
  misc_feature: GYAE6OF01DZFW9.13.25.C03.1.454.CMB.1.raw
  modified_base (243)..(243): a, c, t, g, unknown or other
  misc_feature (243)..(243): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagn

SEQ ID NO: 253653 - DNA, 244 bp, Homo sapiens; identical to SEQ ID NO: 253637
  misc_feature: GYAE6OF01C5PXL.13.25.C03.1.454.CMB.1.raw
  modified_base (242)..(244): a, c, t, g, unknown or other
  misc_feature (242)..(244): n is a, c, g, or t

SEQ ID NO: 253654 - DNA, 245 bp, Homo sapiens; identical to SEQ ID NO: 253648
  misc_feature: GYAE6OF01A8G6E.13.25.C03.1.454.CMB.1.raw
  modified_base (243)..(245): a, c, t, g, unknown or other
  misc_feature (243)..(245): n is a, c, g, or t

SEQ ID NO: 253655 - DNA, 243 bp, Homo sapiens
  misc_feature: GYAE6OF01CES1L.13.25.C03.1.454.CMB.1.raw
  modified_base (242)..(243): a, c, t, g, unknown or other
  misc_feature (242)..(243): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnn

SEQ ID NO: 253656 - DNA, 268 bp, Homo sapiens
  misc_feature: GYAE6OF01BHAEA.13.25.C03.1.454.CMB.1.raw
  modified_base (245)..(268): a, c, t, g, unknown or other
  misc_feature (245)..(268): n is a, c, g, or t
tcagtcacgtactacacgaccggtgctcgatttagtagtgtagatttgggtttgggggtgtgggtgggtctccactcccgccgttgacgaggctgcctattactgcctgctcatatgcaggttcttctgtggtcttcggcggagggtccaaagtgaccgtcctaggtcagcccaaggctgccccctggtcactctgttcccaccctctctagtacgtgactgagcgggctggcaaggcgcatagnnnnnnnnnnnnnnnnnnnnnnnn

SEQ ID NO: 253657 - DNA, 255 bp, Homo sapiens
  misc_feature: GYAE6OF01BQ0VE.13.25.C03.1.454.CMB.1.raw
  modified_base (242)..(255): a, c, t, g, unknown or other
  misc_feature (242)..(255): n is a, c, g, or t
tcagtcacgtactacacgaccggtgctcgatttagtagtgtagatttgggtttgggggtgtggtaggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgctgagcgggctggcaaggcgcatagnnnnnnnnnnnnnn

SEQ ID NO: 253658 - DNA, 245 bp, Homo sapiens; identical to SEQ ID NO: 253648
  misc_feature: GYAE6OF01DH7LX.13.25.C03.1.454.CMB.1.raw
  modified_base (243)..(245): a, c, t, g, unknown or other
  misc_feature (243)..(245): n is a, c, g, or t

SEQ ID NO: 253659 - DNA, 244 bp, Homo sapiens; identical to SEQ ID NO: 253642
  misc_feature: GYAE6OF01BX28P.13.25.C03.1.454.CMB.1.raw
  modified_base (243)..(244): a, c, t, g, unknown or other
  misc_feature (243)..(244): n is a, c, g, or t

SEQ ID NO: 253660 - DNA, 243 bp, Homo sapiens
  misc_feature: GYAE6OF01A4ATM.13.25.C03.1.454.CMB.1.raw
  modified_base (243)..(243): a, c, t, g, unknown or other
  misc_feature (243)..(243): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagn

SEQ ID NO: 253661 - DNA, 244 bp, Homo sapiens; identical to SEQ ID NO: 253642
  misc_feature: GYAE6OF01B6NMY.13.25.C03.1.454.CMB.1.raw
  modified_base (243)..(244): a, c, t, g, unknown or other
  misc_feature (243)..(244): n is a, c, g, or t

SEQ ID NO: 253662 - DNA, 245 bp, Homo sapiens; identical to SEQ ID NO: 253648
  misc_feature: GYAE6OF01C4NDD.13.25.C03.1.454.CMB.1.raw
  modified_base (243)..(245): a, c, t, g, unknown or other
  misc_feature (243)..(245): n is a, c, g, or t

SEQ ID NO: 253663 - DNA, 244 bp, Homo sapiens; identical to SEQ ID NO: 253645
  misc_feature: GYAE6OF01BWQVQ.13.25.C03.1.454.CMB.1.raw
  modified_base (243)..(244): a, c, t, g, unknown or other
  misc_feature (243)..(244): n is a, c, g, or t

SEQ ID NO: 253664 - DNA, 256 bp, Homo sapiens
  misc_feature: GYAE6OF01ESIE8.13.25.C03.1.454.CMB.1.raw
  modified_base (243)..(256): a, c, t, g, unknown or other
  misc_feature (243)..(256): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcagtagnnnnnnnnnnnnnn

SEQ ID NO: 253665 - DNA, 242 bp, Homo sapiens
  misc_feature: GYAE6OF01DKE1I.13.25.C03.1.454.CMB.1.raw
  modified_base (241)..(242): a, c, t, g, unknown or other
  misc_feature (241)..(242): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggaggtccaaagtgaccgtcctaggtcagcccaaggctgccccctggtcactctgttcccaccctcctctagtacgtgactgagcgggctggcaaggcgcatagnn

SEQ ID NO: 253666 - DNA, 243 bp, Homo sapiens; identical to SEQ ID NO: 253652
  misc_feature: GYAE6OF01BOI0J.13.25.C03.1.454.CMB.1.raw
  modified_base (243)..(243): a, c, t, g, unknown or other
  misc_feature (243)..(243): n is a, c, g, or t

SEQ ID NO: 253667 - DNA, 243 bp, Homo sapiens
  misc_feature: GYAE6OF01DDQQI.13.25.C03.1.454.CMB.1.raw
  modified_base (243)..(243): a, c, t, g, unknown or other
  misc_feature (243)..(243): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagtccaaggctgccccctcggtcactctgttcccaccctcctctagtacgtgactgagcgggctggcaaggcgcatagn

SEQ ID NO: 253668 - DNA, 254 bp, Homo sapiens
  misc_feature: GYAE6OF01A4FT1.13.25.C03.1.454.CMB.1.raw
  modified_base (244)..(254): a, c, t, g, unknown or other
  misc_feature (244)..(254): n is a, c, g, or t
tcagtcacgtactacacgaccggtgctcgatttagtagtgtagatttgggtttgggggtgtggtggtctccacctcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnnnnnnnnn

SEQ ID NO: 253669 - DNA, 242 bp, Homo sapiens
  misc_feature: GYAE6OF01CTNPI.13.25.C03.1.454.CMB.1.raw
  modified_base (241)..(242): a, c, t, g, unknown or other
  misc_feature (241)..(242): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggaggtccaaagtgaccgtcctaggtcagcccaaggctgccccctcggtcactctgttcccaccctctctagtacgtgactgagcgggctggcaaggcgcatagnn

SEQ ID NO: 253670 - DNA, 245 bp, Homo sapiens
  misc_feature: GYAE6OF01EOMSW.13.25.C03.1.454.CMB.1.raw
  modified_base (243)..(245): a, c, t, g, unknown or other
  misc_feature (243)..(245): n is a, c, g, or t
tcagtcacgtactacacgaccggtgctcgatttagtagtgtagatttgggtttgggggtggtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnn

SEQ ID NO: 253671 - DNA, 244 bp, Homo sapiens; identical to SEQ ID NO: 253645
  misc_feature: GYAE6OF01D0QLV.13.25.C03.1.454.CMB.1.raw
  modified_base (243)..(244): a, c, t, g, unknown or other
  misc_feature (243)..(244): n is a, c, g, or t

SEQ ID NO: 253672 - DNA, 244 bp, Homo sapiens; identical to SEQ ID NO: 253642
  misc_feature: GYAE6OF01AXOK0.13.25.C03.1.454.CMB.1.raw
  modified_base (243)..(244): a, c, t, g, unknown or other
  misc_feature (243)..(244): n is a, c, g, or t

SEQ ID NO: 253673 - DNA, 245 bp, Homo sapiens; identical to SEQ ID NO: 253648
  misc_feature: GYAE6OF01A9I1D.13.25.C03.1.454.CMB.1.raw
  modified_base (243)..(245): a, c, t, g, unknown or other
  misc_feature (243)..(245): n is a, c, g, or t

SEQ ID NO: 253674 - DNA, 269 bp, Homo sapiens
  misc_feature: GYAE6OF01C35Y3.13.25.C03.1.454.CMB.1.raw
  modified_base (243)..(269): a, c, t, g, unknown or other
  misc_feature (243)..(269): n is a, c, g, or t
tcagtcacgtactacacgaccggtgctcgatttagtagtgtagatttgggtttgggggtggtggtggtctccactcccgccttgacggaggctgcctattactgctgctcatatgctaggttcttctgtggtcttcggcggagggtccaaagtgaccgtccgtaggtcagcccaaggctgcccctcggtcactctgttcccacctctctagtacgtgactgagcggctggcaaggcgcatagnnnnnnnnnnnnnnnnnnnnnnnnnnn

SEQ ID NO: 253675 - DNA, 252 bp, Homo sapiens
  misc_feature: GYAE6OF01A9LLJ.13.25.C03.1.454.CMB.1.raw
  modified_base (242)..(252): a, c, t, g, unknown or other
  misc_feature (242)..(252): n is a, c, g, or t
tcagtcacgtactacacgaccggtgctcgatttagtagtgtagatttgggtttgggggtgtggtggtctccactcctgccttgacgaggctgcctattactgctgctcatatgcaggttcttctgtggtcttcggcggagggtccaaagtgaccgtcctaggtcagcccaaggctgccccctggtcactctgttctcgccctcctctagtacgtgactgagcgggctggcaaggcgcatagnnnnnnnnnnn

SEQ ID NO: 253676 - DNA, 244 bp, Homo sapiens; identical to SEQ ID NO: 253645
  misc_feature: GYAE6OF01A3E38.13.25.C03.1.454.CMB.1.raw
  modified_base (243)..(244): a, c, t, g, unknown or other
  misc_feature (243)..(244): n is a, c, g, or t

SEQ ID NO: 253677 - DNA, 244 bp, Homo sapiens
  misc_feature: GYAE6OF01B97YG.13.25.C03.1.454.CMB.1.raw
  modified_base (242)..(244): a, c, t, g, unknown or other
  misc_feature (242)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnn

SEQ ID NO: 253678 - DNA, 244 bp, Homo sapiens
  misc_feature: GYAE6OF01DC8A1.13.25.C03.1.454.CMB.1.raw
  modified_base (242)..(244): a, c, t, g, unknown or other
  misc_feature (242)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgcctcctctagtacgtgactgagcgggctggcaaggcgcatagnnn

SEQ ID NO: 253679 - DNA, 244 bp, Homo sapiens; identical to SEQ ID NO: 253645
  misc_feature: GYAE6OF01A1ALZ.13.25.C03.1.454.CMB.1.raw
  modified_base (243)..(244): a, c, t, g, unknown or other
  misc_feature (243)..(244): n is a, c, g, or t

SEQ ID NO: 253680 - DNA, 242 bp, Homo sapiens; identical to SEQ ID NO: 253646
  misc_feature: GYAE6OF01EERLY.13.25.C03.1.454.CMB.1.raw
  modified_base (241)..(242): a, c, t, g, unknown or other
  misc_feature (241)..(242): n is a, c, g, or t

SEQ ID NO: 253681 - DNA, 245 bp, Homo sapiens; identical to SEQ ID NO: 253648
  misc_feature: GYAE6OF01CQFDA.13.25.C03.1.454.CMB.1.raw
  modified_base (243)..(245): a, c, t, g, unknown or other
  misc_feature (243)..(245): n is a, c, g, or t

SEQ ID NO: 253682 - DNA, 245 bp, Homo sapiens
  misc_feature: GYAE6OF01BK89H.13.25.C03.1.454.CMB.1.raw
  modified_base (242)..(245): a, c, t, g, unknown or other
  misc_feature (242)..(245): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttcccgccctcctctagtacgtgactgagcgggctggcaaggcgcatagnnnn

SEQ ID NO: 253683 - DNA, 244 bp, Homo sapiens; identical to SEQ ID NO: 253645
  misc_feature: GYAE6OF01D0N4E.13.25.C03.1.454.CMB.1.raw
  modified_base (243)..(244): a, c, t, g, unknown or other
  misc_feature (243)..(244): n is a, c, g, or t

SEQ ID NO: 253684 - DNA, 247 bp, Homo sapiens
  misc_feature: GYAE6OF01BYJT6.13.25.C03.1.454.CMB.1.raw
  modified_base (241)..(247): a, c, t, g, unknown or other
  misc_feature (241)..(247): n is a, c, g, or t
tcagtcacgtactacacgaccggtgctcgatttagtagtgtagatttgggtttggggtgtgggtggtctccactcccgccttgacgaggctgcctattactgctgctcatatgcaggttcttctgtggtcttcggcggagggtccaaagtgaccgtcctaggtcagcccaaggctgcccctggtcactctgttcccgccctcctctagtacgtgactgagcgggctggcaaggcgcatagnnnnnnn

SEQ ID NO: 253685 - DNA, 242 bp, Homo sapiens
  misc_feature: GYAE6OF01DHFUT.13.25.C03.1.454.CMB.1.raw
  modified_base (242)..(242): a, c, t, g, unknown or other
  misc_feature (242)..(242): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagn

SEQ ID NO: 253686 - DNA, 245 bp, Homo sapiens
  misc_feature: GYAE6OF01EACTO.13.25.C03.1.454.CMB.1.raw
  modified_base (243)..(245): a, c, t, g, unknown or other
  misc_feature (243)..(245): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnn

SEQ ID NO: 253687 - DNA, 526 bp, Homo sapiens
  misc_feature: GYAE6OF01BFZL1.13.25.C03.1.454.CMB.1.raw
tcagtcacgtactacacgaccggtgctcgatttagtagtgtagatttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctcctagacagtcgatcaccatctcctgcactggaaacagcagtgatcttgggacttatagacttgtctcctggtaccaacaccaccaggcaacggcccccagagtcatcatttatggggcaataggcgcgtcagggatttccactcgcttctctggctccaagtctggcaacacggcctcctgacaatctctggtctccaggctgagacgaggctgcctatactgctgctcatatgctagggttcttctggttcggtcgttcgggcgggtagggtcccaaaggtcggacccgtccgtaggtcacggcccaaggtctcgccccctcggtccacgttccg

SEQ ID NO: 253688 - DNA, 243 bp, Homo sapiens; identical to SEQ ID NO: 253652
  misc_feature: GYAE6OF01CZSBI.13.25.C03.1.454.CMB.1.raw
  modified_base (243)..(243): a, c, t, g, unknown or other
  misc_feature (243)..(243): n is a, c, g, or t

SEQ ID NO: 253689 - DNA, 244 bp, Homo sapiens
  misc_feature: GYAE6OF01CDTHP.13.25.C03.1.454.CMB.1.raw
  modified_base (242)..(244): a, c, t, g, unknown or other
  misc_feature (242)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgtcccaccctcctctagtacgtgactgagcgggctggcaaggcgcatagnnn

SEQ ID NO: 253690 - DNA, 244 bp, Homo sapiens; identical to SEQ ID NO: 253645
  misc_feature: GYAE6OF01CMVUN.13.25.C03.1.454.CMB.1.raw
  modified_base (243)..(244): a, c, t, g, unknown or other
  misc_feature (243)..(244): n is a, c, g, or t

SEQ ID NO: 253691 - DNA, 252 bp, Homo sapiens
  misc_feature: GYAE6OF01ENN1V.13.25.C03.1.454.CMB.1.raw
  modified_base (243)..(252): a, c, t, g, unknown or other
  misc_feature (243)..(252): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnnnnnnnnn

SEQ ID NO: 253692 - DNA, 245 bp, Homo sapiens
  misc_feature: GYAE6OF01B3X2V.13.25.C03.1.454.CMB.1.raw
  modified_base (245)..(245): a, c, t, g, unknown or other
  misc_feature (245)..(245): n is a, c, g, or t
tcagtcacgtactacacgaccggtgctcgatttagtagtgtagatttgggtttgggggtgtggtggtctccactcccgccttgacgaggctgcctattactgctgctcatatgcaggcagctacactgtactattcggcggagggaccaagctgaccgtcctaggtcagcccaaggctgccccctggtcactctgttcccaccctcctctagtacgtgactgagcgggctggcaaggcgcatagn

SEQ ID NO: 253693 - DNA, 245 bp, Homo sapiens; identical to SEQ ID NO: 253686
  misc_feature: GYAE6OF01CAZE3.13.25.C03.1.454.CMB.1.raw
  modified_base (243)..(245): a, c, t, g, unknown or other
  misc_feature (243)..(245): n is a, c, g, or t

SEQ ID NO: 253694 - DNA, 246 bp, Homo sapiens
  misc_feature: GYAE6OF01C7K2W.13.25.C03.1.454.CMB.1.raw
  modified_base (243)..(246): a, c, t, g, unknown or other
  misc_feature (243)..(246): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnn

SEQ ID NO: 253695 - DNA, 240 bp, Homo sapiens
  misc_feature: GYAE6OF01CNPJR.13.25.C03.1.454.CMB.1.raw
  modified_base (239)..(240): a, c, t, g, unknown or other
  misc_feature (239)..(240): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgcccctggtcactctgttcccaccctctctagtacgtgactgagcgggctggcaaggcgcatagnn

SEQ ID NO: 253696 - DNA, 247 bp, Homo sapiens
  misc_feature: GYAE6OF01CBFPO.13.25.C03.1.454.CMB.1.raw
  modified_base (241)..(247): a, c, t, g, unknown or other
  misc_feature (241)..(247): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctctctagtacgtgactgagcgggctggcaaggcgcatagnnnnnnn

SEQ ID NO: 253697 - DNA, 235 bp, Homo sapiens
  misc_feature: GYAE6OF01CX2JX.13.25.C03.1.454.CMB.1.raw
  modified_base (233)..(235): a, c, t, g, unknown or other
  misc_feature (233)..(235): n is a, c, g, or t
tcagtcacgtactacacgaccggtgctcgatttagtagtgtagatttgggtttgggagttcgactactggggccagggaaccctggtcaccgtctcctcagcctccaccaagggcccatcggtcttcccctggcgccctgctccaggagcacctcgagagcacagcggcctgggctgcctggtcaaggactacttcctagtacgtgactgagcgggctggcaaggcgcatagnnn

SEQ ID NO: 253698 - DNA, 243 bp, Homo sapiens
  misc_feature: GYAE6OF01DJF15.13.25.C03.1.454.CMB.1.raw
  modified_base (242)..(243): a, c, t, g, unknown or other
  misc_feature (242)..(243): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcattctgttcccgccctcctctagtacgtgactgagcgggctggcaaggcgcatagnn

SEQ ID NO: 253699 - DNA, 247 bp, Homo sapiens
  misc_feature: GYAE6OF01ELIBY.13.25.C03.1.454.CMB.1.raw
  modified_base (240)..(247): a, c, t, g, unknown or other
  misc_feature (240)..(247): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggaggtccaaagtgaccgtcctaggtcagcccaaggctgccccctggtcactctgttcccaccctctctagtacgtgactgagcgggctggcaaggcgcatagnnnnnnnn

SEQ ID NO: 253700 - DNA, 244 bp, Homo sapiens; identical to SEQ ID NO: 253642
  misc_feature: GYAE6OF01A0FO9.13.25.C03.1.454.CMB.1.raw
  modified_base (243)..(244): a, c, t, g, unknown or other
  misc_feature (243)..(244): n is a, c, g, or t

SEQ ID NO: 253701 - DNA, 245 bp, Homo sapiens
  misc_feature: GYAE6OF01C6HYX.13.25.C03.1.454.CMB.1.raw
  modified_base (242)..(245): a, c, t, g, unknown or other
  misc_feature (242)..(245): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttcccaccctcctctagtacgtgactgagcgggctggcaaggcgcatagnnnn

SEQ ID NO: 253702 - DNA, 244 bp, Homo sapiens; identical to SEQ ID NO: 253642
  misc_feature: GYAE6OF01CGQR1.13.25.C03.1.454.CMB.1.raw
  modified_base (243)..(244): a, c, t, g, unknown or other
  misc_feature (243)..(244): n is a, c, g, or t

SEQ ID NO: 253703 - DNA, 244 bp, Homo sapiens; identical to SEQ ID NO: 253645
  misc_feature: GYAE6OF01C5KUU.13.25.C03.1.454.CMB.1.raw
  modified_base (243)..(244): a, c, t, g, unknown or other
  misc_feature (243)..(244): n is a, c, g, or t

SEQ ID NO: 253704 - DNA, 243 bp, Homo sapiens
  misc_feature: GYAE6OF01ECY4Z.13.25.C03.1.454.CMB.1.raw
  modified_base (242)..(243): a, c, t, g, unknown or other
  misc_feature (242)..(243): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnn

SEQ ID NO: 253705 - DNA, 529 bp, Homo sapiens
  misc_feature: GYAE6OF01BIBXK.13.25.C03.1.454.CMB.1.raw
  modified_base (420)..(420): a, c, t, g, unknown or other
  misc_feature (420)..(420): n is a, c, g, or t
  modified_base (441)..(441): a, c, t, g, unknown or other
  misc_feature (441)..(441): n is a, c, g, or t
  modified_base (505)..(505): a, c, t, g, unknown or other
  misc_feature (505)..(505): n is a, c, g, or t
  modified_base (524)..(524): a, c, t, g, unknown or other
  misc_feature (524)..(524): n is a, c, g, or t
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatgttgggacttatgaccttgtctcctggtaccgacaacacccaggcaaacgcccccaaatcattatttacggggtcaataagcggccctcagggctttctgatcgcttctctggctcaagtctggcaacacggcctccctgacaatctctggactccgaggccgaggacgaggctgtatttttacngttgttcatatgcaggaaggngtgattagtgtcgtttggaagtggaccaaggtcaccgtctggtcacgcccaaggcccaaccccntcgtcactctcgttccccncctcc

SEQ ID NO: 253706 - DNA, 244 bp, Homo sapiens; identical to SEQ ID NO: 253645
  misc_feature: GYAE6OF01DCPR6.13.25.C03.1.454.CMB.1.raw
  modified_base (243)..(244): a, c, t, g, unknown or other
  misc_feature (243)..(244): n is a, c, g, or t

SEQ ID NO: 253707 - DNA, 244 bp, Homo sapiens
  misc_feature: GYAE6OF01BCOIJ.13.25.C03.1.454.CMB.1.raw
  modified_base (242)..(244): a, c, t, g, unknown or other
  misc_feature (242)..(244): n is a, c, g, or t
tcagtcacgtactacacgaccggtgctcgatttagtagtgtagatttgggtttgggggtgtggtggtctccactcccgccttgatgaggctgcctattactgctgctcatatgcaggttcttctgtggtcttcggcggagggtccaaagtgaccgtcctaggtcagcccaaggctgccccctcggtcactctgttcccgcctcctctagtacgtgactgagcgggctggcaaggcgcatagnnn

SEQ ID NO: 253708 - DNA, 255 bp, Homo sapiens
  misc_feature: GYAE6OF01C08SR.13.25.C03.1.454.CMB.1.raw
  modified_base (242)..(255): a, c, t, g, unknown or other
  misc_feature (242)..(255): n is a, c, g, or t
tcagtcacgtactacacgaccggtgctcgatttagtagtgtagatttgggtttgggggtgtgggtggtctccactcccgccttgacgaggctgcctattactgctgctcatatgcaggttcttctgtggtcttcggcggagggtccaaagtgaccgtcctaggtcagcccaaggctgccccctggtcactctgttcccgcctcctctagtacgtgactgagcgggctggcaaggcgcatagnnnnnnnnnnnnnn

SEQ ID NO: 253709 - DNA, 245 bp, Homo sapiens; identical to SEQ ID NO: 253686
  misc_feature: GYAE6OF01DP4MX.13.25.C03.1.454.CMB.1.raw
  modified_base (243)..(245): a, c, t, g, unknown or other
  misc_feature (243)..(245): n is a, c, g, or t

SEQ ID NO: 253710 - DNA, 246 bp, Homo sapiens; identical to SEQ ID NO: 253694
  misc_feature: GYAE6OF01BMQ77.13.25.C03.1.454.CMB.1.raw
  modified_base (243)..(246): a, c, t, g, unknown or other
  misc_feature (243)..(246): n is a, c, g, or t

SEQ ID NO: 253711 - DNA, 243 bp, Homo sapiens; identical to SEQ ID NO: 253652
  misc_feature: GYAE6OF01A5FIC.13.25.C03.1.454.CMB.1.raw
  modified_base (243)..(243): a, c, t, g, unknown or other
  misc_feature (243)..(243): n is a, c, g, or t

SEQ ID NO: 253712 - DNA, 245 bp, Homo sapiens
  misc_feature: GYAE6OF01BF5WY.13.25.C03.1.454.CMB.1.raw
  modified_base (241)..(245): a, c, t, g, unknown or other
  misc_feature (241)..(245): n is a, c, g, or t
tcagtcacgtactacacgaccggtgctcgatttagtagtgtagatttgggtttgggggtgtggtggtctccactccgccttgacgaggctgcctattactgctgctcatatgcaggttcttctgtggtcttcggcggagggtccaaagtgaccgtcctaggtcagcccaaggctgcccctcggtcactctgttcccgccctcctctagtacgtgactgagcgggctggcaaggcgcatagnnnnn

SEQ ID NO: 253713 - DNA, 540 bp, Homo sapiens
  misc_feature: GYAE6OF01ADTP4.13.25.C03.1.454.CMB.1.raw
  modified_base (432)..(432): a, c, t, g, unknown or other
  misc_feature (432)..(432): n is a, c, g, or t
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatactctggtcctccaggctggaggacgaggctgcctattactgctgctcatntgctaggttcttctgttcggtcttcgggcggtagggtaccaaaggtcgtacccgttcgtaggtccacgtccccgaaggtcctcgccccccttcggtccaccgttcccg

SEQ ID NO: 253714 - DNA, 244 bp, Homo sapiens; identical to SEQ ID NO: 253639
  misc_feature: GYAE6OF01BYYH0.13.25.C03.1.454.CMB.1.raw
  modified_base (242)..(244): a, c, t, g, unknown or other
  misc_feature (242)..(244): n is a, c, g, or t

SEQ ID NO: 253715 - DNA, 242 bp, Homo sapiens
  misc_feature: GYAE6OF01BIZGG.13.25.C03.1.454.CMB.1.raw
  modified_base (242)..(242): a, c, t, g, unknown or other
  misc_feature (242)..(242): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagn

SEQ ID NO: 253716 - DNA, 239 bp, Homo sapiens
  misc_feature: GYAE6OF01CHRKO.13.25.C03.1.454.CMB.1.raw
  modified_base (238)..(239): a, c, t, g, unknown or other
  misc_feature (238)..(239): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggaggtccaaagtgaccgtctaggtcagcccaaggctgcccctggtcactttgttcccaccctcctctagtacgtgactgagcgggctggcaaggcgcatagnn

SEQ ID NO: 253717 - DNA, 251 bp, Homo sapiens
  misc_feature: GYAE6OF01CSS75.13.25.C03.1.454.CMB.1.raw
  modified_base (239)..(251): a, c, t, g, unknown or other
  misc_feature (239)..(251): n is a, c, g, or t
tcagtcacgtactacacgaccggtgctcgatttagtagtgtagatttgggtttgggggtgtgggtggtctccactccgccttgacgaggctgcctattactgctgctcatatgcaggttcttctgtggtcttcggcggagggtccaaagtgaccgtccaggtcagcccaaggctgcccctggtcactctgttcccacctctctagtacgtgactgagcgggctggcaaggtcgcatagnnnnnnnnnnnnn

SEQ ID NO: 253718 - DNA, 255 bp, Homo sapiens
  misc_feature: GYAE6OF01DL3Y1.13.25.C03.1.454.CMB.1.raw
  modified_base (244)..(255): a, c, t, g, unknown or other
  misc_feature (244)..(255): n is a, c, g, or t
tcagtcacgtactacacgaccggtgctcgatttagtagtgtagatttgggtttggggggtgtgggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnnnnnnnnnnn

SEQ ID NO: 253719 - DNA, 242 bp, Homo sapiens; identical to SEQ ID NO: 253646
  misc_feature: GYAE6OF01BREL2.13.25.C03.1.454.CMB.1.raw
  modified_base (241)..(242): a, c, t, g, unknown or other
  misc_feature (241)..(242): n is a, c, g, or t

SEQ ID NO: 253720 - DNA, 265 bp, Homo sapiens
  misc_feature: GYAE6OF01CYUQW.13.25.C03.1.454.CMB.1.raw
  modified_base (243)..(265): a, c, t, g, unknown or other
  misc_feature (243)..(265): n is a, c, g, or t
tcagtcacgtactacacgaccggtgctcgatttagtagtgtagatttggtttgggggtgtggtgggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggcctggcaaggcgcatagnnnnnnnnnnnnnnnnnnnnnnn

SEQ ID NO: 253721 - DNA, 245 bp, Homo sapiens; identical to SEQ ID NO: 253648
  misc_feature: GYAE6OF01DWYZT.13.25.C03.1.454.CMB.1.raw
  modified_base (243)..(245): a, c, t, g, unknown or other
  misc_feature (243)..(245): n is a, c, g, or t

SEQ ID NO: 253722 - DNA, 243 bp, Homo sapiens; identical to SEQ ID NO: 253652
  misc_feature: GYAE6OF01BEQYK.13.25.C03.1.454.CMB.1.raw
  modified_base (243)..(243): a, c, t, g, unknown or other
  misc_feature (243)..(243): n is a, c, g, or t

SEQ ID NO: 253723 - DNA, 249 bp, Homo sapiens
  misc_feature: GYAE6OF01AHSH4.13.25.C03.1.454.CMB.1.raw
  modified_base (190)..(190): a, c, t, g, unknown or other
  misc_feature (190)..(190): n is a, c, g, or t
  modified_base (247)..(249): a, c, t, g, unknown or other
  misc_feature (247)..(249): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcacnctttttttgtcccgccctcctctagtacgtactgagcgggctggcaaggcgcatagnnn

SEQ ID NO: 253724 - DNA, 257 bp, Homo sapiens
  misc_feature: GYAE6OF01BJ97Q.13.25.C03.1.454.CMB.1.raw
  modified_base (245)..(257): a, c, t, g, unknown or other
  misc_feature (245)..(257): n is a, c, g, or t
tcagtcacgtactacacgaccggtgctcgatttagtagtgtagatttgggtttgggggtgtggtgggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactggagcgggctggcaaggcgcatagnnnnnnnnnnnnn

SEQ ID NO: 253725 - DNA, 246 bp, Homo sapiens
  misc_feature: GYAE6OF01EKMQ9.13.25.C03.1.454.CMB.1.raw
  modified_base (244)..(246): a, c, t, g, unknown or other
  misc_feature (244)..(246): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttccccgccctcctctagtacgtgactgagcgggctggcaaggcgcatagnnn

SEQ ID NO: 253726 - DNA, 243 bp, Homo sapiens; identical to SEQ ID NO: 253660
  misc_feature: GYAE6OF01CU7EY.13.25.C03.1.454.CMB.1.raw
  modified_base (243)..(243): a, c, t, g, unknown or other
  misc_feature (243)..(243): n is a, c, g, or t

SEQ ID NO: 253727 - DNA, 257 bp, Homo sapiens
  misc_feature: GYAE6OF01DV05M.13.25.C03.1.454.CMB.1.raw
  modified_base (243)..(257): a, c, t, g, unknown or other
  misc_feature (243)..(257): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnnnnnnnnnnnnnn

SEQ ID NO: 253728 - DNA, 262 bp, Homo sapiens
  misc_feature: GYAE6OF01D80GT.13.25.C03.1.454.CMB.1.raw
  modified_base (247)..(262): a, c, t, g, unknown or other
  misc_feature (247)..(262): n is a, c, g, or t
tcagtcacgtactacacgaccggtgctcgatttagtagtgtagatttgggtttggggggtggtggtggtctccactcccgccttgacgaggctgcctattacctgctgctcatatgcaggttcttctgtggtcttcggcggagggtccaaagtgaccgtcctaggtcagcccaaggctgccccctcggtcactctgttcccgccctcctctagtacgtgacctgagcgggctggcaaggcgcatagnnnnnnnnnnnnnnnn

SEQ ID NO: 253729 - DNA, 270 bp, Homo sapiens
  misc_feature: GYAE6OF01A9HZQ.13.25.C03.1.454.CMB.1.raw
  modified_base (241)..(270): a, c, t, g, unknown or other
  misc_feature (241)..(270): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctctctagtacgtgactgagcgggctggcaaggcgcatagnnnnnnnnnnnnnnnnnnnnnnnnnnnnnn

SEQ ID NO: 253730 - DNA, 268 bp, Homo sapiens
  misc_feature: GYAE6OF01CP09M.13.25.C03.1.454.CMB.1.raw
  modified_base (243)..(268): a, c, t, g, unknown or other
  misc_feature (243)..(268): n is a, c, g, or t
tcagtcacgtactacacgaccggtgctcgatttagtagtgtagatttgggtttgggggtgtggtggtcgtccactcccgccttgacgaggctgcctattactgctcgctcatatgcaggttcttctgtggtcttcggcggagggtccaaagtgaccgtcctaggtcagcccaaggctgccccctggtcactctgttcccaccctcctctagtacgtgactgagcggctggcaaggcgcatagnnnnnnnnnnnnnnnnnnnnnnnnnn

SEQ ID NO: 253731 - DNA, 241 bp, Homo sapiens
  misc_feature: GYAE6OF01CC4HZ.13.25.C03.1.454.CMB.1.raw
  modified_base (241)..(241): a, c, t, g, unknown or other
  misc_feature (241)..(241): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgcccctggtcactctgttcccaccctcctctagtacgtgactgagcgggctggcaaggcgcatagn

SEQ ID NO: 253732 - DNA, 245 bp, Homo sapiens; identical to SEQ ID NO: 253686
  misc_feature: GYAE6OF01BWQ3Z.13.25.C03.1.454.CMB.1.raw
  modified_base (243)..(245): a, c, t, g, unknown or other
  misc_feature (243)..(245): n is a, c, g, or t

SEQ ID NO: 253733 - DNA, 244 bp, Homo sapiens; identical to SEQ ID NO: 253642
  misc_feature: GYAE6OF01B7022.13.25.C03.1.454.CMB.1.raw
  modified_base (243)..(244): a, c, t, g, unknown or other
  misc_feature (243)..(244): n is a, c, g, or t

SEQ ID NO: 253734 - DNA, 246 bp, Homo sapiens
  misc_feature: GYAE6OF01C3PY8.13.25.C03.1.454.CMB.1.raw
  modified_base (242)..(246): a, c, t, g, unknown or other
  misc_feature (242)..(246): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnnnn

SEQ ID NO: 253735 - DNA, 245 bp, Homo sapiens; identical to SEQ ID NO: 253648
  misc_feature: GYAE6OF01ETG2Q.13.25.C03.1.454.CMB.1.raw
  modified_base (243)..(245): a, c, t, g, unknown or other
  misc_feature (243)..(245): n is a, c, g, or t

SEQ ID NO: 253736 - DNA, 246 bp, Homo sapiens
  misc_feature: GYAE6OF01C7Z40.13.25.C03.1.454.CMB.1.raw
  modified_base (241)..(246): a, c, t, g, unknown or other
  misc_feature (241)..(246): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgcccctggtcactctgttcccgccctcctctagtacgtgactgagcgggctggcaaggcgcatagnnnnnn

SEQ ID NO: 253737 - DNA, 243 bp, Homo sapiens
  misc_feature: GYAE6OF01CJN7R.13.25.C03.1.454.CMB.1.raw
  modified_base (242)..(243): a, c, t, g, unknown or other
  misc_feature (242)..(243): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttcccaccctcctctagtacgtgactgagcgggctggcaaggcgcatagnn

SEQ ID NO: 253738 - DNA, 242 bp, Homo sapiens
  misc_feature: GYAE6OF01A1RBH.13.25.C03.1.454.CMB.1.raw
  modified_base (241)..(242): a, c, t, g, unknown or other
  misc_feature (241)..(242): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnn

SEQ ID NO: 253739 - DNA, 247 bp, Homo sapiens
  misc_feature: GYAE6OF01CRNVP.13.25.C03.1.454.CMB.1.raw
  modified_base (239)..(247): a, c, t, g, unknown or other
  misc_feature (239)..(247): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtctaggtcagcccaaggctgcccctggtcactctgttcccgccctctctagtacgtgactgagcgggctggcaaggcgcatagnnnnnnnnn

SEQ ID NO: 253740 - DNA, 244 bp, Homo sapiens; identical to SEQ ID NO: 253645
  misc_feature: GYAE6OF01B3ULT.13.25.C03.1.454.CMB.1.raw
  modified_base (243)..(244): a, c, t, g, unknown or other
  misc_feature (243)..(244): n is a, c, g, or t

SEQ ID NO: 253741 - DNA, 238 bp, Homo sapiens
  misc_feature: GYAE6OF01CJQGT.13.25.C03.1.454.CMB.1.raw
  modified_base (235)..(238): a, c, t, g, unknown or other
  misc_feature (235)..(238): n is a, c, g, or t
tcagtcacgtactacacgaccggtgctcgatttagtagtgtagatttgggtttgggagttcgactactggggccagggaaccctggtcaccgtctcctcagcctccaccaagggcccatcggtcttcccctggcaccctcctccaagagcacctctgggggcacagcggccctgggctgcctggtcaaggactacttcctagtacgtgactgagcgggctggcaaggcgcatagnnnn

SEQ ID NO: 253742 - DNA, 244 bp, Homo sapiens; identical to SEQ ID NO: 253639
  misc_feature: GYAE6OF01CGA3S.13.25.C03.1.454.CMB.1.raw
  modified_base (242)..(244): a, c, t, g, unknown or other
  misc_feature (242)..(244): n is a, c, g, or t

SEQ ID NO: 253743 - DNA, 243 bp, Homo sapiens; identical to SEQ ID NO: 253636
  misc_feature: GYAE6OF01CDWKV.13.25.C03.1.454.CMB.1.raw
  modified_base (242)..(243): a, c, t, g, unknown or other
  misc_feature (242)..(243): n is a, c, g, or t

SEQ ID NO: 253744 - DNA, 272 bp, Homo sapiens
  misc_feature: GYAE6OF01B7B71.13.25.C03.1.454.CMB.1.raw
  modified_base (249)..(272): a, c, t, g, unknown or other
  misc_feature (249)..(272): n is a, c, g, or t
tcagtcacgtactacacgaccggtgctcgatttagtagtgtagatttgggtttgggggggtgtggtggtctccactcccgccttgacggaggctgcctattactgcgtgctcatattgccaggttcttctgtgggtcttcggcggagggtccaaagtgaccgtcctaggtcagcccaaggctgccccctggtcacgtctgttcccaccctctctagtacgtgactgagcgggctggcaaggcgcatagnnnnnnnnnnnnnnnnnnnnnnnn

SEQ ID NO: 253745 - DNA, 251 bp, Homo sapiens
  misc_feature: GYAE6OF01DCSFB.13.25.C03.1.454.CMB.1.raw
  modified_base (237)..(237): a, c, t, g, unknown or other
  misc_feature (237)..(237): n is a, c, g, or t
  modified_base (243)..(251): a, c, t, g, unknown or other
  misc_feature (243)..(251): n is a, c, g, or t
tcagtcacgtactacacgaccggtgctcgatttagtagtgtagatttgggtttgggggtgtgggtggtctccactcccgccttgacgaggctgcctattactgctgctcatatgcaggttcttctgtggtcttcggcggagggtccaaaagtgaccgtcctaggtcagcccaaggctgccccctggtcactctgttccgccctctctagtacgtgactgagcgggctggcaagggcncatagnnnnnnnnn

SEQ ID NO: 253746 - DNA, 243 bp, Homo sapiens; identical to SEQ ID NO: 253652
  misc_feature: GYAE6OF01EH4RH.13.25.C03.1.454.CMB.1.raw
  modified_base (243)..(243): a, c, t, g, unknown or other
  misc_feature (243)..(243): n is a, c, g, or t

SEQ ID NO: 253747 - DNA, 551 bp, Homo sapiens
  misc_feature: GYAE6OF01C6GA5.13.25.C03.1.454.CMB.1.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
tcagtcacgtactacacgaccggtgctcgatttagtagtgtagatttgggtttgggggggtcgacaagaggcagcgctctcgggacgtctccaaccatggcctgggctctgctgctcctcactctcctcactcaggacacagggtcctgggcccagtctgccctgactcagccctgcctccgtgtctgggtctcctggacaggtcgatcaccatctcctgcactggaaacngcagtgatcttgggacttanagacttgtctcctggtaccaacaccaccaggcaagcccccagacgtcatcatttanggggcagtaggcggcgtcgagggacttccactcgcttctctggctccaagtctggcacgcggcctcctgacatctactggtcctcagctgagacgagctgctatacngctgctnatangactaggttcttcgttagttcggtcttcgggcggtacgggtccgaaacgtcggtacccggttcgtacgggtccacggccccgaagggtcccttaccggtccccccttcggtcccgtccgttcccgg

SEQ ID NO: 253748 - DNA, 243 bp, Homo sapiens; identical to SEQ ID NO: 253652
  misc_feature: GYAE6OF01A6DEE.13.25.C03.1.454.CMB.1.raw
  modified_base (243)..(243): a, c, t, g, unknown or other
  misc_feature (243)..(243): n is a, c, g, or t

SEQ ID NO: 253749 - DNA, 418 bp, Homo sapiens
  misc_feature: GYAE6OF01BYDTC.13.25.C03.1.454.CMB.1.raw
  modified_base (414)..(418): a, c, t, g, unknown or other
  misc_feature (414)..(418): n is a, c, g, or t
tcagtcacgtactacacgaccggtgctcgatttagtagtgtagatttgggtttgggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattattgtgtgagattagcgcactactttgactactggggccagggaaccctggtcaccgtctcctcaacctccaccaagggcccatcggtcttcccccctggcacccctcctccaagagcacctctgggggcacagcggccctggctgcctggtcaaggactacttcctagtacgtgactgagcggctggcaaggcgcatagnnnnn

SEQ ID NO: 253750 - DNA, 264 bp, Homo sapiens
  misc_feature: GYAE6OF01DXZC8.13.25.C03.1.454.CMB.1.raw
  modified_base (234)..(234): a, c, t, g, unknown or other
  misc_feature (234)..(234): n is a, c, g, or t
  modified_base (240)..(245): a, c, t, g, unknown or other
  misc_feature (240)..(245): n is a, c, g, or t
  modified_base (248)..(249): a, c, t, g, unknown or other
  misc_feature (248)..(249): n is a, c, g, or t
  modified_base (251)..(264): a, c, t, g, unknown or other
  misc_feature (251)..(264): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggaggtccaaagtgaccgtcctaggtcagcccaaggctgccccctggtcactctgttccccgcctctctagtacgtgactgagcgggctggcaaggcncatagnnnnnntanntnnnnnnnnnnnnnn

SEQ ID NO: 253751 - DNA, 272 bp, Homo sapiens
  misc_feature: GYAE6OF01BOQKY.13.25.C03.1.454.CMB.1.raw
  modified_base (246)..(272): a, c, t, g, unknown or other
  misc_feature (246)..(272): n is a, c, g, or t
tcagtcacgtactacacgaccggtgctcgatttagtagtgtagatttgggtttgggggtagtggtcggtctccactcccgccttgacgaggctgcctattactgctgctcatatgcaggttttttctgtggtcttcggcggagggtccaaagtgaccgtcctaggtcagcccaaggctgccccctcggtcactctgttcccgccctcctctagtacgtgactgagcgggctggcaaggcgcatagnnnnnnnnnnnnnnnnnnnnnnnnnnn

SEQ ID NO: 253752 - DNA, 243 bp, Homo sapiens
  misc_feature: GYAE6OF01A2F5X.13.25.C03.1.454.CMB.1.raw
  modified_base (243)..(243): a, c, t, g, unknown or other
  misc_feature (243)..(243): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctccctagtacgtgactgagcgggctggcaaggcgcatagn

SEQ ID NO: 253753 - DNA, 245 bp, Homo sapiens
  misc_feature: GYAE6OF01D12VH.13.25.C03.1.454.CMB.1.raw
  modified_base (244)..(245): a, c, t, g, unknown or other
  misc_feature (244)..(245): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnn

SEQ ID NO: 253754 - DNA, 252 bp, Homo sapiens
  misc_feature: GYAE6OF01DI4S0.13.25.C03.1.454.CMB.1.raw
  modified_base (237)..(237): a, c, t, g, unknown or other
  misc_feature (237)..(237): n is a, c, g, or t
  modified_base (243)..(252): a, c, t, g, unknown or other
  misc_feature (243)..(252): n is a, c, g, or t
tcagtcacgtactacacgaccggtgctcgatttagtagtgtagatttgggtttgggggtgtggtggtctccactcccgccttgacgaggctgcctattactgctgctcatatgcaggttccttctgtggtcttcggcggagggtccaaagtgaccgtcctaggtcagcccaaggctgccccctggtcactctgttcccgccctcctctagtacgtgactgagcgggctggcaaggcncatagnnnnnnnnnn

SEQ ID NO: 253755 - DNA, 244 bp, Homo sapiens; identical to SEQ ID NO: 253639
  misc_feature: GYAE6OF01A327U.13.25.C03.1.454.CMB.1.raw
  modified_base (242)..(244): a, c, t, g, unknown or other
  misc_feature (242)..(244): n is a, c, g, or t

SEQ ID NO: 253756 - DNA, 244 bp, Homo sapiens
  misc_feature: GYAE6OF01BRBON.13.25.C03.1.454.CMB.1.raw
  modified_base (243)..(244): a, c, t, g, unknown or other
  misc_feature (243)..(244): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccacccttctctagtacgtgactgagcgggctggcaaggcgcatagnn

SEQ ID NO: 253757 - DNA, 243 bp, Homo sapiens; identical to SEQ ID NO: 253660
  misc_feature: GYAE6OF01DF09E.13.25.C03.1.454.CMB.1.raw
  modified_base (243)..(243): a, c, t, g, unknown or other
  misc_feature (243)..(243): n is a, c, g, or t

SEQ ID NO: 253758 - DNA, 244 bp, Homo sapiens
  misc_feature: GYAE6OF01CE8YH.13.25.C03.1.454.CMB.1.raw
  modified_base (243)..(244): a, c, t, g, unknown or other
  misc_feature (243)..(244): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnn

SEQ ID NO: 253759 - DNA, 243 bp, Homo sapiens
  misc_feature: GYAE6OF01DXWEW.13.25.C03.1.454.CMB.1.raw
  modified_base (241)..(243): a, c, t, g, unknown or other
  misc_feature (241)..(243): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttcccgccctcctctagtacgtgactgagcgggctggcaaggcgcatagnnn

SEQ ID NO: 253760 - DNA, 245 bp, Homo sapiens
  misc_feature: GYAE6OF01ES0Y1.13.25.C03.1.454.CMB.1.raw
  modified_base (242)..(245): a, c, t, g, unknown or other
  misc_feature (242)..(245): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnnn

SEQ ID NO: 253761 - DNA, 245 bp, Homo sapiens; identical to SEQ ID NO: 253686
  misc_feature: GYAE6OF01EYEY5.13.25.C03.1.454.CMB.1.raw
  modified_base (243)..(245): a, c, t, g, unknown or other
  misc_feature (243)..(245): n is a, c, g, or t

SEQ ID NO: 253762 - DNA, 243 bp, Homo sapiens; identical to SEQ ID NO: 253652
  misc_feature: GYAE6OF01AWJ6V.13.25.C03.1.454.CMB.1.raw
  modified_base (243)..(243): a, c, t, g, unknown or other
  misc_feature (243)..(243): n is a, c, g, or t

SEQ ID NO: 253763 - DNA, 522 bp, Homo sapiens
  misc_feature: GYAE6OF01BK7O7.13.25.C03.1.454.CMB.1.raw
  modified_base (517)..(517): a, c, t, g, unknown or other
  misc_feature (517)..(517): n is a, c, g, or t
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttggggacttatagacttgtctcctggtaccaacaccaccaggcaaggcccccagagtcatcatttatgggggcaataggcggccgtcagggattccactcgcttctctggctccaagtctggcaacacggcctccctgacaatctctggtcctccaggctgaggacgaggctgcctattactgctgctcatatgctaggttctttctggttggtcttcgggcggtacgggtccaaaggtcgaccgttctaggtcagcccaaggcctacgccccctcgtcnctccg

SEQ ID NO: 253764 - DNA, 243 bp, Homo sapiens; identical to SEQ ID NO: 253737
  misc_feature: GYAE6OF01BGXJK.13.25.C03.1.454.CMB.1.raw
  modified_base (242)..(243): a, c, t, g, unknown or other
  misc_feature (242)..(243): n is a, c, g, or t

SEQ ID NO: 253765 - DNA, 544 bp, Homo sapiens
  misc_feature: GYAE6OF01BGUMS.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccaccagtcaacggcccccagacgtcatctatttagtgggggcaagtaggcggccgtcgagggtactttccactcgtcttctctggctccaagtctggcaacacgcctcctgacatctctggtctccaggctggaggacgaggctgcctattactgctgctcatatcgctaggttcttcgtggttggttcgttcgggcgggtacggtaccaaaggtcgacccgttccgtaggtccacgcccgaaggtcctccgcccccgtcggtcctctcccg

SEQ ID NO: 253766 - DNA, 294 bp, Homo sapiens
  misc_feature: GYAE6OF01CNY6H.13.25.C03.1.454.CMB.1.raw
  modified_base (252)..(256): a, c, t, g, unknown or other
  misc_feature (252)..(256): n is a, c, g, or t
  modified_base (259)..(294): a, c, t, g, unknown or other
  misc_feature (259)..(294): n is a, c, g, or t
tcagtcacgtactacacgaccggtgctcgatttagtagtgtagatttgggtttggggggtgtgggtggtcgtccactcccgtccttgacgaggcttgcctattacgtgcgtgctcatatgcaggttcttcgtggtggtcttcggcggagggtcaaagtgaccgtcctaggtcagcccaaggctcgccccctggtcactctgttcccaccctctctagtacgtgactgagtcgggctggcaaggcgcagtagnnnnnggnnnnnnnnnnnnnnnnnnnnnnnnnnnnnnnnnnnn

SEQ ID NO: 253767 - DNA, 250 bp, Homo sapiens
  misc_feature: GYAE6OF01C7MRB.13.25.C03.1.454.CMB.1.raw
  modified_base (242)..(250): a, c, t, g, unknown or other
  misc_feature (242)..(250): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnnnnnnnn

SEQ ID NO: 253768 - DNA, 244 bp, Homo sapiens; identical to SEQ ID NO: 253645
  misc_feature: GYAE6OF01CFQFV.13.25.C03.1.454.CMB.1.raw
  modified_base (243)..(244): a, c, t, g, unknown or other
  misc_feature (243)..(244): n is a, c, g, or t

SEQ ID NO: 253769 - DNA, 245 bp, Homo sapiens; identical to SEQ ID NO: 253682
  misc_feature: GYAE6OF01DO4HO.13.25.C03.1.454.CMB.1.raw
  modified_base (242)..(245): a, c, t, g, unknown or other
  misc_feature (242)..(245): n is a, c, g, or t

SEQ ID NO: 253770 - DNA, 246 bp, Homo sapiens
  misc_feature: GYAE6OF01CD9VD.13.25.C03.1.454.CMB.1.raw
  modified_base (243)..(246): a, c, t, g, unknown or other
  misc_feature (243)..(246): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnnn

SEQ ID NO: 253771 - DNA, 244 bp, Homo sapiens; identical to SEQ ID NO: 253645
  misc_feature: GYAE6OF01B1WMK.13.25.C03.1.454.CMB.1.raw
  modified_base (243)..(244): a, c, t, g, unknown or other
  misc_feature (243)..(244): n is a, c, g, or t

SEQ ID NO: 253772 - DNA, 567 bp, Homo sapiens
  misc_feature: GYAE6OF01CM88X.13.25.C03.1.454.CMB.1.raw
  modified_base (227)..(227): a, c, t, g, unknown or other
  misc_feature (227)..(227): n is a, c, g, or t
  modified_base (375)..(375): a, c, t, g, unknown or other
  misc_feature (375)..(375): n is a, c, g, or t
  modified_base (449)..(449): a, c, t, g, unknown or other
  misc_feature (449)..(449): n is a, c, g, or t
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttgggacttagtagacttgtctcctggtaccaacacccacccaggcaacggcccccagagtcatctatttagtggggacaagtaggcggccgtcgagggactttccactcgccttctctggctccaagtctggcaacnccggcctccctgacaatctctggtcctccgaggctgacggtacgaggctcgaccttattactgactgctacatntgcgtacggtttcttcgttgttcggtcgttcgggcggtacgggtaccaaggtcgtaccgtcgtacgggtccacgtacccgaagggtcctaccgtccccctcgggtcctaccgttcccg

SEQ ID NO: 253773 - DNA, 280 bp, Homo sapiens
  misc_feature: GYAE6OF01CAIPV.13.25.C03.1.454.CMB.1.raw
  modified_base (247)..(280): a, c, t, g, unknown or other
  misc_feature (247)..(280): n is a, c, g, or t
tcagtcacgtactacacgaccggtgctcgatttagtagtgtagatttgggtttgggggtgtggtggggtctccactcccgccttgacgaggctggcctattactgctgctcatatgcaggttcttctgtggtcttcggcggagggtccaaagtgaccgtcctaggtcagcccaaggctgccccctggtcactctgttccccgccctcctctagtacgtgactgagcgggctggcaaggcgcatagcnnnnnnnnnnnnnnnnnnnnnnnnnnnnnnnnnn

SEQ ID NO: 253774 - DNA, 529 bp, Homo sapiens
  misc_feature: GYAE6OF01CQQXZ.13.25.C03.1.454.CMB.1.raw
  modified_base (426)..(426): a, c, t, g, unknown or other
  misc_feature (426)..(426): n is a, c, g, or t
  modified_base (521)..(521): a, c, t, g, unknown or other
  misc_feature (521)..(521): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccaccaggcaaggcccccagagtcatcatttagtgggggcaagtaggcggccgtcgagggattccactcgcttctctgctcgagtctggcaacacggcctcctgacaatctctggtctccaggctggaggacgaggctgcctattactgctgctnatatgctaggtttcttcttgtggttcttcgggcggtacggtaccaaaggtcgaccgtctaggtccacgcccaacggtcctcgccccctcggtccncgttcccg

SEQ ID NO: 253775 - DNA, 245 bp, Homo sapiens; identical to SEQ ID NO: 253686
  misc_feature: GYAE6OF01BKXUO.13.25.C03.1.454.CMB.1.raw
  modified_base (243)..(245): a, c, t, g, unknown or other
  misc_feature (243)..(245): n is a, c, g, or t

SEQ ID NO: 253776 - DNA, 272 bp, Homo sapiens
  misc_feature: GYAE6OF01CEFF9.13.25.C03.1.454.CMB.1.raw
  modified_base (247)..(272): a, c, t, g, unknown or other
  misc_feature (247)..(272): n is a, c, g, or t
tcagtcacgtactacacgaccggtgctcgatttagtagtgtagatttgggtttggggggtggtggtggtctcccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgacgtgagcgggctggcaaggcgcatagnnnnnnnnnnnnnnnnnnnnnnnnnn

SEQ ID NO: 253777 - DNA, 244 bp, Homo sapiens
  misc_feature: GYAE6OF01AWSMC.13.25.C03.1.454.CMB.1.raw
  modified_base (242)..(244): a, c, t, g, unknown or other
  misc_feature (242)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctctctagtacgtgactgagcgggctggcaaggcgcatagnnn

SEQ ID NO: 253778 - DNA, 241 bp, Homo sapiens
  misc_feature: GYAE6OF01DPFMP.13.25.C03.1.454.CMB.1.raw
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatag

SEQ ID NO: 253779 - DNA, 243 bp, Homo sapiens
  misc_feature: GYAE6OF01EP0HW.13.25.C03.1.454.CMB.1.raw
  modified_base (243)..(243): a, c, t, g, unknown or other
  misc_feature (243)..(243): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagn

SEQ ID NO: 253780 - DNA, 245 bp, Homo sapiens; identical to SEQ ID NO: 253686
  misc_feature: GYAE6OF01AK5PQ.13.25.C03.1.454.CMB.1.raw
  modified_base (243)..(245): a, c, t, g, unknown or other
  misc_feature (243)..(245): n is a, c, g, or t

SEQ ID NO: 253781 - DNA, 243 bp, Homo sapiens; identical to SEQ ID NO: 253660
  misc_feature: GYAE6OF01CPFYS.13.25.C03.1.454.CMB.1.raw
  modified_base (243)..(243): a, c, t, g, unknown or other
  misc_feature (243)..(243): n is a, c, g, or t

SEQ ID NO: 253782 - DNA, 248 bp, Homo sapiens
  misc_feature: GYAE6OF01BUXWP.13.25.C03.1.454.CMB.1.raw
  modified_base (245)..(248): a, c, t, g, unknown or other
  misc_feature (245)..(248): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttccccaccctcctctagtacgtgactgagcgggctggcaaggcgcatagnnnn

SEQ ID NO: 253783 - DNA, 242 bp, Homo sapiens; identical to SEQ ID NO: 253715
  misc_feature: GYAE6OF01BCYTV.13.25.C03.1.454.CMB.1.raw
  modified_base (242)..(242): a, c, t, g, unknown or other
  misc_feature (242)..(242): n is a, c, g, or t

SEQ ID NO: 253784 - DNA, 243 bp, Homo sapiens
  misc_feature: GYAE6OF01CQEL1.13.25.C03.1.454.CMB.1.raw
  modified_base (242)..(243): a, c, t, g, unknown or other
  misc_feature (242)..(243): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctccttagtacgtgactgagcgggctggcaaggcgcatagnn

SEQ ID NO: 253785 - DNA, 519 bp, Homo sapiens
  misc_feature: GYAE6OF01BRLIL.13.25.C03.1.454.CMB.1.raw
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtccgggtctcctggacagtcagtcaccatctcctgcactggaaccagcagtgatgttggtggttataactatgtctcctggtaccaacaacaccaggcaaacgccccaaaatcatgatttatgatgtcagtaagcggcctcgagggtccctgatcgcttctctcgcctcaagtctggcaacacgcctccctgaccatctcgtcgggcctccgaggctgaggatgagtctagtatttattactgtctgctcatatcgcagcagctacactgtacttagttcgggacggacggaccaaggcctacgaccgtcgtacggtcacgcccgaaggtcctcccgg

SEQ ID NO: 253786 - DNA, 516 bp, Homo sapiens
  misc_feature: GYAE6OF01EQKUJ.13.25.C03.1.454.CMB.1.raw
  modified_base (227)..(227): a, c, t, g, unknown or other
  misc_feature (227)..(227): n is a, c, g, or t
  modified_base (447)..(447): a, c, t, g, unknown or other
  misc_feature (447)..(447): n is a, c, g, or t
  modified_base (510)..(510): a, c, t, g, unknown or other
  misc_feature (510)..(510): n is a, c, g, or t
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccaccaggcaaggccccccagacgtcatctatttagtgggggcaagtaggcggccgtcagggatttccactcgcttctctggctccaagtctggcaacaccgcctccctgacaatctctcggtctccaggctgaggacgaggctgccttattactgctgctcatatgctagttcttntgtgtcgtcggcggaggtcaagtcgaccgtcgtaggcagcccaaggctacgcccctcggtccncgtccg

SEQ ID NO: 253787 - DNA, 246 bp, Homo sapiens; identical to SEQ ID NO: 253694
  misc_feature: GYAE6OF01BZ9WC.13.25.C03.1.454.CMB.1.raw
  modified_base (243)..(246): a, c, t, g, unknown or other
  misc_feature (243)..(246): n is a, c, g, or t

SEQ ID NO: 253788 - DNA, 245 bp, Homo sapiens
  misc_feature: GYAE6OF01D3KVQ.13.25.C03.1.454.CMB.1.raw
  modified_base (243)..(245): a, c, t, g, unknown or other
  misc_feature (243)..(245): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctgttcactctgttcccgccctcctctagtacgtgactgagcgggctggcaaggcgcatagnnn

SEQ ID NO: 253789 - DNA, 600 bp, Homo sapiens
  misc_feature: GYAE6OF01C7988.13.25.C03.1.454.CMB.1.raw
  modified_base (228)..(228): a, c, t, g, unknown or other
  misc_feature (228)..(228): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgtggacttatagacttgtctcgtgtaccaacaccaccaggcaacggccccagtacgtcactctatttagtcgggggacaagtacggcggtaccgtcgagggtactttccactcgtcttctcgtcggcctccgtaagtcgtacggacaaccgaccgcccttccctagaactaacttcctcgtggtcctccgaggtcgtaggacggacgacggtcgtcgacctttagttacgtcgtcttacgctacctaagttagtcggtacgtttacggttcttcgttggttcggtttcgtcgggtcggtacggtacctaaggtcgtaccgtcgtaggtcacgaccgacgtcgtccgtccctcgtctcgttccg

SEQ ID NO: 253790 - DNA, 243 bp, Homo sapiens
  misc_feature: GYAE6OF01C3UKM.13.25.C03.1.454.CMB.1.raw
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaaagtgaccgtcctaggtcagcccaaggctgccccctggtcactctgttcccgccctcctctagtacgtgactgagcgggctggcaaggcgcatag

SEQ ID NO: 253791 - DNA, 283 bp, Homo sapiens
  misc_feature: GYAE6OF01A51ZE.13.25.C03.1.454.CMB.1.raw
  modified_base (246)..(283): a, c, t, g, unknown or other
  misc_feature (246)..(283): n is a, c, g, or t
tcagtcacgtactacacgaccggtgctcgatttagtagtgtagatttgggtttggggggtgtggtggtcgtccactcccgccttgacgaggctgcctattactgctgctcatatcgcaggttcttctgtggtcttcggcggagggtccaaagtgaccgtcctaggtcagcccaaggctgccccctggtcactctgttccccgccctcctctagtacgtgactgagcgggctggcaaggcgcatagnnnnnnnnnnnnnnnnnnnnnnnnnnnnnnnnnnnnnn

SEQ ID NO: 253792 - DNA, 246 bp, Homo sapiens
  misc_feature: GYAE6OF01AKVFH.13.25.C03.1.454.CMB.1.raw
  modified_base (245)..(246): a, c, t, g, unknown or other
  misc_feature (245)..(246): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttccccgccctcctctagtacgtgactgagcgggctggcaaggcgcatagnn

SEQ ID NO: 253793 - DNA, 570 bp, Homo sapiens
  misc_feature: GYAE6OF01AH2HW.13.25.C03.1.454.CMB.1.raw
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaatagcagtgatggttgggacttatgaccttgtctcctggtaccgacaacacccaggcaaacgcccccaaactcatttagttacgggtcaataacgcggccctcagggtctttctgatcgtcttctctggctccaagtctgcacncgcctcctgacatctctgtcncngctgngacgagctgctntactgctgctcatatcgcttacggttcttcgttcggttggttcgttcgggcgggtacgggtacctaaggttccgtaccgttccgtagggtccaccggtcccgtacggccgtcccggtccccccgttcggtaccctacccgttccgtcccgtttaccccccg

SEQ ID NO: 253794 - DNA, 560 bp, Homo sapiens
  misc_feature: GYAE6OF01CN1Q5.13.25.C03.1.454.CMB.1.raw
  modified_base (228)..(228): a, c, t, g, unknown or other
  misc_feature (228)..(228): n is a, c, g, or t
  modified_base (374)..(374): a, c, t, g, unknown or other
  misc_feature (374)..(374): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttgggactttatagacttgtctcctggtaaccaacaccacccaggcaacggcccccagagtcatcatttagtgggggcaagtaggccggccgtcgagggtactttccactcgcttctctggctcaagtctgcaacncgcctcctgacatctctgtctcgaggctgaggacgagctcgaccttatactgctgctacatatgctaggtttcttcgtcgttggtcgttcgggcggtacgggtacctaaggtcgtacccggttccgttacggtccacggtacccgaacgggtcctcccggtcccccgttcggtccctacgttcccg

SEQ ID NO: 253795 - DNA, 255 bp, Homo sapiens
  misc_feature: GYAE6OF01BFROF.13.25.C03.1.454.CMB.1.raw
  modified_base (243)..(255): a, c, t, g, unknown or other
  misc_feature (243)..(255): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnnnnnnnnnnnn

SEQ ID NO: 253796 - DNA, 245 bp, Homo sapiens; identical to SEQ ID NO: 253686
  misc_feature: GYAE6OF01BZT0K.13.25.C03.1.454.CMB.1.raw
  modified_base (243)..(245): a, c, t, g, unknown or other
  misc_feature (243)..(245): n is a, c, g, or t

SEQ ID NO: 253797 - DNA, 227 bp, Homo sapiens
  misc_feature: GYAE6OF01ATD8N.13.25.C03.1.454.CMB.1.raw
  modified_base (221)..(227): a, c, t, g, unknown or other
  misc_feature (221)..(227): n is a, c, g, or t
tcagtcacgtactacacgaccggtgctcgatttagtagtgtagatttgggtttggggccagggagccctggtcaccgtctcctcagcctccaccaagggcccatcggtcttccccctggcaccctcctccaagagcacctctgggggcacagcggccctgggctgcctggtcaaggactacttcctagtacgtgactgagcgggctggcaaggcgcatagnnnnnnn

SEQ ID NO: 253798 - DNA, 246 bp, Homo sapiens; identical to SEQ ID NO: 253694
  misc_feature: GYAE6OF01AJG3Z.13.25.C03.1.454.CMB.1.raw
  modified_base (243)..(246): a, c, t, g, unknown or other
  misc_feature (243)..(246): n is a, c, g, or t

SEQ ID NO: 253799 - DNA, 243 bp, Homo sapiens; identical to SEQ ID NO: 253652
  misc_feature: GYAE6OF01BO34B.13.25.C03.1.454.CMB.1.raw
  modified_base (243)..(243): a, c, t, g, unknown or other
  misc_feature (243)..(243): n is a, c, g, or t

SEQ ID NO: 253800 - DNA, 667 bp, Homo sapiens
  misc_feature: GYAE6OF01BA46M.13.25.C03.1.454.CMB.1.raw
  modified_base (509)..(509): a, c, t, g, unknown or other
  misc_feature (509)..(509): n is a, c, g, or t
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcacgccagagcacgcccacctacccaagtcgcctcctaagaaacgcgggtccgggctaggaggtagaaagacgccggtcggggcctacgagtaggtaacggtcctccgtgacgaacggtccgttaccgatacccacctacaagtaacggtaaactgtcgtaccacttagtgtcgacgaacgccggaccccgaaggacgacggtccttcgtggtggaggtggggtagactacctaaaccttagtaggtcggtacaaaccaacaaactgtagaagtaaagttaagttggacgggtccggtacacgtagtacgacgacgggtaacaccgtacactaacgaacttacgacgtcctanaggtacgtaactaccgaaccaagtcgtacgtaccttacgacggacgaaccgtccggacgttattacgttacgtggtacgacgtaacaacctcgaacgtacctaacgtttacgttagttacggttcggacgacggtacctcgtgacctccgtctacccg

SEQ ID NO: 253801 - DNA, 246 bp, Homo sapiens
  misc_feature: GYAE6OF01C9TBF.13.25.C03.1.454.CMB.1.raw
  modified_base (243)..(246): a, c, t, g, unknown or other
  misc_feature (243)..(246): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnnn

SEQ ID NO: 253802 - DNA, 270 bp, Homo sapiens
  misc_feature: GYAE6OF01BWLA4.13.25.C03.1.454.CMB.1.raw
  modified_base (245)..(270): a, c, t, g, unknown or other
  misc_feature (245)..(270): n is a, c, g, or t
tcagtcacgtactacacgaccggtgctcgatttagtagtgtagatttgggtttgggggtggtggtggtctccactcccgccttgacgaggctgcctattactgctgctcatactgcaggttcttcctgtggtcttcggcggaggtccaaagtgaccgtctaggtcagcccaaggctcgccccctggtcactctcgttcccgccctcctctagtacgtgactgagcgggctggcaaggcgcatagnnnnnnnnnnnnnnnnnnnnnnnnnn

SEQ ID NO: 253803 - DNA, 292 bp, Homo sapiens
  misc_feature: GYAE6OF01DAA71.13.25.C03.1.454.CMB.1.raw
  modified_base (219)..(219): a, c, t, g, unknown or other
  misc_feature (219)..(219): n is a, c, g, or t
  modified_base (241)..(241): a, c, t, g, unknown or other
  misc_feature (241)..(241): n is a, c, g, or t
  modified_base (247)..(292): a, c, t, g, unknown or other
  misc_feature (247)..(292): n is a, c, g, or t
tcagtcacgtactacacgaccggtgctcgatttagtagtgtagatttgggtttggggggtggtggtggtctccactcccgccttgacgaggctgcctattactgctgctcatatgcaggttcttctgtggtcttcggcggagggtccaaagtgaccgtcctaggtcaggcccaaggctgccccctggtcactctgttcccgccctcctctagtaccgtnactgagcgggctcggcaaggcncatagnnnnnnnnnnnnnnnnnnnnnnnnnnnnnnnnnnnnnnnnnnnnnn

SEQ ID NO: 253804 - DNA, 245 bp, Homo sapiens
  misc_feature: GYAE6OF01D9NI9.13.25.C03.1.454.CMB.1.raw
  modified_base (243)..(245): a, c, t, g, unknown or other
  misc_feature (243)..(245): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnn

SEQ ID NO: 253805 - DNA, 645 bp, Homo sapiens
  misc_feature: GYAE6OF01AGJE5.13.25.C03.1.454.CMB.1.raw
  modified_base (229)..(229): a, c, t, g, unknown or other
  misc_feature (229)..(229): n is a, c, g, or t
  modified_base (371)..(371): a, c, t, g, unknown or other
  misc_feature (371)..(371): n is a, c, g, or t
  modified_base (412)..(412): a, c, t, g, unknown or other
  misc_feature (412)..(412): n is a, c, g, or t
  modified_base (518)..(518): a, c, t, g, unknown or other
  misc_feature (518)..(518): n is a, c, g, or t
  modified_base (587)..(587): a, c, t, g, unknown or other
  misc_feature (587)..(587): n is a, c, g, or t
tcagtcacgtactacacgaccggtgctcgatttagtagtgtagatttgggtttgggggggtcgtacgaagaggcagcgctctcgggacgtctccaccatggcctggctctgctgctcctcactctcctcactcaggacacagggtcctgggcccagtctgccctgactcagcctgcctccgtgtctgggtctcctggacagtcgatcaccattctcctgcactgaaacngcatgatcttgggacttatagacttgcttctcggtaccaacgtaccaccacgcaaggccccccaggtacgtacataccatttaactgggggccaagtaggtaccggaccgtacgacggggtaactttccgaacgttccggtnttcccttctcgggtcctccctaaagtcgttacgcgaaaccncggaccctccctagaccaacttctaccgttgaacccgttcaacggccgaaggtacgaaggctagtatttttaccgtgttcgtttacattatgaccgaggaacgggnttacgtaatttagtcgttgttttaaggaggttacggacgtagtacccggtaacgtttcgtcgggttacncggtacccgacccgttaccgaaaccctccttaggacctacgtccgttagtttcccccg

SEQ ID NO: 253806 - DNA, 246 bp, Homo sapiens; identical to SEQ ID NO: 253734
  misc_feature: GYAE6OF01DDX6N.13.25.C03.1.454.CMB.1.raw
  modified_base (242)..(246): a, c, t, g, unknown or other
  misc_feature (242)..(246): n is a, c, g, or t

SEQ ID NO: 253807 - DNA, 244 bp, Homo sapiens
  misc_feature: GYAE6OF01BW7TM.13.25.C03.1.454.CMB.1.raw
  modified_base (244)..(244): a, c, t, g, unknown or other
  misc_feature (244)..(244): n is a, c, g, or t
tcagtcacgtactacacgaccggtgctcgatttagtagtgtagatttgggtttggggggtgtggtggtctctactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagn

SEQ ID NO: 253808 - DNA, 243 bp, Homo sapiens; identical to SEQ ID NO: 253704
  misc_feature: GYAE6OF01A9FWU.13.25.C03.1.454.CMB.1.raw
  modified_base (242)..(243): a, c, t, g, unknown or other
  misc_feature (242)..(243): n is a, c, g, or t

SEQ ID NO: 253809 - DNA, 505 bp, Homo sapiens
  misc_feature: GYAE6OF01AWUFD.13.25.C03.1.454.CMB.1.raw
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (450)..(450): a, c, t, g, unknown or other
  misc_feature (450)..(450): n is a, c, g, or t
  modified_base (500)..(500): a, c, t, g, unknown or other
  misc_feature (500)..(500): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatggggcaataggcggccgtcagggattccactcgcttctctgctccaagtctggcaacacggcctccctgacaatctctgtcctccagctgaggacgaggctgcctatactgctgctnatntgcagttctctgtgtctcggtcggnggtccaagtcgtaccgtctaggtcacgcccaggctcgccccctcggtccnctccg

SEQ ID NO: 253810 - DNA, 242 bp, Homo sapiens
  misc_feature: GYAE6OF01DX0FN.13.25.C03.1.454.CMB.1.raw
  modified_base (242)..(242): a, c, t, g, unknown or other
  misc_feature (242)..(242): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggttcaaagtgaccgtcctaggtcagcccaaggctgccccctggtcactctgttcccgccctcctctagtacgtgactgagcgggctggcaaggcgcatagn

SEQ ID NO: 253811 - DNA, 270 bp, Homo sapiens
  misc_feature: GYAE6OF01BD4YO.13.25.C03.1.454.CMB.1.raw
  modified_base (243)..(270): a, c, t, g, unknown or other
  misc_feature (243)..(270): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnnnnnnnnnnnnnnnnnnnnnnnnnnn

SEQ ID NO: 253812 - DNA, 248 bp, Homo sapiens
  misc_feature: GYAE6OF01CSP05.13.25.C03.1.454.CMB.1.raw
  modified_base (244)..(248): a, c, t, g, unknown or other
  misc_feature (244)..(248): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnnn

SEQ ID NO: 253813 - DNA, 247 bp, Homo sapiens
  misc_feature: GYAE6OF01ERMM2.13.25.C03.1.454.CMB.1.raw
  modified_base (243)..(247): a, c, t, g, unknown or other
  misc_feature (243)..(247): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnnn

SEQ ID NO: 253814 - DNA, 542 bp, Homo sapiens
  misc_feature: GYAE6OF01C0RNC.13.25.C03.1.454.CMB.1.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (435)..(435): a, c, t, g, unknown or other
  misc_feature (435)..(435): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttgggacttanagtacttgtctcctggtaccaacaccaccagcaacggccccagagtcatctattagtgggggacaagtaggccggccgtcgagggtactttccactcgtcttctctcggctccaagtcgtgacaacaccggcctccgtgacatctctgtcctcgaggctgaggacgagctgctattactgctgctnatatcgacgttgttccttgtcggttgtcgttcggcggtagggtaccaaggtcgtaccgtcgtacggtcacgtacccgaggtcctaccgccccgtcgtcgtcgtcccg

SEQ ID NO: 253815 - DNA, 244 bp, Homo sapiens; identical to SEQ ID NO: 253642
  misc_feature: GYAE6OF01CYI50.13.25.C03.1.454.CMB.1.raw
  modified_base (243)..(244): a, c, t, g, unknown or other
  misc_feature (243)..(244): n is a, c, g, or t

SEQ ID NO: 253816 - DNA, 246 bp, Homo sapiens
  misc_feature: GYAE6OF01DKMH2.13.25.C03.1.454.CMB.1.raw
  modified_base (242)..(246): a, c, t, g, unknown or other
  misc_feature (242)..(246): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctctctagtacgtgactgagcgggctggcaaggcgcatagnnnnn

SEQ ID NO: 253817 - DNA, 250 bp, Homo sapiens
  misc_feature: GYAE6OF01CVP3T.13.25.C03.1.454.CMB.1.raw
  modified_base (244)..(250): a, c, t, g, unknown or other
  misc_feature (244)..(250): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctcgttcccgccctcctctagtacgtgactgagcgggctggcaaggcgcatagnnnnnnn

SEQ ID NO: 253818 - DNA, 652 bp, Homo sapiens
  misc_feature: GYAE6OF01BAMXA.13.25.C03.1.454.CMB.1.raw
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcgttagggacttatagacttgtctctggtaccaacaccaccagcaacggcccccagacgtcatctatttagtggggcaagtacggccggccgtcgagggtattccacgtcgcttctcgtcggctaccagtctcggacacacgcctccgtgactaactcctcgtcggtactccagggtccttaggaacgggacgacgggtcctggtacctacgttactggtcctcgctacgattaacgtggtccttacgggtttccttcgttcggttcgggttcgttaccgggtcgggtaacgggttaccgaaaaggttcccgggtaacccgtttacggttaccgggtaacccggttacccgaccccggtaaacgggtcccgttaccccggaccccccgtttaccgggtaccctcccggtttaccccg

SEQ ID NO: 253819 - DNA, 246 bp, Homo sapiens
  misc_feature: GYAE6OF01DH2D2.13.25.C03.1.454.CMB.1.raw
  modified_base (244)..(246): a, c, t, g, unknown or other
  misc_feature (244)..(246): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnn

SEQ ID NO: 253820 - DNA, 520 bp, Homo sapiens
  misc_feature: GYAE6OF01CCUAU.13.25.C03.1.454.CMB.1.raw
  modified_base (249)..(249): a, c, t, g, unknown or other
  misc_feature (249)..(249): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (452)..(452): a, c, t, g, unknown or other
  misc_feature (452)..(452): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggactttanagacttgtctcctggtaccaacaccaccaggcaacggcccccagagtcatcatttagtgggggcaagtaggcggccgtcgagggtatttccactcgcttctcgtggctcaagtctggcaacacgcctcctgacatctctgctcagctgagcgagctgctatctgcngctnatgtncgtagtttcttctgttcggtcttcgggnggacggtaccaagtcgtaccgtctacggtcacgtcccgaaggtctccgcccccgtcggtctccgtccg

SEQ ID NO: 253821 - DNA, 253 bp, Homo sapiens
  misc_feature: GYAE6OF01EQ4EV.13.25.C03.1.454.CMB.1.raw
  modified_base (245)..(253): a, c, t, g, unknown or other
  misc_feature (245)..(253): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagccaacggctcgcccctcgtcactctcgttcccaccctcctctagtacgtgactgagcgggcgtggcgaaggcgcatagnnnnnnnnn

SEQ ID NO: 253822 - DNA, 244 bp, Homo sapiens
  misc_feature: GYAE6OF01B8UOE.13.25.C03.1.454.CMB.1.raw
  modified_base (241)..(244): a, c, t, g, unknown or other
  misc_feature (241)..(244): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagccaaggctgccccctggtcactctgttcccaccctctctagtacgtgactgagcgggctggcaaggcgcatagnnnn

SEQ ID NO: 253823 - DNA, 244 bp, Homo sapiens
  misc_feature: GYAE6OF01D62TE.13.25.C03.1.454.CMB.1.raw
  modified_base (244)..(244): a, c, t, g, unknown or other
  misc_feature (244)..(244): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagn

SEQ ID NO: 253824 - DNA, 247 bp, Homo sapiens
  misc_feature: GYAE6OF01CYP0G.13.25.C03.1.454.CMB.1.raw
  modified_base (243)..(247): a, c, t, g, unknown or other
  misc_feature (243)..(247): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnnnn

SEQ ID NO: 253825 - DNA, 251 bp, Homo sapiens
  misc_feature: GYAE6OF01CNM4R.13.25.C03.1.454.CMB.1.raw
  modified_base (242)..(251): a, c, t, g, unknown or other
  misc_feature (242)..(251): n is a, c, g, or t
tcagtcacgtactacacgaccggtgctcgatttagtagtgtagatttgggtttgggggtgtggtggtctccactcccgccttgacgaggctgcctattactgctgctcatatgcaggtttcttctgtggtcttcggcggagggtccaaagtgaccgtcctaggtcagcccaaggctgccccctggtcactctgttcccaccctctctagtacgtgactgagcgggctggcaaggcgcatagnnnnnnnnnn

SEQ ID NO: 253826 - DNA, 265 bp, Homo sapiens
  misc_feature: GYAE6OF01BXK19.13.25.C03.1.454.CMB.1.raw
  modified_base (247)..(265): a, c, t, g, unknown or other
  misc_feature (247)..(265): n is a, c, g, or t
tcagtcacgtactacacgaccggtgctcgatttagtagtgtagatttgggtttggggggtggtggtggtctccactcccgccttgacgaggctgcctattactgctgctcatatgctaggtttcttctgtggtcttcggcggagggtccaaagtgaccgtcctaggtcagcccaaggctgccccctggtcactctgttcccgccctcctctagtaccgtgactgagcgggctggcaaggcgcatagnnnnnnnnnnnnnnnnnnn

SEQ ID NO: 253827 - DNA, 227 bp, Homo sapiens
  misc_feature: GYAE6OF01A3VAA.13.25.C03.1.454.CMB.1.raw
  modified_base (222)..(227): a, c, t, g, unknown or other
  misc_feature (222)..(227): n is a, c, g, or t
tcagtcacgtactacacgaccggtgctcgatttagtagtgtagatttgggtttggggccagggagccctggtcaccgtctcctcagcctccaccaagggcccatcggtcttccccctggcaccctcctccaagagcacctctggggggcacagcggccctgggctgcctggtcaaggactacttcctagtacgtgactgagcgggctggcaaggcgcatagnnnnnn

SEQ ID NO: 253828 - DNA, 584 bp, Homo sapiens
  misc_feature: GYAE6OF01BS1GO.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcgttgggacttatagacttgtctcctggtaccaacaccaccaggcaacggcccccagacgtcatctatttagtgggggcaagtacggcggccgtacgagggtactttccactccgctttctcgtggctacccgtaagtcgtgaccaacaccggtccctacccgtcgactaactctcgtcgtcctccaggtcctaggaacggacggaggtctcgtaccttagttaccgtgcctgtcctcatctcgcgtaggtttcttcgttcgtcgtcgtcggacggtaggtccgtaaagtcggaccgtcgtacggtcacgtacccgaacggtctccgcccccgtcgtccgtcttcccg

SEQ ID NO: 253829 - DNA, 618 bp, Homo sapiens
  misc_feature: GYAE6OF01CD8YX.13.25.C03.1.454.CMB.1.raw
  modified_base (230)..(230): a, c, t, g, unknown or other
  misc_feature (230)..(230): n is a, c, g, or t
  modified_base (605)..(605): a, c, t, g, unknown or other
  misc_feature (605)..(605): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatcctctgcactaggaaacngcagtgattcgtaggactttagagtactttgtcctccgttagtaaccaaacaccaccgaggaccgaaccggccccagacgtacactctatttaggcggggacaaacgtgggccggtccgtagaacgggttactttccacgttcgtctttctcgtcggacctaccgtaagtcgtcggacaaccgaccgtcctaccgtacgactaacttcgtcgttccgtctaccgtaggtccttaggaacggtacggacgtcgttaccgtaccgttactttacgtctccgtgtacttacgtaatacgtcgtacgttacgtttctcgttggttcggtcgtcggcggtacgacgtaggtcgtacgtcagtcgacgccgagtcctaccnccgtcgcctcgtc

SEQ ID NO: 253830 - DNA, 244 bp, Homo sapiens; identical to SEQ ID NO: 253758
  misc_feature: GYAE6OF01EELVO.13.25.C03.1.454.CMB.1.raw
  modified_base (243)..(244): a, c, t, g, unknown or other
  misc_feature (243)..(244): n is a, c, g, or t

SEQ ID NO: 253831 - DNA, 478 bp, Homo sapiens
  misc_feature: GYAE6OF01CMLXN.13.25.C03.1.454.CMB.1.raw
  modified_base (239)..(239): a, c, t, g, unknown or other
  misc_feature (239)..(239): n is a, c, g, or t
  modified_base (246)..(248): a, c, t, g, unknown or other
  misc_feature (246)..(248): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (338)..(338): a, c, t, g, unknown or other
  misc_feature (338)..(338): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (471)..(471): a, c, t, g, unknown or other
  misc_feature (471)..(471): n is a, c, g, or t
tcagtcacgtactacacgaccggtgctcgatttagtagtgtagatttgggtttggggggtgtggtaggtctccactcccgccttgacgaggctgcctattactgctgctcatatgcacggttcttctgtggtcttcggcggagggtccaaagtgaccgtcctaggtcagcccaaggctgcccccctggtcactctgttcccgcctcctctagtacgtgactgagcggctggcaagggcncatagcnnncagncngngancaggacacgcacncantatacnananacacacacacacgcgcgcncacgcgcncgacgacgacgagcgcgcgtacgagngtgcganacncacngngagagananagtatananacatatctatagagtgtgtgtgngcgagacgagcacgcacgtagtcgacacgacgcgcgcgcgacgcacgtcnctacgtcncacgacgtacacagacgngtgtacg

SEQ ID NO: 253832 - DNA, 615 bp, Homo sapiens
  misc_feature: GYAE6OF01CEVRN.13.25.C03.1.454.CMB.1.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (309)..(309): a, c, t, g, unknown or other
  misc_feature (309)..(309): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgattcgtgggacttanagacttgtctcctagtaccaacaccaccaggacaacggccccagacgtcatctatttagnggggacaagtaggcggccgtacgagggtactttccacgttcgtccttctcgtcgggccttaccgaagttcgtcggacctaaccgaccggtcccttcccgtagaactaacttccgtccgttcggtccttccgaggtccgtaggacggacggacggtctcgaccttagttactcgtcgtcgctacattatcgacgttacggtttcttcgttggtcgttcgttccgggcggtacggtaccgaaggtcggtaccgttcgtacggtcaccgcccgaacggtcctcccggacccctcggtcctccgttcccg

SEQ ID NO: 253833 - DNA, 251 bp, Homo sapiens
  misc_feature: GYAE6OF01AMLZH.13.25.C03.1.454.CMB.1.raw
  modified_base (240)..(240): a, c, t, g, unknown or other
  misc_feature (240)..(240): n is a, c, g, or t
  modified_base (245)..(251): a, c, t, g, unknown or other
  misc_feature (245)..(251): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttctgtggtcttcggcggagggtccaaagtgaccgtcctaggtcagcccaaggctcgccccctggtcactctcgttccccgccctctctagtacgtgactgagcgggctggcaaggcncatgnnnnnnn

SEQ ID NO: 253834 - DNA, 759 bp, Homo sapiens
  misc_feature: GYAE6OF01AESEZ.13.25.C03.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (250)..(250): a, c, t, g, unknown or other
  misc_feature (250)..(250): n is a, c, g, or t
tcagtcacgtactacacgaccggtgctcgatttagtagtgtagatttgggtttgggggggtcgacgaagaggcagcgctctcgggacgtctccaccatggcctgggctctgctgctcctcactctcctcactcaggacacagggtcctgggcccagtctgccctgactcagcctgcctcgtgtctggtctcctggacngtcgatcacntctctgcacgtaggaacagcagtgtactcgttagggacttanacgtacttgtcttccgtacggtaaccaaccaccctacccgaggaccgaaccggaccccagacgtcctatcgtaatttaacggtcgggggactaaggtacggtccggaccggttacgacggggtactttccgaaccgttccggtctttcgtccgtcggtcctaccgtaacgttcgtacggacaaccggtccggtccctacccgtacgtaaccctaacgttccgttaccgtttcgggtacccttaccgggaggttacccggttacgggaacgggaaccgggtacggttccggtaccgtaccgtttaacgtttaccgtcggttccttacggtccctagttagttaacgtccggtacggttaccgttttcggtcttagggttcggttccggttccggggtacgggtacggtaccggttaaaggttccggtacccggttagacggtttaccgaccgtaacccgtacgggtccttacccccggaccccgttttcggtccccgtacgtttccccgg

SEQ ID NO: 253835 - DNA, 555 bp, Homo sapiens
  misc_feature: GYAE6OF01BRC97.13.25.C03.1.454.CMB.1.raw
  modified_base (227)..(227): a, c, t, g, unknown or other
  misc_feature (227)..(227): n is a, c, g, or t
  modified_base (318)..(318): a, c, t, g, unknown or other
  misc_feature (318)..(318): n is a, c, g, or t
  modified_base (406)..(406): a, c, t, g, unknown or other
  misc_feature (406)..(406): n is a, c, g, or t
  modified_base (447)..(447): a, c, t, g, unknown or other
  misc_feature (447)..(447): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaacngcagtgattcgttgggacttagtagacttgtcctccgtcggtaaccaaccacccaaccacggccaacggcccccagacgtcatcatttagnggggacaagtaggcggcgtcgaggtattccgactcgcttctctgctcgaagtctgacacgtacgcctcctgactatctctgtcctcgngtctgacggacgaggctcgccgttatcgtcgtctcgtactnatatggactaggttcttcgttggtcgtcgtccgggcggtacggtaccgaaggttcgaccgttcgtacggtccgacgcccgaggtctccgacccgtcgtctcgttcccg

SEQ ID NO: 253836 - DNA, 583 bp, Homo sapiens
  misc_feature: GYAE6OF01C7SUT.13.25.C03.1.454.CMB.1.raw
  modified_base (370)..(370): a, c, t, g, unknown or other
  misc_feature (370)..(370): n is a, c, g, or t
  modified_base (438)..(438): a, c, t, g, unknown or other
  misc_feature (438)..(438): n is a, c, g, or t
  modified_base (465)..(465): a, c, t, g, unknown or other
  misc_feature (465)..(465): n is a, c, g, or t
  modified_base (570)..(570): a, c, t, g, unknown or other
  misc_feature (570)..(570): n is a, c, g, or t
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctggaggtgaagaagcctgggggcctcagtgaaggtctcctgcaaggcttccggatacaccctcaatggaaactatgtccactatgtgcgacaggccccaggacaaggggcttctgtggagtggggtggactacaaccctaagtacgtggtagacacaaactatggaanaaagtaaatttggaaggggccgggtacaccagtgaccagggacacgtccaagtcaatacagaccttanatcggaactcgaccagactcgactcgngaaccgacgccggtccgtagtacttacgtgtgcgtacgaactcgacgtacctaacttacgttttcgtaagtttcggggacgtacggggacgtcccgtaggtcccnccgttcgtacccc

SEQ ID NO: 253837 - DNA, 245 bp, Homo sapiens
  misc_feature: GYAE6OF01ANSSD.13.25.C03.1.454.CMB.1.raw
  modified_base (244)..(245): a, c, t, g, unknown or other
  misc_feature (244)..(245): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnn

SEQ ID NO: 253838 - DNA, 246 bp, Homo sapiens
  misc_feature: GYAE6OF01CECY4.13.25.C03.1.454.CMB.1.raw
  modified_base (243)..(246): a, c, t, g, unknown or other
  misc_feature (243)..(246): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnnn

SEQ ID NO: 253839 - DNA, 249 bp, Homo sapiens
  misc_feature: GYAE6OF01DYFAM.13.25.C03.1.454.CMB.1.raw
  modified_base (244)..(249): a, c, t, g, unknown or other
  misc_feature (244)..(249): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcgggagggtccaaagtgaccgtcctaggtcagcccaaggctgccccctggtcactctgttccccgccctctctagtacgtgactgagcgggctggcaaggcgcatagnnnnnn

SEQ ID NO: 253840 - DNA, 257 bp, Homo sapiens
  misc_feature: GYAE6OF01BYXXM.13.25.C03.1.454.CMB.1.raw
  modified_base (247)..(257): a, c, t, g, unknown or other
  misc_feature (247)..(257): n is a, c, g, or t
tcagtcacgtactacacgaccggtgctcgatttagtagtgtagatttgggtttggggggtgtggtggtctccactcacgccttgacgaggctgcctattactgctgctcatatggcaggttcttctggtggtcttcggcggagggtccaaagtgacccgtcctaggtcagcccaaggctgccccctcggtcactctgttcccgccctcctctagtacgtgactgagcgggctggcaaggcgcatagnnnnnnnnnnn

SEQ ID NO: 253841 - DNA, 246 bp, Homo sapiens; identical to SEQ ID NO: 253734
  misc_feature: GYAE6OF01EFLZK.13.25.C03.1.454.CMB.1.raw
  modified_base (242)..(246): a, c, t, g, unknown or other
  misc_feature (242)..(246): n is a, c, g, or t

SEQ ID NO: 253842 - DNA, 254 bp, Homo sapiens
  misc_feature: GYAE6OF01BZNZR.13.25.C03.1.454.CMB.1.raw
  modified_base (245)..(245): a, c, t, g, unknown or other
  misc_feature (245)..(245): n is a, c, g, or t
  modified_base (250)..(254): a, c, t, g, unknown or other
  misc_feature (250)..(254): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttctgtggtcttcggcgggagggtccaaagtgaccgtcctaggtcagcccaaggctcgccccctcggtcactctcgttccccaccctcctctagtacgtgactggagcgggctggcaaggcgnatagnnnnn

SEQ ID NO: 253843 - DNA, 248 bp, Homo sapiens
  misc_feature: GYAE6OF01ELVQL.13.25.C03.1.454.CMB.1.raw
  modified_base (243)..(248): a, c, t, g, unknown or other
  misc_feature (243)..(248): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnnnnn

SEQ ID NO: 253844 - DNA, 750 bp, Homo sapiens
  misc_feature: GYAE6OF01CB6IL.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacaggatcctgggctcagtctgccctgactcagcctcgctcagtcgtccggtctccgtggacagtcagtccaccatcctcctgcacgtggaaccagcagtgacgttcgtggacaagacttagtgtcctacctacggtaaccaacaacacccgaggaccaaccggaccccctaaaactcaattaactttactgtaactttacaactaactccggaccctacgtagtacgtaactctaactcgtcttacacgtcggtctaccaagtctacggactaaaccgaccggtccctacccgtacgtaacctacgttccgtcggtaccgggtacctacccggaacgggtaccgaacgggtaaacgggtaccgaacgggtacgttacggtaacgtttacgttaccgttcggaccggttaccctaccggtttaggaaccggttacgtttaaccggtaccctttaacccgttttaagttcccgggttacgttaaccggggtaccttacgggtaccggtaaacccgtacggttcccgtaaccccggttaccggttaacgggtaccctaacccgggtacccgtaaaccggacccctaaccccgtacggttccgtcccttaacccgg

SEQ ID NO: 253845 - DNA, 657 bp, Homo sapiens
  misc_feature: GYAE6OF01CPE0B.13.25.C03.1.454.CMB.1.raw
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctggggcctcagtgaaggtctcctgcaaggcttcggatacaccctcaatggaaactatgtccactatgtgcgacgacggcccccaaggacaaggggtcttcgtagtgggtagtggggtggacttacgaaccctaatagtggtacgacacaaaactatagaacgaagtaaatttggacggggtccggtcaaccgatcgaccgaggggacacgcaatacgaatacacgtcttacagtacgaacacgtaccacgtacctacgacctcgtagaaccgacgaaccgggtcccgtagttacgttacgtacgggttggacccggtaccgtaaaccgtaccgtaccgtacccgttaaaccttacggttttacggtaaacggtttttacggggacccgtaacggggtaccgtacccgttcgggtacccgttaccggtcccgttaaccccg

SEQ ID NO: 253846 - DNA, 257 bp, Homo sapiens
  misc_feature: GYAE6OF01D81B6.13.25.C03.1.454.CMB.1.raw
  modified_base (248)..(257): a, c, t, g, unknown or other
  misc_feature (248)..(257): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggcctgccccctcggtcactctcgttccccaccctcctctagtacgtgactgagcgggctggcaaggcgcaatagnnnnnnnnnn

SEQ ID NO: 253847 - DNA, 567 bp, Homo sapiens
  misc_feature: GYAE6OF01BZLAM.13.25.C03.1.454.CMB.1.raw
  modified_base (368)..(368): a, c, t, g, unknown or other
  misc_feature (368)..(368): n is a, c, g, or t
  modified_base (409)..(409): a, c, t, g, unknown or other
  misc_feature (409)..(409): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcgttgggacttatagacttgtctcctggtaccaacaccaccaggcaacggcccccagacgtcatctagtttagtgggggacaagtagggcggcgtacgagggtacttccactcgtcttctctggctcagtcngcacgcgcctcctgacatctctgtctcgagtctgaggacgnggctgcttatctgtctgctcatacgtgtcgttaggtttccttcgttggttcggttcgttcgggaccggtacggtacccgtaaaggtcggtacccgttccggtacggtccgacggtacccgaacggtccctcccggtccccctcggtcctccgttcccg

SEQ ID NO: 253848 - DNA, 249 bp, Homo sapiens
  misc_feature: GYAE6OF01DLPID.13.25.C03.1.454.CMB.1.raw
  modified_base (238)..(238): a, c, t, g, unknown or other
  misc_feature (238)..(238): n is a, c, g, or t
  modified_base (243)..(249): a, c, t, g, unknown or other
  misc_feature (243)..(249): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtctaggtcagcccaaggctcgccccctggtcactctgttcccgccctcctctagtacgtgactgagcgggctggcaaggcgnatagnnnnnnn

SEQ ID NO: 253849 - DNA, 273 bp, Homo sapiens
  misc_feature: GYAE6OF01BWIRG.13.25.C03.1.454.CMB.1.raw
  modified_base (209)..(209): a, c, t, g, unknown or other
  misc_feature (209)..(209): n is a, c, g, or t
  modified_base (246)..(273): a, c, t, g, unknown or other
  misc_feature (246)..(273): n is a, c, g, or t
tcagtcacgtactacacgaccggtgctcgatttagtagtgtagatttgggtttggggggtgtgggtggtctccactcccgccttgacgaggctgcctattactgctgctcatatgcaggttcttctgtggtcttcggcggagggtccaaagtgaccgtcctaggtcagcccaaggctgccccctggtcactctcgttccccacctcctntagtacgtgactgagcgggctgggcaaggcgcatagnnnnnnnnnnnnnnnnnnnnnnnnnnnn

SEQ ID NO: 253850 - DNA, 247 bp, Homo sapiens
  misc_feature: GYAE6OF01DO2NK.13.25.C03.1.454.CMB.1.raw
  modified_base (243)..(247): a, c, t, g, unknown or other
  misc_feature (243)..(247): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnnnn

SEQ ID NO: 253851 - DNA, 281 bp, Homo sapiens
  misc_feature: GYAE6OF01DC0WW.13.25.C03.1.454.CMB.1.raw
  modified_base (214)..(214): a, c, t, g, unknown or other
  misc_feature (214)..(214): n is a, c, g, or t
  modified_base (242)..(281): a, c, t, g, unknown or other
  misc_feature (242)..(281): n is a, c, g, or t
tcagtcacgtactacacgaccggtgctcgatttagtagtgtagatttgggtttggggggtgtggtggtctccactcccgccttgacgaggctgcctattactgctgctcatatggcaggttcttctgtggtcttcggcggaggtccaaagtgaccgtcctaggtcagcccaaggctgccccctggtcactctgttcccaccctctctagtcgtnactgagcgggctggcaaggtcgcatagnnnnnnnnnnnnnnnnnnnnnnnnnnnnnnnnnnnnnnnn

SEQ ID NO: 253852 - DNA, 261 bp, Homo sapiens
  misc_feature: GYAE6OF01BIGCO.13.25.C03.1.454.CMB.1.raw
  modified_base (241)..(261): a, c, t, g, unknown or other
  misc_feature (241)..(261): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggaggtccaaagtgaccgtcctaggtcagcccaaggctgccccctggtcactctgttcccaccctcctctagtacgtgactgagcgggctggcaaggcgcatagnnnnnnnnnnnnnnnnnnnnn

SEQ ID NO: 253853 - DNA, 250 bp, Homo sapiens
  misc_feature: GYAE6OF01C4C3V.13.25.C03.1.454.CMB.1.raw
  modified_base (241)..(250): a, c, t, g, unknown or other
  misc_feature (241)..(250): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttccgccctcctctagtacgtgactgagcggctggcaaggcgcatagnnnnnnnnnn

SEQ ID NO: 253854 - DNA, 620 bp, Homo sapiens
  misc_feature: GYAE6OF01C0MJU.13.25.C03.1.454.CMB.1.raw
  modified_base (231)..(231): a, c, t, g, unknown or other
  misc_feature (231)..(231): n is a, c, g, or t
  modified_base (532)..(532): a, c, t, g, unknown or other
  misc_feature (532)..(532): n is a, c, g, or t
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgccttccgtgtcgtgggtctccgtggacagtcatcaccatcctctgcacgtaggaaacngcagctatcgttaggacttagagtcttgtctccgtggtaaccaacaccaccgaggaccaaccggccccagacgtacatacctagttacggtggggactaagtcggccggacgtacgaagggtcttccacgtcgtccttctcgtacgtctaccgaagttcgtacggacaaccgaccggtccctacgtacgtacacgttctacgtcgttactaccgcgtctaggtacgtagcgttaacgtctagttacttacgttacgtcgtctcgacttacgtatagtcgacgtcgtacgactacgttaacncgttacgtacgtacggttacggacgggtaacggacacgtccgtacgtacccgtacgtacgtacgaccgtacgaggttccgtaccccgg

SEQ ID NO: 253855 - DNA, 246 bp, Homo sapiens
  misc_feature: GYAE6OF01D9MMX.13.25.C03.1.454.CMB.1.raw
  modified_base (244)..(246): a, c, t, g, unknown or other
  misc_feature (244)..(246): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnn

SEQ ID NO: 253856 - DNA, 245 bp, Homo sapiens
  misc_feature: GYAE6OF01C9G1Q.13.25.C03.1.454.CMB.1.raw
  modified_base (244)..(245): a, c, t, g, unknown or other
  misc_feature (244)..(245): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtaccgtgactgagcgggtctggcaaggcgcatgnn

SEQ ID NO: 253857 - DNA, 720 bp, Homo sapiens
  misc_feature: GYAE6OF01ADGTZ.13.25.C03.1.454.CMB.1.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (311)..(311): a, c, t, g, unknown or other
  misc_feature (311)..(311): n is a, c, g, or t
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttggacttanagtacttgtcctctgtacccaacacccaccagaccaacggcccccagacgtcactcagtttagnggggactaagtacggccggccgtgagggtcttccgactcgtcttcgtcgtcggcctaccgagtcgtacggacaaccgccggtccctccctacgacctatccgtcgtcggtcctaccgacggtcggtagacggtaagtcggtacgtccgttagttaactttacgttacgttcggtacttcgtaccttaccgtaattcgtacggtacgaacgggtaccgtacgtaacccgttaccgttaccgttaacggtttaccggttaaccgggttacccggggaaccggggttaaaccggggaaccccgttaaacgggttccccgttaacccgggtaaccccgggtttacccgttaaacggggttaccccgaacccgggttaaccccgtaacgggggttccccttaacccccccgggg

SEQ ID NO: 253858 - DNA, 252 bp, Homo sapiens
  misc_feature: GYAE6OF01AZZVG.13.25.C03.1.454.CMB.1.raw
  modified_base (243)..(252): a, c, t, g, unknown or other
  misc_feature (243)..(252): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctctctagtacgtgactgagcgggctggcaaggcgcatagnnnnnnnnnn

SEQ ID NO: 253859 - DNA, 260 bp, Homo sapiens
  misc_feature: GYAE6OF01BOK0K.13.25.C03.1.454.CMB.1.raw
  modified_base (244)..(260): a, c, t, g, unknown or other
  misc_feature (244)..(260): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttccccaccctcctctagtacgtgactgagcgggctggcaaggcgcatagnnnnnnnnnnnnnnnnn

SEQ ID NO: 253860 - DNA, 652 bp, Homo sapiens
  misc_feature: GYAE6OF01BNRFM.13.25.C03.1.454.CMB.1.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctcgctcagtgtccgggtctcctggacagtcagtcaccatctcctgcactggaaccngcagtgatggttggtgttataactatgtctcctggtaccaacaaccaccaggacaaacgaccccaaaatcatagtatttangatgtacagtaacgcgccctgacgggtcctgactcgtcttctctcgacctacagtctggaccaacgaccggtcctccctagacctatccgtcgtcgggcctaccgaggtctaggacgtagtacggtacgtcttaggtaatttaacgttaccgtcgtcttacggccttacgtaacgttacgtacggtaccgtaacggacctacgtaccgttaacgtaccgttaacgttaccgttaacggttaccggggaccgggtaaccgggtacccgtaaacggcccgttaacggtaaccccggttacccgttaacggtacccgtaaccggtaccccggtaaacgggtccccg

SEQ ID NO: 253861 - DNA, 261 bp, Homo sapiens
  misc_feature: GYAE6OF01CKZ1V.13.25.C03.1.454.CMB.1.raw
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (252)..(261): a, c, t, g, unknown or other
  misc_feature (252)..(261): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctcgccccctggtcactctcgttccccgccctctctagtacgtgacgtggacggcggtcgnggacgaggcgatanagnnnnnnnnnn

SEQ ID NO: 253862 - DNA, 246 bp, Homo sapiens
  misc_feature: GYAE6OF01B7HGD.13.25.C03.1.454.CMB.1.raw
  modified_base (243)..(246): a, c, t, g, unknown or other
  misc_feature (243)..(246): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttctgtggtcttcggcggaggtccaaagtgaccgtcctaggtcagcccaaggctgccccctggtcactctgttcccaccctcctctagtacgtgactgagcgggctggcaaggcgcatagnnnn

SEQ ID NO: 253863 - DNA, 248 bp, Homo sapiens
  misc_feature: GYAE6OF01BTUK7.13.25.C03.1.454.CMB.1.raw
  modified_base (243)..(248): a, c, t, g, unknown or other
  misc_feature (243)..(248): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnnnnn

SEQ ID NO: 253864 - DNA, 245 bp, Homo sapiens; identical to SEQ ID NO: 253760
  misc_feature: GYAE6OF01EYZY4.13.25.C03.1.454.CMB.1.raw
  modified_base (242)..(245): a, c, t, g, unknown or other
  misc_feature (242)..(245): n is a, c, g, or t

SEQ ID NO: 253865 - DNA, 253 bp, Homo sapiens
  misc_feature: GYAE6OF01C7KAJ.13.25.C03.1.454.CMB.1.raw
  modified_base (244)..(253): a, c, t, g, unknown or other
  misc_feature (244)..(253): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctcgccccctggtcactctgttccccgccctctctagtacgtgactgagcgggctggcaaggcgcatagnnnnnnnnnn

SEQ ID NO: 253866 - DNA, 545 bp, Homo sapiens
  misc_feature: GYAE6OF01B62J7.13.25.C03.1.454.CMB.1.raw
  modified_base (228)..(228): a, c, t, g, unknown or other
  misc_feature (228)..(228): n is a, c, g, or t
  modified_base (307)..(307): a, c, t, g, unknown or other
  misc_feature (307)..(307): n is a, c, g, or t
  modified_base (380)..(380): a, c, t, g, unknown or other
  misc_feature (380)..(380): n is a, c, g, or t
  modified_base (523)..(523): a, c, t, g, unknown or other
  misc_feature (523)..(523): n is a, c, g, or t
  modified_base (539)..(539): a, c, t, g, unknown or other
  misc_feature (539)..(539): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttgggacttatagacttgtctcctggtaccaacaccaccaggcaacggccccagagtcatctatttagnggggactaagtaggccggtaccgtcgagggtacttccgactcgtcttctctcggctaccgagtctggacaacncggccctccgtgacaactctcgtcgtctaccgaggtctagacggcgaggctagcctattactcgctcgctcatatcgctggtttctgtgttggtcgtcggcggaggtaccaagtcgtccgtcgtaggtccacgccaaggtccncggtcccctcggtccncgtccg

SEQ ID NO: 253867 - DNA, 252 bp, Homo sapiens
  misc_feature: GYAE6OF01AKCI3.13.25.C03.1.454.CMB.1.raw
  modified_base (244)..(252): a, c, t, g, unknown or other
  misc_feature (244)..(252): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnnnnnnn

SEQ ID NO: 253868 - DNA, 712 bp, Homo sapiens
  misc_feature: GYAE6OF01BO3KT.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctgggacagtcgatcaccatcctcctgcactaggaaacagcagtgatcgttgggacttatagacttgtctcctggtaccaacaccacccaggaccaacggcccccagagtcatctagtttagtgggggacaagtacgggccggaccgtcgagggtctttaccgactcggtcctttctcgtcggtcctacctaagtccgtacggtaccaaaccgacccggtccctaccccgtagaacctaacttcctccgtacggtcctcccgtaggccgtagggacggtacggacggtctcgtacccttacttacgtcgtactcggaccttacgtagttgtacggccgttaaggtttcctttcggtcggttcgggttccgttccggggttacgggtaaccgggttaccgtaaaagggttccgggtaaccccgttaccggttacgggtcccgaacccggtaccccggaaacgggttaccccgttcccccgggtaccccccggttaccggttaccccgtcccgtttccccgg

SEQ ID NO: 253869 - DNA, 243 bp, Homo sapiens; identical to SEQ ID NO: 253779
  misc_feature: GYAE6OF01AYHKA.13.25.C03.1.454.CMB.1.raw
  modified_base (243)..(243): a, c, t, g, unknown or other
  misc_feature (243)..(243): n is a, c, g, or t

SEQ ID NO: 253870 - DNA, 263 bp, Homo sapiens
  misc_feature: GYAE6OF01A9XNQ.13.25.C03.1.454.CMB.1.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (246)..(263): a, c, t, g, unknown or other
  misc_feature (246)..(263): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctcgcccctggtcactctcgttccccnccctctctagtacgtgactggagcgggctggcaaggccnagtagnnnnnnnnnnnnnnnnnn

SEQ ID NO: 253871 - DNA, 243 bp, Homo sapiens; identical to SEQ ID NO: 253779
  misc_feature: GYAE6OF01CS1U8.13.25.C03.1.454.CMB.1.raw
  modified_base (243)..(243): a, c, t, g, unknown or other
  misc_feature (243)..(243): n is a, c, g, or t

SEQ ID NO: 253872 - DNA, 251 bp, Homo sapiens
  misc_feature: GYAE6OF01B3033.13.25.C03.1.454.CMB.1.raw
  modified_base (244)..(251): a, c, t, g, unknown or other
  misc_feature (244)..(251): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctcgttcccgccctcctctagtacgtgactgagcgggctggcaaggcgcatagnnnnnnnn

SEQ ID NO: 253873 - DNA, 245 bp, Homo sapiens; identical to SEQ ID NO: 253837
  misc_feature: GYAE6OF01BIROT.13.25.C03.1.454.CMB.1.raw
  modified_base (244)..(245): a, c, t, g, unknown or other
  misc_feature (244)..(245): n is a, c, g, or t

SEQ ID NO: 253874 - DNA, 250 bp, Homo sapiens
  misc_feature: GYAE6OF01CY7RU.13.25.C03.1.454.CMB.1.raw
  modified_base (247)..(250): a, c, t, g, unknown or other
  misc_feature (247)..(250): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttctgtggtcttcggcggagggtccaaagtgaccgtcctaggtcagcccaaggctcgccccctggtcactctcgttccccaccctcctctagtacgtgactggagcgggctggcaaggcgcatgnnnn

SEQ ID NO: 253875 - DNA, 245 bp, Homo sapiens; identical to SEQ ID NO: 253648
  misc_feature: GYAE6OF01D625N.13.25.C03.1.454.CMB.1.raw
  modified_base (243)..(245): a, c, t, g, unknown or other
  misc_feature (243)..(245): n is a, c, g, or t

SEQ ID NO: 253876 - DNA, 807 bp, Homo sapiens
  misc_feature: GYAE6OF01AR5AD.13.25.C03.1.454.CMB.1.raw
  modified_base (230)..(230): a, c, t, g, unknown or other
  misc_feature (230)..(230): n is a, c, g, or t
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcaccatcctcctgcactggaaacngcagtgatcgttggacttatagacttgtcctcctacggtaccaacaccacccaggaccaacggcccccagacgtacatcctagtttagtggggacaagtacgggccggccgtcgagggtacttccgactcgtcttcgtcgtcggccttaccgaagtcgtacgacctaaccgaccggtcccttacccgtagaacctaacgttccttaccgttcggttaccctccggacggtaccgttagggaaacgggtaccggtaacggtcccgttaccggtaaccctttaacgtttaacccgtcgttcccgttacggtcccttaacgtaacgtttacggttacgttaccggtttaaccgggttttcccttttaccggtttcgggtttccgggtttacccggtttcgggggaacccgggttaaccgggttaaacccgttaaaaccggggtttcccggtaaccccggtttacccggttaacggttccccggtaaacccggtaccccccgggtaaaccgggttcccccgttacccccgggttacccccccggtttaaccgggttccccgttacccggtttccccccggg

SEQ ID NO: 253877 - DNA, 249 bp, Homo sapiens
  misc_feature: GYAE6OF01DKFCA.13.25.C03.1.454.CMB.1.raw
  modified_base (244)..(249): a, c, t, g, unknown or other
  misc_feature (244)..(249): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctcgttcccgccctcctctagtacgtgactgagcgggctggcaaggcgcatagnnnnnn

SEQ ID NO: 253878 - DNA, 748 bp, Homo sapiens
  misc_feature: GYAE6OF01BVITF.13.25.C03.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
tcagtcacgtactacacgaccggtgctcgatttagtagtgtagatttgggtttgggggggtcacaagaggcagcgctctcgggacgtctaccacactggcctgggctctgctgctcctcactctcctcactcaggactacagggtcctgggcccagtctgccctgactcagcctgcctcgtgtctggtctcctggacngtcgatcaccntctctgcatggaacngcagtnactgttggacttatagtacttcgtctccgtggtaccaactaccgaccaggacgaaccggcccccagacgtcactctagtttaggcggggacaaggtcggtccggtaccgtagacgggttactttaccacttccggtactttcctcgtcggtacctacgtaacgttcgtacggaccgtaaccgtccgggtaccccttaccgtaacgtaaccgtaaacgttacccgtttacgttaccgggttaccccgttacggtacgggttacccgttaaggggaaccgggtaaccggtacggggttaccctacgggttaccccgtttaagttttacccgtaggtcccgttacggtcccttaacgtaacggtacgttacgttacggttacggttttccgttcgttcgggttcgttaccgggtttacgggccgggttacggtaaccgttaacgggtccgtaccgtttccggttacggccgtaccgacccgacggttccgcccgggttaccctcgtaccgtcccgttccgg

SEQ ID NO: 253879 - DNA, 248 bp, Homo sapiens; identical to SEQ ID NO: 253843
  misc_feature: GYAE6OF01DXCFN.13.25.C03.1.454.CMB.1.raw
  modified_base (243)..(248): a, c, t, g, unknown or other
  misc_feature (243)..(248): n is a, c, g, or t

SEQ ID NO: 253880 - DNA, 263 bp, Homo sapiens
  misc_feature: GYAE6OF01CA4NN.13.25.C03.1.454.CMB.1.raw
  modified_base (246)..(263): a, c, t, g, unknown or other
  misc_feature (246)..(263): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtctaggtcagcccaaggctgcccccctggtcacttctcgttcccgccctcctctagtacgtgactgagcgggctaggcaaggcgcagtagnnnnnnnnnnnnnnnnnn

SEQ ID NO: 253881 - DNA, 763 bp, Homo sapiens
  misc_feature: GYAE6OF01DOZSH.13.25.C03.1.454.CMB.1.raw
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctagaaacacggtccggggctgaggtgaagaagccgtggggcctcgaggtgaaggtctcctgacgaaggccttccggataccacccgtcaataggaaactagtcgtcctaactagtcgtgcgacgacggaccccgaaggacgaagggtcttcgtggtaggtaggtggggtaggtaactaccgaaaccctaagtaggtggtacgacaaactaaacgtagtagaagaaagtaaagttggacggggccggtacacagtcgaacgagggaccacgtacagtacaactacgacgtccttacgagtacgggaacctacgaaccgtacgaaccgttacgtaccctcgtacggaaacccggtaaccggtaacccgggttcccgttaagtttaaccgtttacggttacggtccgggtaaccgggttaaacccgtaaaccgttccgtaaacggttaaccccttttaaacgtttaccggtttttaacgggtttaaaccgggtttttcccggggggaacccggtaacggggttacccggttaccccggttaccgggttaaccccgttccccggttacccgttacccccgg

SEQ ID NO: 253882 - DNA, 253 bp, Homo sapiens
  misc_feature: GYAE6OF01DL0VT.13.25.C03.1.454.CMB.1.raw
  modified_base (248)..(253): a, c, t, g, unknown or other
  misc_feature (248)..(253): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttctgtggtcttcggcggagggtccaaagtgaccgtcctaggtcacgcccaagactcgccccctggtcactctcgttcccgccctcctctagtacgtgactggagcgggctggcaaggcgcatagnnnnnn

SEQ ID NO: 253883 - DNA, 259 bp, Homo sapiens
  misc_feature: GYAE6OF01B3O3F.13.25.C03.1.454.CMB.1.raw
  modified_base (241)..(241): a, c, t, g, unknown or other
  misc_feature (241)..(241): n is a, c, g, or t
  modified_base (246)..(259): a, c, t, g, unknown or other
  misc_feature (246)..(259): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaaagtgaccgtcctaggtcagcccaaggctcgccccctcggtcactctgttcccaccctcctctagtacgtgactgagcgggctggcaaggcgnatagnnnnnnnnnnnnnn

SEQ ID NO: 253884 - DNA, 707 bp, Homo sapiens
  misc_feature: GYAE6OF01BBRGA.13.25.C03.1.454.CMB.1.raw
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (317)..(317): a, c, t, g, unknown or other
  misc_feature (317)..(317): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcnctgcactggaaacngcagtgatcgttagggacttatagtacttcgtctccgtggtaaccaaccacccacccgaggcaacggcccccagagtcatctagtttagngggggacaagtacgggccggtaccgtacgtagggtactttacccgacttcggtcctttcctcgtacggtcccttaccgtaacggtccgtacgggaccaaacccgtacccgggtacccctttaccccgtacgtaacctaaacttcccgtttccgttacggttccctaccggaaggtccgtacgggaacgggaccggtagggtccttagtttaacttttttacgtgttttacgttacctagttacgtcgaacgtagggaaggtagtagttagtttacgtgtttacgtttagggaaggtcggtacgtaacggttcccgtaccggttcgttggtaccgacgtacccgaaccggtaccccaaacccgtcgttacgtacctccgttcgttaccccg

SEQ ID NO: 253885 - DNA, 256 bp, Homo sapiens
  misc_feature: GYAE6OF01CISDZ.13.25.C03.1.454.CMB.1.raw
  modified_base (242)..(256): a, c, t, g, unknown or other
  misc_feature (242)..(256): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgcctcctctagtacgtgactgagcgggctggcaaggcgcatagnnnnnnnnnnnnnnn

SEQ ID NO: 253886 - DNA, 253 bp, Homo sapiens
  misc_feature: GYAE6OF01C1KEU.13.25.C03.1.454.CMB.1.raw
  modified_base (240)..(240): a, c, t, g, unknown or other
  misc_feature (240)..(240): n is a, c, g, or t
  modified_base (246)..(253): a, c, t, g, unknown or other
  misc_feature (246)..(253): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggaggtccaaagtgaccgtcctaggtcagcccaaggctcgcccccctggtcactctcgttccccgccctcctctagtacgtgactgagcgggctggcaaggcncatagnnnnnnnn

SEQ ID NO: 253887 - DNA, 582 bp, Homo sapiens
  misc_feature: GYAE6OF01A4YS7.13.25.C03.1.454.CMB.1.raw
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (423)..(423): a, c, t, g, unknown or other
  misc_feature (423)..(423): n is a, c, g, or t
  modified_base (451)..(451): a, c, t, g, unknown or other
  misc_feature (451)..(451): n is a, c, g, or t
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctggggcctcagtgaaggtctcctgcaaggcttccggataccaccctcaatggaaactatgtccactatgtgcgacacggccccaggacagggcttctgtggagtggggtgatcaacctatagtgngacacaactangaagaagtaatttggacggggtccgtcaccgagtacgaccgagggacacgtccatcaataccagtccttnatacggtaactgaccagactcgacctcnggaaccgacgaccggcgtagttattacgtagtcgtacggtacgaaactcgaacgtcccgtaacttacgtttaggtaacggttttcgggaccgtagggccgtacccgttggtccctaccggttcctaccccg

SEQ ID NO: 253888 - DNA, 681 bp, Homo sapiens
  misc_feature: GYAE6OF01B20UG.13.25.C03.1.454.CMB.1.raw
  modified_base (250)..(250): a, c, t, g, unknown or other
  misc_feature (250)..(250): n is a, c, g, or t
tcagtcacgtactacacgaccggtgctcgatttagtagtgtagatttggggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcacgtggaaacagcagtgatcttgggacttanagtacttgtctcctggtaccaacaccaccaggacacggcccccagagtcatctatttagtggggctaagtagggcgtccgtcgacgggtatttccgactcgtccttcgtcgtcgggccttacccgtaagtcctggacctaacgaccggtccctacccgttcgactaacttcgtaccgtcgtcctaccgagggtctagggaacggtacggacggtcgtcggtaccttaactttacgtcggccttcgacttactaattacgtcggtaccgtaggttttccgtaccggttggttcggttacggttacccgggtcggggttaaaccgggtcctaaacgggtccgtaacccggtttcggtaacggttccgacggtaccccggaaacggtcccgttaccccggtacccccgtttcgggacccttacggtttcccccg

SEQ ID NO: 253889 - DNA, 259 bp, Homo sapiens
  misc_feature: GYAE6OF01DD03V.13.25.C03.1.454.CMB.1.raw
  modified_base (138)..(138): a, c, t, g, unknown or other
  misc_feature (138)..(138): n is a, c, g, or t
  modified_base (210)..(210): a, c, t, g, unknown or other
  misc_feature (210)..(210): n is a, c, g, or t
  modified_base (242)..(242): a, c, t, g, unknown or other
  misc_feature (242)..(242): n is a, c, g, or t
  modified_base (248)..(259): a, c, t, g, unknown or other
  misc_feature (248)..(259): n is a, c, g, or t
tcagtcacgtactacacgaccggtgctcgatttagtagtgtagatttgggtttggggggtgtggtggtctccactcccgccttgacgaggctgcctattactgctgctcatatgctaggttcttctgtggtcttcggnggaggtccaaagtcgaccgtcctaggtcacgcccaaggctcgccccctggtcactctcgttcccacctcctntagtacgtgactggagcggctggacgaggcgnagtagnnnnnnnnnnnn

SEQ ID NO: 253890 - DNA, 848 bp, Homo sapiens
  misc_feature: GYAE6OF01AXFTJ.13.25.C03.1.454.CMB.1.raw
  modified_base (340)..(340): a, c, t, g, unknown or other
  misc_feature (340)..(340): n is a, c, g, or t
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagccctctcctactgtctcggtcggtcctcggtagacgtcgtacgtactaccaactctcctacgtcgactacggtaagtaagtacgacgtagtagtgttggttaggttaacgttaactaacgttcgttcgttccgtacggttaaccgtaaaccaaaccaacccgtaccggaanaaccggtaaacccccaaccttaaccgtaatttaacggttttaaccgggttaacggtaactaaaacggtacccggtcccgtacctaacgggtacgtttccttaacggagttacctcccgttacttccgtacgtcgtaaccgtacgtaacggttcgaccaactaccggtacccgttccctacgacgtaactcgttccgacggtaccgtcctacggggacgtacgggaaccggtacggtacgttacgtttaacttttacgtttaggtcgttttaacacgttacgtacggtcggtaacggtaaagggtaaccgtttggaacttttacgttaacgggtttaccgttaggggttaaccggttaacgggtaccgttaaaccgggttcccgttacccgttacccggtttaccggtacggttacccggaaccccgttaacgggtaccccgacccccgttaaacgtcggtttaccctaacccgttaccgtttccccgttacccggtcccgttaccccg

SEQ ID NO: 253891 - DNA, 255 bp, Homo sapiens
  misc_feature: GYAE6OF01DJD7A.13.25.C03.1.454.CMB.1.raw
  modified_base (247)..(255): a, c, t, g, unknown or other
  misc_feature (247)..(255): n is a, c, g, or t
tcagtcacgtactacacgaccggtgctcgatttagtagtgtagatttgggtttggggggtgtggtggtctccactcccgccttgacgaggctgcctattactgctgctcatatgctagtttcttctgtggtcttcggcggagggtccaaagtgacccgtcctaggtcacgacccaaggctcgccccctggtcactctcgttccccgccctctctagtcgtgactgaggcggctggacaggcgcatgnnnnnnnnn

SEQ ID NO: 253892 - DNA, 230 bp, Homo sapiens
  misc_feature: GYAE6OF01B5WYD.13.25.C03.1.454.CMB.1.raw
  modified_base (140)..(140): a, c, t, g, unknown or other
  misc_feature (140)..(140): n is a, c, g, or t
  modified_base (216)..(230): a, c, t, g, unknown or other
  misc_feature (216)..(230): n is a, c, g, or t
tcagtcacgtactacacgaccggtgctcgatttagtagtgtagatttgggtttggggccagggagccctggtcaccgtctcctcagcctccaccaaggcccatcggtcttccccctgcaccctcctccaagagcacctcnggggcacagcggccctggctgcctggtcaaggactacttcctagtactgactgagcgggctggcaaggctcatagnnnnnnnnnnnnnnn

SEQ ID NO: 253893 - DNA, 788 bp, Homo sapiens
  misc_feature: GYAE6OF01B74AM.13.25.C03.1.454.CMB.1.raw
  modified_base (247)..(247): a, c, t, g, unknown or other
  misc_feature (247)..(247): n is a, c, g, or t
  modified_base (622)..(622): a, c, t, g, unknown or other
  misc_feature (622)..(622): n is a, c, g, or t
tcagtcacgtactacacgaccggtgctcgatttagtagtgtagatttggggtttggggggggtcacaagaggcagcgctctcgggacgtctccaccatggcctgggctctgctgctcctcactctcctcactcaggacacgacgggtcctcgggcccagtctcgccctgacctcacgcctcgccctccgtgtcgtgggtcctccgtggacagtcgactccacctatcctcctgccacgtaggaaacngacagtgattcgttaggacttagtagtacttcgtctaccgtacggtaacccaaccacccgaaccgacggaccgaaccggcccccaaggtacgtacctattaccgttacgttttaacggacgggggtactaaacgggtacgggtccgggaccggttacggtaacgggttaccttaccccggtaccgttccgggttaccttttccgtccgtcggtacccgttaaccgtacggtttccgtacgggaacccaaccggtaccccgggtccccttacccggtacgtaaacctaacgttccgtcgttacgtccgtaccgacggtcgtacggacgggtacgacggtcgtaccgtccgttacgttacgtcgtcgttcgtacctntaacgtgtacgtacggttcgtttcgttcggttcggtcggttccgttccggggcgggtaacggttaacgaccgggttcccggtaccgttcggtaacccggtcggacccgtaaccggtacccggtcccttaccccggtcccggtttaccgtccgtcctttacccccgg

SEQ ID NO: 253894 - DNA, 880 bp, Homo sapiens
  misc_feature: GYAE6OF01AO2LQ.13.25.C03.1.454.CMB.1.raw
  modified_base (194)..(194): a, c, t, g, unknown or other
  misc_feature (194)..(194): n is a, c, g, or t
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctagaaacnggtccgggctggaggtgaagagccgtggggcctcgagtgacggtctccgtgacgaaggtccttccggataccaccctacaagtacggaaactagtcgtacctaatagtcggtacgaccggaaccgaccgggacccccgaagggaaccgaacggggtcctttacggtgggtagggagggttgggggtacgtaacgttaaccgtaaacccgttaaggtacgggttacgggtacgaaaccgtaaacgtaaaacgttagtaacggtaaaggtaaaacggtttaaacggtttacggggaaccggggggtacccgggtaaccgtaaaccgtaacggttaccgggaacccgggtaacgggggtaacccttaaccggttaacccgtaacgttaaccgtaaacgttaaaccccggtaaccgtttacccgtttaacgtaaccggttaacgggtaaacccgttaaccggaaacccgtaacggtaacccgttaaccggttacccgttaccgtaacggaaccgtaccggtaccggttacgttacgttacgttacgttcggtacggtaccggtaacgtaaccgtaccgtaaccgttaacccgtttaacgtttacggtttaacggttacgggtttaccggggaccggttaacgggtacccgttacccggttacggttcccgtaaccggttcccgtacccgg

SEQ ID NO: 253895 - DNA, 656 bp, Homo sapiens
  misc_feature: GYAE6OF01E39DW.13.25.C03.1.454.CMB.1.raw
  modified_base (288)..(288): a, c, t, g, unknown or other
  misc_feature (288)..(288): n is a, c, g, or t
  modified_base (471)..(471): a, c, t, g, unknown or other
  misc_feature (471)..(471): n is a, c, g, or t
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagccccactcccaagtgctcctagaaacaggtccggggctggaggtagaagaacgccgtggggcctcgagtgaaggtcctcctgacaaggtcttaccggataccaccctacaatggaaactntcgtccactagtcgtgcgacacggccccaggacaaggtcttcgtgtggagtgggtcgataccaacctagtagtggtacaacaacaaactataggaaagaaagtaaagtttgggaacggggcccgggttacaaccagtaccgaccgtacgggaccaccgtaccatacaactacacgtcccttanaagtacggaactcgaaccgacgtacctacgtaccttacgacgaccgaaccgacggtccgttagttacttcgtggtacggaccggtacaacctcgaaccgttacccttaacgtttacgtttacggttaacggtttcggggaacccgttacgggtccgtaccgtacggtccctcccgtccttacccg

SEQ ID NO: 253896 - DNA, 842 bp, Homo sapiens
  misc_feature: GYAE6OF01CT8VA.13.25.C03.1.454.CMB.1.raw
  modified_base (197)..(197): a, c, t, g, unknown or other
  misc_feature (197)..(197): n is a, c, g, or t
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgcctacctagaaacgnggtccgggctggaggtagaagaacgccggtggggcctcgaggtagaacggtcctccgtgacgtaacggtccttaccggactaccctaacccttacaaacgttaacgggtaaaaccttagttaccgttaccctaacgtttagttcgggttacggacccggaaccggacccggggaccccccggaaagggaaaccggtaacggggttcctttaccggtgggttacggggagggttcgggggtaacgtactaaccgtaaacccgttaaggttaggttacggtaccgaacctaaacgtaaacgttaagtacggtaaaaggtaaacgttaaagggtttacggggaaccggggtaccggtaccaaaccgtagtacccggaacggtacggggaacctaccgtacctaacgtacgaaacgtaccgtacgtaccgtttacgacgttaacggtaaccgtacgtaacccgtacggtacctaccgaccttaccgtaacgaaccggaccggtaaccggttacgttagttacgttacgtcggtacggtaccggtaaccgtaacctacgtaaccgtacccgtttaaacgttagttacggtttacgggttaccgggaccggtacgggtacccgttaccgtggtaccctccgttcctacccg

SEQ ID NO: 253897 - DNA, 255 bp, Homo sapiens
  misc_feature: GYAE6OF01DADHX.13.25.C03.1.454.CMB.1.raw
  modified_base (242)..(255): a, c, t, g, unknown or other
  misc_feature (242)..(255): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctcgttcccgccctcctctagtcgtgactgagcggctggcaaggcgcatagnnnnnnnnnnnnnn

SEQ ID NO: 253898 - DNA, 249 bp, Homo sapiens
  misc_feature: GYAE6OF01BRTTV.13.25.C03.1.454.CMB.1.raw
  modified_base (246)..(249): a, c, t, g, unknown or other
  misc_feature (246)..(249): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctcgccccctggtcactctgttccccaccctcctctagtacgtgactgagccgggctggcaaggcgcatagnnnn

SEQ ID NO: 253899 - DNA, 250 bp, Homo sapiens
  misc_feature: GYAE6OF01CC1U9.13.25.C03.1.454.CMB.1.raw
  modified_base (244)..(250): a, c, t, g, unknown or other
  misc_feature (244)..(250): n is a, c, g, or t
tcagtcacgtactacacgaccggtgctcgatttagtagtgtagatttgggtttggggggtgtggtggtctccactcccgccttgacgaggctgcctattactgctgctcatatgcagttcttctgtggtcttcggcggagggtccaaagtgaccgtcctaggtcagcccaaggctgccccctcggtcactctcgttcccaccctcctctagtacgtgactgagcgggctggcaaggcgcatagnnnnnnn

SEQ ID NO: 253900 - DNA, 244 bp, Homo sapiens
  misc_feature: GYAE6OF01C8RR6.13.25.C03.1.454.CMB.1.raw
  modified_base (242)..(244): a, c, t, g, unknown or other
  misc_feature (242)..(244): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggaggtccaaagtgaccgtcctaggtcagcccaaggctgccccctggtcactctgttcccaccctcctctagtacgtgactgagcgggctggcaaggcgcatagnnn

SEQ ID NO: 253901 - DNA, 250 bp, Homo sapiens
  misc_feature: GYAE6OF01D065Q.13.25.C03.1.454.CMB.1.raw
  modified_base (236)..(236): a, c, t, g, unknown or other
  misc_feature (236)..(236): n is a, c, g, or t
  modified_base (242)..(250): a, c, t, g, unknown or other
  misc_feature (242)..(250): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctcgccccctggtcactctcgtcccaccctctctagtacgtgactgagcggctggcaaggcncatagnnnnnnnnn

SEQ ID NO: 253902 - DNA, 253 bp, Homo sapiens
  misc_feature: GYAE6OF01AGZ54.13.25.C03.1.454.CMB.1.raw
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (248)..(253): a, c, t, g, unknown or other
  misc_feature (248)..(253): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttctgtggtcttcggcggagggtccaaagtgaccgtcctaggtcagcccaaggctcgccccctcggtcactctcgttcccaccctcctctagtcgtgactgaggcggctggacaggcncaangngnnnnnn

SEQ ID NO: 253903 - DNA, 249 bp, Homo sapiens
  misc_feature: GYAE6OF01E2VBO.13.25.C03.1.454.CMB.1.raw
  modified_base (242)..(249): a, c, t, g, unknown or other
  misc_feature (242)..(249): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgtcccaccctctctagtacgtgactgagcgggctggcaagggcgcatagnnnnnnnn

SEQ ID NO: 253904 - DNA, 267 bp, Homo sapiens
  misc_feature: GYAE6OF01CLA7W.13.25.C03.1.454.CMB.1.raw
  modified_base (245)..(267): a, c, t, g, unknown or other
  misc_feature (245)..(267): n is a, c, g, or t
tcagtcacgtactacacgaccggtgctcgatttagtagtgtagatttgggtttggggggtgtggtggtctccactcccgccttgacgtaggctgcctattactgctgctcatatgcgagttcttctgtggtcttcggcgagggtccaaagtgacgtcctaggtcagcccaaggctgccccctggtcactctgttcccgccctctctagtacgtgactggagtcggggctggcgaaggcgcatagnnnnnnnnnnnnnnnnnnnnnnn

SEQ ID NO: 253905 - DNA, 260 bp, Homo sapiens
  misc_feature: GYAE6OF01AZ1E4.13.25.C03.1.454.CMB.1.raw
  modified_base (240)..(260): a, c, t, g, unknown or other
  misc_feature (240)..(260): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggaggtccaaagtgaccgtctaggtcagcccaaggctgccccctggtcactctgttcccgcctcctctagtacgtgactgagcgggctggcaaggcgcatagnnnnnnnnnnnnnnnnnnnnn

SEQ ID NO: 253906 - DNA, 256 bp, Homo sapiens
  misc_feature: GYAE6OF01AI6SM.13.25.C03.1.454.CMB.1.raw
  modified_base (246)..(256): a, c, t, g, unknown or other
  misc_feature (246)..(256): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctcgccccctcggtcactctgttccccgccctcctctagtacgtgactgagcgggctggcaaggcgcatagnnnnnnnnnnn

SEQ ID NO: 253907 - DNA, 706 bp, Homo sapiens
  misc_feature: GYAE6OF01DFMIL.13.25.C03.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
tcagtcacgtactacacgaccggtgctcgatttagtagtgtagatttgggtttggggggggtcacgaagaggcagcgctctcgggacgtctccaccatggcctgggctctgctgctcctcactctcctcactcaggacacagggtcctgggcccagtctgccctgactcagcctgcctccgtgtctgggtctccgnggacngtcgatcacatctcctgcatggaaacngnagtgatcgttggacttagtagtacttgtcctcgtacgtaaccaaccacccaccgacggacgaaccggacccccagtacgtacattacttagttacgtaggggactaaggtacggccggtaccgtaacgtagggttactttccgaacgttcgtccttcgtctcggtcctacgtaacgtctacggaccaacgtacccgtcccgtacctagaacctacgttccgtcgtcggttcctccggtaacggtcttaacgggacggaaacggtcgtaacccttcggtacctttaaacgttcgtcgtaccgtcgtactacgtacgttagacgtccgtacgtttccgttgttacgggttcgtttaccggttgggaccgggttaaccggtaaaccgtaaacggttcggtacccgtaccggtacggttaccgaccgggcccgttaaggtcccgtcccgtaaccccgttcgttacccgtccgtttaccgg

SEQ ID NO: 253908 - DNA, 754 bp, Homo sapiens
  misc_feature: GYAE6OF01EXAET.13.25.C03.1.454.CMB.1.raw
  modified_base (241)..(241): a, c, t, g, unknown or other
  misc_feature (241)..(241): n is a, c, g, or t
  modified_base (505)..(505): a, c, t, g, unknown or other
  misc_feature (505)..(505): n is a, c, g, or t
tcagtcacgtactacacgaccggtgctcgatttagtagtgtagatttggggtttggggggggtcacaagaggcagcgctctcgggacgtctccaccatggcctgggctctgctgctcctcactctcctcactcaggacacagggtcctggacccagtctgccctgactcagcctcgcctccgtgtcgtgggtctccgtaggacagtcgatccaccatccgtcctgaccaacgtaggaaacngactaggtgattcggttaggaacctttagtacgtactttcgtcctccgttacggtaacccaacctacccaaccgacggaaccgaaccggccccccgaaggtaccgtacctaagttaccgttaaaggttttacggacgggggtacctaaaggtaccggggccggtacccgtacggtacgggttacctttaccgtacgttccgtaccttcctcgtacggcccttacgtaacgtcgtacggacctaaccgtcccggtacctccgtanaacctacttctcgtaccgttccacggcgtaccgtggaacgggtcgacgccgtacgtaccttacgtacgttcggctcgtacttatacgtggtacgtcgttacgtttcgttcgttgggttccggtacgggttccgggacggttaccggttaacccggtaaggttcccggtaaccgttcgggtaacgtccgtacccgacccggtaacgtcccgttcccggtaccccgttaccggtccgtcccgtttaccccg

SEQ ID NO: 253909 - DNA, 245 bp, Homo sapiens
  misc_feature: GYAE6OF01ERXEZ.13.25.C03.1.454.CMB.1.raw
  modified_base (237)..(237): a, c, t, g, unknown or other
  misc_feature (237)..(237): n is a, c, g, or t
  modified_base (243)..(245): a, c, t, g, unknown or other
  misc_feature (243)..(245): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcncatagnnn

SEQ ID NO: 253910 - DNA, 506 bp, Homo sapiens
  misc_feature: GYAE6OF01CD1CM.13.25.C03.1.454.CMB.1.raw
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (258)..(259): a, c, t, g, unknown or other
  misc_feature (258)..(259): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (271)..(272): a, c, t, g, unknown or other
  misc_feature (271)..(272): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
tcagtcacgtactacacgaccggtgctcgatttagtagtgtagatttgggtttggggggtgtggtgggtctccactcccgcttgacgaggctgcctattactgctgctcatatgcaggttcttctgtgtcttcggcggagggtcaaagtcgaccgtctaggtcagccaaggctcgcccctgtcactctcgtcccacctctgtagtacgtgacgtggacgcgggctcgggacgtaacgggcctanacgtagcncgncgnntactgngtancnncacgtcgangtntgatcgtncgcgcgngngacgngtgcgtgngtanactagtagagtgtgntganactctacgcacgtgtgtcgacacacgacncnctcncgagatacganacgacgtatgtactacacatanactcncgtcgtacgacgacgtgcgngactatagtatntgtagtgtcgtgtcgacgtgacgcgtacgtacgtcgcgacgtcgtacgcgacgtcgacgcgtcg

SEQ ID NO: 253911 - DNA, 912 bp, Homo sapiens
  misc_feature: GYAE6OF01A0QAP.13.25.C03.1.454.CMB.1.raw
  modified_base (248)..(248): a, c, t, g, unknown or other
  misc_feature (248)..(248): n is a, c, g, or t
tcagtcacgtactacacgaccggtgctcgatttagtagtgtagattttggggtttggggggggtcacaagaggcagcgctctcgggacgtctccaccatggcctgggctctgctgctcctcactctcctcactcaggacacgacgggtccgtcgggcccagtctcgccctgactcagcctgcccgtcgtgtcgtcgggtctccgtggactaggtcgactcacctatcctcctgacacgtaggaaaccngactagtcgagttcgttaggtacttagtacgtactttcgtacctaccgtacggtaacccaaaccgaacccgaaccgtaggacccgaacccggaccccgaaggtacgttacctaacgttacgttaacgttttaacggggtacgggggtaactaaacgggttaccgggacccggggttacccggttaaccgggttaaacgggtttacccttttacccgtaaccggtttcccggtttccgttttaccgtttaccggtcgggttaaccccttaaccggtaaacgggtttccccgtaacgggttaacccgaaacccgggttaccccgggtacccctttaccccgtaaggtaaacccctttacgttccccggttaccgttacccgggtttacccgttacggtaccgggtacccggtttagggaacgggtaacgggtaccgtccgtaccgttaccgtttaacgttccgtacgtcgtcgtaccttactacggttacgttacgttacggttacggttttccgtttacggttcgggtttcggtccgggttacgggtaacgggttaccggtacgttaacgggtaccggttacccgttccgggacggttaaccggacccgtacccggaaccggttcccgtacccggttcccgtaccggttcccgttcccgttcccg

SEQ ID NO: 253912 - DNA, 253 bp, Homo sapiens
  misc_feature: GYAE6OF01CEZ92.13.25.C03.1.454.CMB.1.raw
  modified_base (239)..(253): a, c, t, g, unknown or other
  misc_feature (239)..(253): n is a, c, g, or t
tcagtcacgtactacacgaccggtgctcgatttagtagtgtagatttgggtttggggggtgtggtggtctccactcccgccttgacgaggctgcctattactgctgctcatatgcagttcttctgtggtcttcggcggaggtccaaagtgaccgtcctaggtcagcccaaggctcgccccctggtcactctcgtcccgcctctctagtacgtgactggcgcggctggcgagcgcatagnnnnnnnnnnnnnnn

SEQ ID NO: 253913 - DNA, 840 bp, Homo sapiens
  misc_feature: GYAE6OF01BOUHS.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcacctatcctcctgcacgtaggaaaccagcagtgattcgttggtacttatagtacgttgtcctccgtcggtaaccaaaccacccaccgacggacaaccggcccccgagacgtcactctagtttacggaggggacaacgtacgggccggtccgtcgaagggttactttaccgacgttccggtcctttacgtcgtcggtcctaccgtaaggttccgtacggacctaaccggtaacccggtccccttacccgttacgaaacccgtaaacgttcccttccggttaccgggttaccctacccggtacgggtaccgttaacgggtaacggggtaccggtaacgggtccgttaccggttaaccctttaacggttttacccgtcggttacccgtacggttccctaaccgttaattaccggtcggtttacccgttaacgggttttcccgttttcgtcgggttttaccgggttcccggttacggggtaccgggttaaccggggttaaaccgttaaacgggttccccgggtaaaccggtttcccgaacgggttcccggaacccggtaccccggaacgggttacccccggttacccggtaccccccccggtttacgggttaccccgttaacccggtttcccccggg

SEQ ID NO: 253914 - DNA, 263 bp, Homo sapiens
  misc_feature: GYAE6OF01CDU4Q.13.25.C03.1.454.CMB.1.raw
  modified_base (209)..(209): a, c, t, g, unknown or other
  misc_feature (209)..(209): n is a, c, g, or t
  modified_base (248)..(263): a, c, t, g, unknown or other
  misc_feature (248)..(263): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctagtcagcccaaggctcgccccctggtcactcgtcgtccccgccctcctntagtacgtgactggaggcgggctggacaaggcgcatagnnnnnnnnnnnnnnnn

SEQ ID NO: 253915 - DNA, 286 bp, Homo sapiens
  misc_feature: GYAE6OF01BM2JK.13.25.C03.1.454.CMB.1.raw
  modified_base (254)..(286): a, c, t, g, unknown or other
  misc_feature (254)..(286): n is a, c, g, or t
tcagtcacgtactacacgaccggtgctcgatttagtagtgtagatttgggtttggggggtgtggtggtctccactcccgccttgacgaggctgcctattactgctgcttcatatgcaggttcttctgtggtcttaggcggagggtccaaagtgaccgtcctaggtcagccctaaggctcgcccccctcggtcacttctcgttccccacccgtcctctagtagtgactggagccgggcctggcaaggcgcatagnnnnnnnnnnnnnnnnnnnnnnnnnnnnnnnnn

SEQ ID NO: 253916 - DNA, 247 bp, Homo sapiens
  misc_feature: GYAE6OF01D07N9.13.25.C03.1.454.CMB.1.raw
  modified_base (244)..(247): a, c, t, g, unknown or other
  misc_feature (244)..(247): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctcgccccctggtcactctgttcccgccctcctctagtacgtgactgagcgggctggcaaggcgcatagnnnn

SEQ ID NO: 253917 - DNA, 261 bp, Homo sapiens
  misc_feature: GYAE6OF01BT17J.13.25.C03.1.454.CMB.1.raw
  modified_base (240)..(240): a, c, t, g, unknown or other
  misc_feature (240)..(240): n is a, c, g, or t
  modified_base (246)..(261): a, c, t, g, unknown or other
  misc_feature (246)..(261): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttctgtggtcttcggcggagggtccaaagtgaccgtcctaggtcagcccaaggctcgccccctggtcactctgttcccgccctcctctagtacgtgactgagcgggctggacaaggcncatagnnnnnnnnnnnnnnnn

SEQ ID NO: 253918 - DNA, 706 bp, Homo sapiens
  misc_feature: GYAE6OF01A1IHK.13.25.C03.1.454.CMB.1.raw
  modified_base (215)..(215): a, c, t, g, unknown or other
  misc_feature (215)..(215): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (445)..(445): a, c, t, g, unknown or other
  misc_feature (445)..(445): n is a, c, g, or t
tcagtcacgtactacacgaccggtgctcgatttagtagtgtagatttgggtttgggggtaggcgatcacccagcaaccacatctgtcctctagagaactcccctgagagctccgttcctcaccatggactcggacctggaggactccttcttcttgggtggcagcacgccacgagcacgcccactacccaaggttcgcctccgtacggaaaaccncggtcccggggctaggaggtacgaaagaacggtccgtgggggcctcgaaggtcggaaagggttcctcccggtagaccgaacgggtccgtttccgggaactaacccgtacccgtacgtaaacgtaacgggtaaactacgttcggtacctactagttcgtacgacgacgcccggacgtacggacgtacggtcttcgnggtaggnggtgggctacgtacctaacgtagtaggngtacaacgaactaaacgttagagaacgtaagtaacgttggacgggtcgtacgactagcgtaacgacgggactacgacactacaactacgactacctagacgtacgacctcgaaccgcgtacgcctaacgacgtacgaccgtaacggccggtacttacgttatacgcggttacggacttaacgaactccgtaactacgtaccttagttcggtaacggttcggacgacgggtaccgttcgtaggtacgtacccgtcgttaccg

SEQ ID NO: 253919 - DNA, 799 bp, Homo sapiens
  misc_feature: GYAE6OF01DK903.13.25.C03.1.454.CMB.1.raw
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacgagggtcctcgggcccagtctgccctgactcacgcctcgcctcgtgtcgtggtctccgtggacagtcgatcaccntcctacctgacctacgtaaggaaacngctagtagtacttcgttaggtacttaagtagtacttcgtcctaccgtacggtaacccaaaccaccgaccgacggaccgaaccggcccccagtacgtactacgtcgttaggtttacggacgggactaacggtacgggtccggaccgttacgagggttaccttccgacgtcgtcctttcgcgtacgtcctacgtaacgtcgacggtaccaaccgtccgtccctaccgtagtacctacgttcctacgttccggtaccgtacggacggtacggtacggaacgggtaacgtcggtacgttacggttacctttaacgttaccgtcgttccgttacgaacttccgtaagttaccgtcgttaaccggtttcggttttccttacggtttcgggtttccggtttaccggggtaccgggtttaaccgggggaccgtttaaaccggtaacgggttacccggttacccggttaaccgggtaaccggtccgtaaccccgggtacccgtaacggggtcccccttaccccggggttcccccggttaggttcccccgttcccgggttacccccggg

SEQ ID NO: 253920 - DNA, 591 bp, Homo sapiens
  misc_feature: GYAE6OF01BCNQ9.13.25.C03.1.454.CMB.1.raw
  modified_base (231)..(231): a, c, t, g, unknown or other
  misc_feature (231)..(231): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (284)..(286): a, c, t, g, unknown or other
  misc_feature (284)..(286): n is a, c, g, or t
  modified_base (288)..(288): a, c, t, g, unknown or other
  misc_feature (288)..(288): n is a, c, g, or t
  modified_base (290)..(291): a, c, t, g, unknown or other
  misc_feature (290)..(291): n is a, c, g, or t
  modified_base (293)..(294): a, c, t, g, unknown or other
  misc_feature (293)..(294): n is a, c, g, or t
  modified_base (296)..(297): a, c, t, g, unknown or other
  misc_feature (296)..(297): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
tcagtcacgtactacacgaccggtgctcgatttagtagtgtagatttgggtttgggggtgtggttgggttcgtccacgtcccgccttgacgaggcgtgcctagttactgcttgctcatatgctaggttacttctgtggtcttcggcggaggtccaaagttgacgtcctaggtcgtagcccaaggctcgtaccccttaggtcactctcgttcccaccgtctcgtagtacgtnacgtggagcgggctggaccgtaaggccggcagtagncgntangnagcngtagnnnanannanngnngngcngnacgngnggngtangtgcgatgtagtacagtancgtagactnanacgtacgtacgcgtacgtacgtcgacgacgtacgtactacactcgtacgacgacgacgtacgtagtacgacgtacgtacgtacgtactatatacgtacgacgacgagacgacgacgacgacgtacgtacgtacgtacgttacgtacgtacgtagtagtagttacgtacgtacgtaccggtacggtacggtacggtacgtacgtacgtaccgtaccgtacgtacgtaccgtaccgtaccgtaccg

SEQ ID NO: 253921 - DNA, 248 bp, Homo sapiens; identical to SEQ ID NO: 253843
  misc_feature: GYAE6OF01C4LWL.13.25.C03.1.454.CMB.1.raw
  modified_base (243)..(248): a, c, t, g, unknown or other
  misc_feature (243)..(248): n is a, c, g, or t

SEQ ID NO: 253922 - DNA, 818 bp, Homo sapiens
  misc_feature: GYAE6OF01C7YXT.13.25.C03.1.454.CMB.1.raw
  modified_base (104)..(104): a, c, t, g, unknown or other
  misc_feature (104)..(104): n is a, c, g, or t
  modified_base (165)..(165): a, c, t, g, unknown or other
  misc_feature (165)..(165): n is a, c, g, or t
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (563)..(563): a, c, t, g, unknown or other
  misc_feature (563)..(563): n is a, c, g, or t
tcagtcacgtactacacgaccggtgctcgatttagtagtgtagatttgggtttgggggagcatcacccagcaaccacatctgtacctctagagaatcccctganagctccgttcctcaccatggactggacctggaggatcctcttcttggtaggcagcagccanagcagcccactacccgagtgctcctagaaacngtccgggatgaaggtcgaagaagcctggggcctcagtagaagtctcctagcaaggtcttccggatacacctctaaattcggaaactatcgtccaatanagtncgaccacgaccccaggtaacaacggggtcttcgtaggtgggtaagttgggggtacggtaactacgtaaaaccccgtaaagttacggaggttacggaacaaaccgttaaaaccgtaaagttacggaaagggtaaacgtaaaaacggttttggaaaccgggggtcccgggggtttaaaccaacccggtaaattacgggtaaccgacgggggaaccctaaccgggtccctaaactacgtaaaacgtaaccgacgtacctttaaccgngttaacgggaaccttacggaacccaggtaaccctggaaaccctttaccgagaacccggaaccgaaccggtaccccggttagtttaacggttactacggttacgggaccgggttaaaccctaaaccgttaccgaaaccgttcccgtaaaaaccgtttaccgtttttaagggtaaactttttacccggggggacccgtaaaggggtacccggtaaaccgtttggggtaaaccccttaccgggttccccttaacccgg

SEQ ID NO: 253923 - DNA, 298 bp, Homo sapiens
  misc_feature: GYAE6OF01CHH1K.13.25.C03.1.454.CMB.1.raw
  modified_base (270)..(298): a, c, t, g, unknown or other
  misc_feature (270)..(298): n is a, c, g, or t
tcagtcacgtactacacgaccggtgctcgatttagtagtgtagatttggggtttggggggtgtggtggtctccactcccgccttgacgaggctgcctattactgctgctcatatgctaggtttcttctgtcggtcgttcggcgggtaggtccaaagtgacccgttcctaggtcacgcccaaggctcgccccccgtggtcactcttccgttccccgccctcctactacgtacgtgacgtgacggcgggctgggacgaacggcgactagtgnnnnnnnnnnnnnnnnnnnnnnnnnnnnn

SEQ ID NO: 253924 - DNA, 677 bp, Homo sapiens
  misc_feature: GYAE6OF01ELDBT.13.25.C03.1.454.CMB.1.raw
  modified_base (228)..(228): a, c, t, g, unknown or other
  misc_feature (228)..(228): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcacgtaggaaacngcagtgtattcgttagggacttatagtactttgtcttcgtacggtaccaacaccaccaggacacggccccagacgtcatctatttaggtgggggacaagtacggcggccgtcgagggtactttccacgtcgtcttctcgtgccgtccaagtcgtcggaccaaccgaccggtccctccgtagacaattcctcgtcgtcctacccgaggcgtacggacggacgaggtccgtacgtccttacgttacgtcgtactcggtacttacgtaacgttacttcggacgtttaacggggttttcctttcggtttacggggttcggtttaccggttcccggggacgggttaacggggttacccgtaaaacgggttcggtacccggttaccgttacggtccgtaacggacccgaacggtcccgtaccggtacccccgttcgtacccgtaccgtttccccg

SEQ ID NO: 253925 - DNA, 248 bp, Homo sapiens
  misc_feature: GYAE6OF01C6K7S.13.25.C03.1.454.CMB.1.raw
  modified_base (237)..(237): a, c, t, g, unknown or other
  misc_feature (237)..(237): n is a, c, g, or t
  modified_base (242)..(248): a, c, t, g, unknown or other
  misc_feature (242)..(248): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgcctcctctagtacgtgactgagcgggctggcaaggcgnatagnnnnnnn

SEQ ID NO: 253926 - DNA, 458 bp, Homo sapiens
  misc_feature: GYAE6OF01B6UG0.13.25.C03.1.454.CMB.1.raw
  modified_base (216)..(216): a, c, t, g, unknown or other
  misc_feature (216)..(216): n is a, c, g, or t
  modified_base (237)..(237): a, c, t, g, unknown or other
  misc_feature (237)..(237): n is a, c, g, or t
  modified_base (241)..(246): a, c, t, g, unknown or other
  misc_feature (241)..(246): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (273)..(274): a, c, t, g, unknown or other
  misc_feature (273)..(274): n is a, c, g, or t
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (353)..(354): a, c, t, g, unknown or other
  misc_feature (353)..(354): n is a, c, g, or t
  modified_base (371)..(371): a, c, t, g, unknown or other
  misc_feature (371)..(371): n is a, c, g, or t
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
  modified_base (435)..(436): a, c, t, g, unknown or other
  misc_feature (435)..(436): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
tcagtcacgtactacacgaccggtgctcgatttagtagtgtagatttgggtttgggggtgtggtggtctccactcccgccttgacgaggctgcctattactgctgctcatatgcaggtttcttctgtggtcttcggcggagggtccaaagtgaccgtcctaggtcagcccaaggctgccccctggtcactctcgttcccaccctctctagtacgtnactgagcgggctggcaagcgnatgnnnnnntgactncnactngactnagtcagtnannanctagctctgatgatccntangnacgtnacnctngntncncgtcgancgtctcgtcgngtcgtctgctctagtcgcgnngtacgtgtacacgatanactatacgtacgagtgtcagtatcgatacactcngtcgcactacacgtcngtcgtcgtgacgcnncgntcngtcgtcnancgtgnac

SEQ ID NO: 253927 - DNA, 270 bp, Homo sapiens
  misc_feature: GYAE6OF01A33ZV.13.25.C03.1.454.CMB.1.raw
  modified_base (239)..(270): a, c, t, g, unknown or other
  misc_feature (239)..(270): n is a, c, g, or t
tcagtcacgtactacacgaccggtgctcgatttagtagtgtagatttgggtttgggaggttcgactactgggccagggaaccctggtcaccgtctcctcagcctccaccaagggccccatccggtcttcccccctggcaccctcctccaagagcacctctgggggcacagcggccctgggctgcctggtcaaggctacttcctagtaccgtgactgagcgggctggcaaggcgcatagnnnnnnnnnnnnnnnnnnnnnnnnnnnnnnnn

SEQ ID NO: 253928 - DNA, 694 bp, Homo sapiens
  misc_feature: GYAE6OF01BNM22.13.25.C03.1.454.CMB.1.raw
  modified_base (118)..(118): a, c, t, g, unknown or other
  misc_feature (118)..(118): n is a, c, g, or t
  modified_base (164)..(164): a, c, t, g, unknown or other
  misc_feature (164)..(164): n is a, c, g, or t
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
tcagtcacgtactacacgaccggtgctcgatttagtagtgtagatttggggtttggggggggtcacaagaggcagcgctctcgggacgtctccaccatggcctggctctgctgctccncacttctcctcactcaggacacgacgggtcctcgggaccctgtccncgtcctagactcacgtccgtcgccgtcgtgtcgtcggtcctcgtagactagtcactcactatcctcngctacgtaagaacngcgatcgtagttcgttacggtattagcgttacgttcgtacctacggtaccgtaaccaaccaacccgaccgacggaacccgaacccgacctagtactacgtacgttacgttaggtacggtacggacgtacgggccggtccggtacgtacgtacgttacctacgtcgtccgtacgtcgtacgtcgtacctaacgtcgtacgtacggcctacggtacccgtactaccgactacgtacctgtccgtacgtcgacgcggtacgaggacggcgtcgtccgtcttacgtacgttcgtacgtacgtctaactgttacgttacgtcgttacggtcgttcggttcggtcggttcggtacggtacggtacggtacggtaccgttaccgtaccggtcctacggtacgtccggacgtacccgtccgtccgtaccccggtaccgttcctccgttccgtacccg

SEQ ID NO: 253929 - DNA, 260 bp, Homo sapiens
  misc_feature: GYAE6OF01BO13U.13.25.C03.1.454.CMB.1.raw
  modified_base (250)..(260): a, c, t, g, unknown or other
  misc_feature (250)..(260): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttcgtgtggtcttcggcgggagggtccaaagtgaccgtcctaggtcagcccaaggctcgccccctggtcactctcgttcccaccctcctctagtacgtgactggagcgggctggcaaggcgcagtagnnnnnnnnnnn

SEQ ID NO: 253930 - DNA, 687 bp, Homo sapiens
  misc_feature: GYAE6OF01EFKN2.13.25.C03.1.454.CMB.1.raw
  modified_base (229)..(229): a, c, t, g, unknown or other
  misc_feature (229)..(229): n is a, c, g, or t
  modified_base (409)..(409): a, c, t, g, unknown or other
  misc_feature (409)..(409): n is a, c, g, or t
  modified_base (616)..(616): a, c, t, g, unknown or other
  misc_feature (616)..(616): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcacgcctgcctccgtgtctggtctcctggacagtcatcaccatcctctgcactaggaaacancagtgatcgttagggacttatacgtacttgtactcctacggtaaccaaacaccaccacggacaaccggccccagacgtcatctagtttacggtggggacaagtcggccgcgtagaggtacttccactcgctctcgtcgccgtacgaagtcgtacggaccaaaccgccggtcccttccganactaacttccttcgtcggtcctaccgaggtaccgtaggaacgggaacggtacgggtacctacgggtaccttaacgttacgtcggtactcgttacctacgtaatacgtcgtacgttacggtttctttcgttcggttcggttacggtccggggtacggtacgggttaaacccaagggttaccgtaacccggttacggtaacccggttanaacccgggtacccgaaaccgggttccctaccccggttacccccggttcggttcccgtccgtttacccccgg

SEQ ID NO: 253931 - DNA, 691 bp, Homo sapiens
  misc_feature: GYAE6OF01AV7R6.13.25.C03.1.454.CMB.1.raw
  modified_base (233)..(233): a, c, t, g, unknown or other
  misc_feature (233)..(233): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacgagggtcctgggcccagtctgccctgactcagcctgccctccgtgtcgtgggtctcgtggacagtcgatcaccactctcctgctactaggaacngcagtgatcgttgggtattagtatacgttacgtcctaccgtacgtaccaacccacctaccgacgacaacccggtacccccagacgtacccagtacttaacgtttaggcggggtaacaacggtacgggcccgggtaccgtacggtaacgggttaacctttccgaccgtccgttcgttaccctcgtcgtccctaccgaacgtcgtcggtaccgaacgtccccggtcctcccgtagtaaccacttccgttcgtcggtacctcgacgtcggtcggacggtacgacggtcgtacctaccgtttaactcgttacgtccgtcgtacctacgtaagttcgtacgtacggttacgttccgttacgttcgtcggttacggtcgggacggttacgtacgtaacggtcgtaccgtacgtacggctaccggccgtacgtcccgtacccgcccggtactcctccgttacccg

SEQ ID NO: 253932 - DNA, 269 bp, Homo sapiens
  misc_feature: GYAE6OF01ALOWX.13.25.C03.1.454.CMB.1.raw
  modified_base (236)..(236): a, c, t, g, unknown or other
  misc_feature (236)..(236): n is a, c, g, or t
  modified_base (242)..(269): a, c, t, g, unknown or other
  misc_feature (242)..(269): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttctgtggtcttcggcggagggtccaaagtgaccgtcctaggtcagcccaaggctgccccctggtcactctgttcccaccctctctagtcgtgactgagcgggctggcaaggcncatagnnnnnnnnnnnnnnnnnnnnnnnnnnnn

SEQ ID NO: 253933 - DNA, 350 bp, Homo sapiens
  misc_feature: GYAE6OF01EM9R6.13.25.C03.1.454.CMB.1.raw
  modified_base (144)..(144): a, c, t, g, unknown or other
  misc_feature (144)..(144): n is a, c, g, or t
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
  modified_base (281)..(350): a, c, t, g, unknown or other
  misc_feature (281)..(350): n is a, c, g, or t
tcagtcacgtactacacgaccggtgctcgatttagtagtgtagatttgggtttgggggggtgtggtggtctccactcccgccttgacgaggctgcctattactgctgctcatatgctaggtttcttcgtgtcggttcttcgggnggaggtaccaaagtcgaccgtctaggtcacgcccaaggcctcgccccctggtacacttctcgttcccccacccttcctacgtacgtaccgngtaccgtggcggccgggatcggacgaacggaccagtaatgntcagnnnnnnnnnnnnnnnnnnnnnnnnnnnnnnnnnnnnnnnnnnnnnnnnnnnnnnnnnnnnnnnnnnnnnn

SEQ ID NO: 253934 - DNA, 278 bp, Homo sapiens
  misc_feature: GYAE6OF01ET5HY.13.25.C03.1.454.CMB.1.raw
  modified_base (207)..(207): a, c, t, g, unknown or other
  misc_feature (207)..(207): n is a, c, g, or t
  modified_base (249)..(278): a, c, t, g, unknown or other
  misc_feature (249)..(278): n is a, c, g, or t
tcagtcacgtactacacgaccggtgctcgatttagtagtgtagatttgggtttggggggtgtggtggtctccactcccgccttgacgaggctgcctattactgctgctcatatgcaggtttcttctgtggtcttcggcggagggtccaaagtgaccgtcctaggtcagcccaaggctcgccccctgcactctcgtccccaccctctntagtacgtgactggagcgggtctggacgaaggcgctagtagnnnnnnnnnnnnnnnnnnnnnnnnnnnnnn

SEQ ID NO: 253935 - DNA, 831 bp, Homo sapiens
  misc_feature: GYAE6OF01CLT9M.13.25.C03.1.454.CMB.1.raw
  modified_base (216)..(216): a, c, t, g, unknown or other
  misc_feature (216)..(216): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
tcagtcacgtactacacgaccggtgctcgatttagtagtgtagatttgggtttggggggggtcacgaagaggcagcgctctcgggacgtctccacatggcctggctctgctgctcctcactctcctcactcgaggacacgagggtcctcgggccctagttctgccctagactcgagcctgcctcgtgtcgtggtctccgtggacagtcgatcactntcctccngctacgtgaaccngctagtgngttggtggtgttaatactagtcgtctccgtagtaacctaacaaccgaccgacggaccaaacgtacccccaaaatcgaagtacgtagtttagtacggtagtcgtacgtaaaggtacgccgccctacggtaacgggtcctagacgttctacgttcctacgttcgtccgtaccgtaaggttccgacggtacccgtaaccggtacccggtcccttaacctacgtaacctacgttccgtaccgtacggacccgtaccgacgggtaacggacggtaccgtagggttccttagttttaaccgtttttaacgtcgtttaacgttacgtaacgttaccggtacgggaaacggtaacgggggtaaggttaacggtttaaacggtttacgttttacgttaacggggtttttaaccgggtttacgggttaaaaccggggtttaccgggtaaaacccgggttaccgggttaccccggtaaaccgggttttccgttaacgggtaaacccggtaccggtaaacccccggtaaaaccgggacccccttaaacccggtaccggttaccgtaacccggttaacccggttttcccgttaacccccg

SEQ ID NO: 253936 - DNA, 279 bp, Homo sapiens
  misc_feature: GYAE6OF01BTVOY.13.25.C03.1.454.CMB.1.raw
  modified_base (257)..(279): a, c, t, g, unknown or other
  misc_feature (257)..(279): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcgggaggtccaaagtgaccgtcctaggtcagcccgaaggcctcgccccctcggtcactctcgtccccgcctcctctagtacgtcgacgtggacggcgggctggacgaacggcgactatagnnnnnnnnnnnnnnnnnnnnnnn

SEQ ID NO: 253937 - DNA, 380 bp, Homo sapiens
  misc_feature: GYAE6OF01DU3B7.13.25.C03.1.454.CMB.1.raw
  modified_base (292)..(292): a, c, t, g, unknown or other
  misc_feature (292)..(292): n is a, c, g, or t
  modified_base (296)..(297): a, c, t, g, unknown or other
  misc_feature (296)..(297): n is a, c, g, or t
  modified_base (299)..(299): a, c, t, g, unknown or other
  misc_feature (299)..(299): n is a, c, g, or t
  modified_base (303)..(380): a, c, t, g, unknown or other
  misc_feature (303)..(380): n is a, c, g, or t
tcagtcacgtactacacgaccggtgctcgattttagtagtgtagatttggggtttgggggggtgtggtggtctccactcccgccttgacgaggctgccttattctgactgcctctatatgactgtttcttcgtgttgtcgtcggagggacggtacaaagtcaccgtacgtggtcacgacctacgcctcccgaccccccgtggtacctaccttccttcccgttacccctcccttcctagtaacgttcggtgacgtgggaccgggcgttcggagcgaacggggcaacgtagtgntagnntnactnnnnnnnnnnnnnnnnnnnnnnnnnnnnnnnnnnnnnnnnnnnnnnnnnnnnnnnnnnnnnnnnnnnnnnnnnnnnnn

SEQ ID NO: 253938 - DNA, 802 bp, Homo sapiens
  misc_feature: GYAE6OF01DR1OJ.13.25.C03.1.454.CMB.1.raw
  modified_base (264)..(264): a, c, t, g, unknown or other
  misc_feature (264)..(264): n is a, c, g, or t
tcagtcacgtactacacgaccggtgctcgattttagtagtgtagatttggggtttgggggggggtcacaagaggcagcgctctcgggacgtctccaccatggcctgggctctgctgctcctcacctctcctcactcaggacacgagggtcctcgggcccagtctcgccctgactcacgcctcgcccgtcgtgttcgtcgggttcctccgtggaactacggtcgactccaaccctcttcctcctcgaccaacggttaggaaaacncgactaggtctagttccggttaggtaacttagtactacgttctaccgttcctaccggtaaacccaaaccacccaaccgacggaccgaacccggtccccaaggtacacgtacgttattaggttacggtaggggacgtaaggtacggccggtaccgtcgagggtttacctccgtacgtacttcttacgtcgtggtaccctacgtactcgtacggaccgaacgccgtacccgtacctacgaactacgttactcgttcggtcctacgagtcgaggacggacgtaacgtcgtacgtaccgttacttacgtacggttccacggttcaaccttacgtacggttacgtaccgttttagtttccgtttacggtttccgggtttaccggttgggttaccgggtaaccgggttaaaccgggtaacggtaaacccggttaccggttaacccgggtttacctacggggtaaccaaccgggtaaaccccggtcggtaacccccggttcccgttaccccccgggttacggttaccgtaccccgtttaccccgg

SEQ ID NO: 253939 - DNA, 975 bp, Homo sapiens
  misc_feature: GYAE6OF01CQEMH.13.25.C03.1.454.CMB.1.raw
tcagtcacgtactacacgaccggtgctcgatttagtagtgtagatttggggtttggggggggtcacaagaggcagcgctctcgggacgtctccaccatggcctgggctctgctgctcctcacctcctcctcactcaggaccacgagggtcctcgggccagtctcgccctgactcacgcctcgcctccgtgtcgtcgggtcctccgtacggactagtcgactaccaaccacttccgtccctggacctaacgtacgggaaaacctggtaccgtaggttaccgtaacggtttcccgtttaggggaacttttacggtaacgttaccgttttccgttaccgttacccgggtaacctaaaccccgaacccgtaaccccaaccggaacggacccggtaaaaccccgggccccctaaggtacgtaccgtaacgttacttaacggtttagggggaccggaacgtttaaaggggccggtacccggggtcccgttaagggtaaacggtttacccttacccgaccgtttccggttccgtttcgttacggtacccgttaacccgtacccgttaaagggttcccgtaacgggaacccaaacccgggttccccgtccctaccggtaacacgtaccttcctaccggtacgtcctaccggacggtacgtaccgggacggaacgggtaactccggttaaccgtaaccttactttaccggtccgtaccgttaccggtaccctaacgttacttaccgggtacgttacgttaccgggtttcccgtttacggttcggtttacggggttccccgggttaccggggtaaaccgggtacccggtttaaacccgggtacgggttaacccggggttaaccccgttacggttaaaccccggggtaccgtaacccccgggtaacccgggttaaccggtccccccggtttaaaccccgggtcccccgtttaaccccgggttcctaacccccgggttttacccccg

SEQ ID NO: 253940 - DNA, 277 bp, Homo sapiens
  misc_feature: GYAE6OF01EHPKX.13.25.C03.1.454.CMB.1.raw
  modified_base (246)..(277): a, c, t, g, unknown or other
  misc_feature (246)..(277): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtaccaaagtgaccgtcctaggtcagcccaggctcgcccctcgtcactctcgtcccgccctcctctagtcgtgactgacggcggctggacgaaggcgcagtagnnnnnnnnnnnnnnnnnnnnnnnnnnnnnnnn

SEQ ID NO: 253941 - DNA, 281 bp, Homo sapiens
  misc_feature: GYAE6OF01B4JC1.13.25.C03.1.454.CMB.1.raw
  modified_base (254)..(255): a, c, t, g, unknown or other
  misc_feature (254)..(255): n is a, c, g, or t
  modified_base (257)..(281): a, c, t, g, unknown or other
  misc_feature (257)..(281): n is a, c, g, or t
tcagtcacgtactacacgaccggtgctcgatttagtagtgtagatttgggtttggggggtgtggtggtctccactcccgccttgacgaggctgcctattactgctgctcatatgctaggttcttctgtggtcttcggcggagggtccaaagtgaccgtcctaggtcagcccaaggctgccccctggtcactctcgttccccaccctcctatagtacgtgactgacggccgggtctggccgaaggccgcaagtgnntnnnnnnnnnnnnnnnnnnnnnnnnn

SEQ ID NO: 253942 - DNA, 288 bp, Homo sapiens
  misc_feature: GYAE6OF01AV0PL.13.25.C03.1.454.CMB.1.raw
  modified_base (110)..(110): a, c, t, g, unknown or other
  misc_feature (110)..(110): n is a, c, g, or t
  modified_base (140)..(140): a, c, t, g, unknown or other
  misc_feature (140)..(140): n is a, c, g, or t
  modified_base (213)..(213): a, c, t, g, unknown or other
  misc_feature (213)..(213): n is a, c, g, or t
  modified_base (256)..(288): a, c, t, g, unknown or other
  misc_feature (256)..(288): n is a, c, g, or t
tcagtcacgtactacacgaccggtgctcgatttagtagtgtagatttggggtttgggggggtgtggtggtctccactcccgcttgacgaggctgcctattactgctgctnatatgctaggttcttctgtggtcttcgggnggaggtccaaagtcgaccgtcctaggtcaagcccaaggctcgcccccgtggtcactctcgttcccaccctctntacgtagtgactggacggcgggctgggaccaaggcgacaatgnnnnnnnnnnnnnnnnnnnnnnnnnnnnnnnnn

SEQ ID NO: 253943 - DNA, 766 bp, Homo sapiens
  misc_feature: GYAE6OF01AZGFU.13.25.C03.1.454.CMB.1.raw
  modified_base (584)..(584): a, c, t, g, unknown or other
  misc_feature (584)..(584): n is a, c, g, or t
  modified_base (744)..(744): a, c, t, g, unknown or other
  misc_feature (744)..(744): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacaccgagggtcctcgggcccagtctacggccctgactcgacgcctcgcctccgtgtcgtcgggtcctaccgtggactacggttcacgttaccaacctacttcctaccgtcgacctaacgtaacggaaaccagtcgtaaggtagtaactccgggttagggtaactttattaggtaccgtttgtaccgttaccggttacgtaacccaaccgtaacccgaaccgaacggaccgaaacccggacccccgaaggtacgtactacttacgttaaggtttagggcggggtaactaacgggtaccgggtcggtaaccggtacggaacgggtttacttcccgtacgttcctaacgttttccgtcgtaccgggtcctaccggtaacggttcgtaccggaaaccgtaccgtacccggtcccctacggactaaactcgttacgtcgtccgtaccgtacgngtaccgaggacggacgtacggtcctacgtaacttcgtactggctcgtacacgttgtaaggccttcgttagggttcctttagggttccgtgggttaccggcgggtaaggaccgttacgaggtaccggtaccgtagtaccggctaacgggctaccggtcccnccctacgggtctctcgtccccg

SEQ ID NO: 253944 - DNA, 246 bp, Homo sapiens
  misc_feature: GYAE6OF02IXZMY.13.25.C03.1.454.CMB.1.raw
  modified_base (239)..(246): a, c, t, g, unknown or other
  misc_feature (239)..(246): n is a, c, g, or t
tcagtcacgtactacacgaccggtgctcgatttagtagtgtagatttgggtttgggtgtggtggtctccactcccgccttgacgaggctgcctattactgctgctcatatgcaggttcttctgtggtcttcggcggaggtccaaagtgaccgtcctaggtcagcccaaggctgcccctcggtcactctgttcccgccctcctctagtacgtgactgagcgggctggcaaggcgcatagnnnnnnnn

SEQ ID NO: 253945 - DNA, 257 bp, Homo sapiens
  misc_feature: GYAE6OF02G0O4M.13.25.C03.1.454.CMB.1.raw
  modified_base (243)..(257): a, c, t, g, unknown or other
  misc_feature (243)..(257): n is a, c, g, or t
tcagtcacgtactacacgaccggtgctcgatttagtagtgtagatttgggtttggggtgtgggtggtctccacgtcccgccttgacgaggctgcctattactgctgctcatatgcaggttcttctgtggtcttcggcggagggtccaaagtgaccgtcctaggtcagcccaaggctgcccctcggtcactctgttcccgccctcctctagtacgtgactgagcgggctggcaaggcgcatagnnnnnnnnnnnnnnn

SEQ ID NO: 253946 - DNA, 242 bp, Homo sapiens
  misc_feature: GYAE6OF02JA2MW.13.25.C03.1.454.CMB.1.raw
  modified_base (241)..(242): a, c, t, g, unknown or other
  misc_feature (241)..(242): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttcccgccctcctctagtacgtgactgagcgggctggcaaggcgcatagnn

SEQ ID NO: 253947 - DNA, 240 bp, Homo sapiens
  misc_feature: GYAE6OF02GAIG4.13.25.C03.1.454.CMB.1.raw
tcagtcacgtactacacgaccggtgctcgattagtagtgtagatttgggtttgggtggtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatag

SEQ ID NO: 253948 - DNA, 246 bp, Homo sapiens
  misc_feature: GYAE6OF02I3E0M.13.25.C03.1.454.CMB.1.raw
  modified_base (240)..(246): a, c, t, g, unknown or other
  misc_feature (240)..(246): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttcccacctcctctagtacgtgactgagcgggctggcaaggcgcatagnnnnnnn

SEQ ID NO: 253949 - DNA, 240 bp, Homo sapiens
  misc_feature: GYAE6OF02HIH9X.13.25.C03.1.454.CMB.1.raw
  modified_base (238)..(240): a, c, t, g, unknown or other
  misc_feature (238)..(240): n is a, c, g, or t
tcagtcacgtactacacgaccggtgctcgatttagtagtgtagattggttggggtggtggtggtctccactcccgccttgacgaggctgcctattactgctgctcatatgcaggttcttctgtggtcttcggcggagggtccaaagtgaccgtcctaggtcagcccaaggctgcccctcggtcactctgttcccacctcctctagtacgtgactgagcgggctggcaaggcgcatagnnn

SEQ ID NO: 253950 - DNA, 243 bp, Homo sapiens; identical to SEQ ID NO: 253660
  misc_feature: GYAE6OF02IPEE1.13.25.C03.1.454.CMB.1.raw
  modified_base (243)..(243): a, c, t, g, unknown or other
  misc_feature (243)..(243): n is a, c, g, or t

SEQ ID NO: 253951 - DNA, 245 bp, Homo sapiens; identical to SEQ ID NO: 253686
  misc_feature: GYAE6OF02I1RDR.13.25.C03.1.454.CMB.1.raw
  modified_base (243)..(245): a, c, t, g, unknown or other
  misc_feature (243)..(245): n is a, c, g, or t

SEQ ID NO: 253952 - DNA, 243 bp, Homo sapiens; identical to SEQ ID NO: 253633
  misc_feature: GYAE6OF02FVNQX.13.25.C03.1.454.CMB.1.raw
  modified_base (242)..(243): a, c, t, g, unknown or other
  misc_feature (242)..(243): n is a, c, g, or t

SEQ ID NO: 253953 - DNA, 269 bp, Homo sapiens
  misc_feature: GYAE6OF02GFLBA.13.25.C03.1.454.CMB.1.raw
  modified_base (247)..(269): a, c, t, g, unknown or other
  misc_feature (247)..(269): n is a, c, g, or t
tcagtcacgtactacacgaccggtgctcgatttagtagtgtagatttgggtttgggggtgtgggtggtctccactcccgccttgacgaggctgcctattactgctgctcatatgcaggttctttctgtggtcttcggcggagggtccaaagtgaccgtccgtaggtcagcccaaggctgccccctcggtcactctgttcccgccctcctctaagtacgtgactgagcgggctggcaaggcgcatagnnnnnnnnnnnnnnnnnnnnnnn

SEQ ID NO: 253954 - DNA, 240 bp, Homo sapiens
  misc_feature: GYAE6OF02GPE34.13.25.C03.1.454.CMB.1.raw
  modified_base (239)..(240): a, c, t, g, unknown or other
  misc_feature (239)..(240): n is a, c, g, or t
tcagtcacgtactacacgaccggtgctcgatttagtagtgtagatttgggtttgggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttcccacctcctctagtacgtgactgagcgggctggcaaggcgcatagnn

SEQ ID NO: 253955 - DNA, 250 bp, Homo sapiens
  misc_feature: GYAE6OF02HD9HL.13.25.C03.1.454.CMB.1.raw
  modified_base (243)..(250): a, c, t, g, unknown or other
  misc_feature (243)..(250): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnnnnnn

SEQ ID NO: 253956 - DNA, 243 bp, Homo sapiens
  misc_feature: GYAE6OF02INLQE.13.25.C03.1.454.CMB.1.raw
  modified_base (241)..(243): a, c, t, g, unknown or other
  misc_feature (241)..(243): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtactgagcgggctggcaaggcgcatagnnn

SEQ ID NO: 253957 - DNA, 243 bp, Homo sapiens; identical to SEQ ID NO: 253660
  misc_feature: GYAE6OF02GK97B.13.25.C03.1.454.CMB.1.raw
  modified_base (243)..(243): a, c, t, g, unknown or other
  misc_feature (243)..(243): n is a, c, g, or t

SEQ ID NO: 253958 - DNA, 244 bp, Homo sapiens; identical to SEQ ID NO: 253637
  misc_feature: GYAE6OF02F7E55.13.25.C03.1.454.CMB.1.raw
  modified_base (242)..(244): a, c, t, g, unknown or other
  misc_feature (242)..(244): n is a, c, g, or t

SEQ ID NO: 253959 - DNA, 244 bp, Homo sapiens; identical to SEQ ID NO: 253645
  misc_feature: GYAE6OF02GP1GR.13.25.C03.1.454.CMB.1.raw
  modified_base (243)..(244): a, c, t, g, unknown or other
  misc_feature (243)..(244): n is a, c, g, or t

SEQ ID NO: 253960 - DNA, 244 bp, Homo sapiens; identical to SEQ ID NO: 253645
  misc_feature: GYAE6OF02GQG4T.13.25.C03.1.454.CMB.1.raw
  modified_base (243)..(244): a, c, t, g, unknown or other
  misc_feature (243)..(244): n is a, c, g, or t

SEQ ID NO: 253961 - DNA, 245 bp, Homo sapiens; identical to SEQ ID NO: 253686
  misc_feature: GYAE6OF02G2JAZ.13.25.C03.1.454.CMB.1.raw
  modified_base (243)..(245): a, c, t, g, unknown or other
  misc_feature (243)..(245): n is a, c, g, or t

SEQ ID NO: 253962 - DNA, 275 bp, Homo sapiens
  misc_feature: GYAE6OF02G8VKE.13.25.C03.1.454.CMB.1.raw
  modified_base (245)..(275): a, c, t, g, unknown or other
  misc_feature (245)..(275): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctggtggtcttcggcggagggtccaaagtgaccgtcctaggtcagcccaaggctgccccctcggtcactctgttcccgccctcctctagtacgtgactgagcgggctggtcaaggcgcatagnnnnnnnnnnnnnnnnnnnnnnnnnnnnnnn

SEQ ID NO: 253963 - DNA, 245 bp, Homo sapiens; identical to SEQ ID NO: 253686
  misc_feature: GYAE6OF02GNPIO.13.25.C03.1.454.CMB.1.raw
  modified_base (243)..(245): a, c, t, g, unknown or other
  misc_feature (243)..(245): n is a, c, g, or t

SEQ ID NO: 253964 - DNA, 247 bp, Homo sapiens
  misc_feature: GYAE6OF02GECS3.13.25.C03.1.454.CMB.1.raw
  modified_base (241)..(247): a, c, t, g, unknown or other
  misc_feature (241)..(247): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctctctagtacgtgactgagcgggctggcaaggcgcatagnnnnnnn

SEQ ID NO: 253965 - DNA, 244 bp, Homo sapiens
  misc_feature: GYAE6OF02GF7DC.13.25.C03.1.454.CMB.1.raw
  modified_base (242)..(244): a, c, t, g, unknown or other
  misc_feature (242)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccacctcctctagtacgtgactgagcgggctggcaaggcgcatagnnn

SEQ ID NO: 253966 - DNA, 243 bp, Homo sapiens; identical to SEQ ID NO: 253633
  misc_feature: GYAE6OF02I99EB.13.25.C03.1.454.CMB.1.raw
  modified_base (242)..(243): a, c, t, g, unknown or other
  misc_feature (242)..(243): n is a, c, g, or t

SEQ ID NO: 253967 - DNA, 243 bp, Homo sapiens; identical to SEQ ID NO: 253660
  misc_feature: GYAE6OF02IEECX.13.25.C03.1.454.CMB.1.raw
  modified_base (243)..(243): a, c, t, g, unknown or other
  misc_feature (243)..(243): n is a, c, g, or t

SEQ ID NO: 253968 - DNA, 244 bp, Homo sapiens; identical to SEQ ID NO: 253642
  misc_feature: GYAE6OF02H0MX8.13.25.C03.1.454.CMB.1.raw
  modified_base (243)..(244): a, c, t, g, unknown or other
  misc_feature (243)..(244): n is a, c, g, or t

SEQ ID NO: 253969 - DNA, 242 bp, Homo sapiens
  misc_feature: GYAE6OF02GCERZ.13.25.C03.1.454.CMB.1.raw
  modified_base (242)..(242): a, c, t, g, unknown or other
  misc_feature (242)..(242): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagn

SEQ ID NO: 253970 - DNA, 245 bp, Homo sapiens; identical to SEQ ID NO: 253686
  misc_feature: GYAE6OF02I8VP6.13.25.C03.1.454.CMB.1.raw
  modified_base (243)..(245): a, c, t, g, unknown or other
  misc_feature (243)..(245): n is a, c, g, or t

SEQ ID NO: 253971 - DNA, 243 bp, Homo sapiens; identical to SEQ ID NO: 253652
  misc_feature: GYAE6OF02FJUGE.13.25.C03.1.454.CMB.1.raw
  modified_base (243)..(243): a, c, t, g, unknown or other
  misc_feature (243)..(243): n is a, c, g, or t

SEQ ID NO: 253972 - DNA, 245 bp, Homo sapiens; identical to SEQ ID NO: 253686
  misc_feature: GYAE6OF02HZBVI.13.25.C03.1.454.CMB.1.raw
  modified_base (243)..(245): a, c, t, g, unknown or other
  misc_feature (243)..(245): n is a, c, g, or t

SEQ ID NO: 253973 - DNA, 243 bp, Homo sapiens; identical to SEQ ID NO: 253660
  misc_feature: GYAE6OF02I0SBG.13.25.C03.1.454.CMB.1.raw
  modified_base (243)..(243): a, c, t, g, unknown or other
  misc_feature (243)..(243): n is a, c, g, or t

SEQ ID NO: 253974 - DNA, 289 bp, Homo sapiens
  misc_feature: GYAE6OF02G5KNK.13.25.C03.1.454.CMB.1.raw
  modified_base (246)..(289): a, c, t, g, unknown or other
  misc_feature (246)..(289): n is a, c, g, or t
tcagtcacgtactacacgaccggtgctcgatttagtagtgtagatttgggttggggggtgtggtggtctccactcccgccttgacgaggctgcctattactgcgtcgctcatatgcgaggttcttctgtggtcttcggcggagggtccaaaggtgaccgtcctaggtcagcccaaggctgccccctcggtcactctgttcccgcctcctctagtacgtgactgagcgggctggcaaggcgcatagnnnnnnnnnnnnnnnnnnnnnnnnnnnnnnnnnnnnnnnnnnnn

SEQ ID NO: 253975 - DNA, 248 bp, Homo sapiens
  misc_feature: GYAE6OF02GR8MP.13.25.C03.1.454.CMB.1.raw
  modified_base (244)..(248): a, c, t, g, unknown or other
  misc_feature (244)..(248): n is a, c, g, or t
tcagtcacgtactacacgaccggtgctcgatttagtagtgtagatttgggtttgggggtgtggtggcctccactacccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnnn

SEQ ID NO: 253976 - DNA, 244 bp, Homo sapiens
  misc_feature: GYAE6OF02I7BX3.13.25.C03.1.454.CMB.1.raw
  modified_base (240)..(244): a, c, t, g, unknown or other
  misc_feature (240)..(244): n is a, c, g, or t
tcagtcacgtactacacgaccggtgctcgattagtagtgtagattgggtttggggtggtggtggtcgtccactcccgccttcgacgaggctgcctattactgctgctcatatgcaggttcttctgtggtcttcggcggaggtccaaagtgaccgtcctaggtcagcccaaggctgcccctcggtcactctgttcccacctcctctagtacgtgactgagcgggctggcaaggcgcatagnnnnn

SEQ ID NO: 253977 - DNA, 244 bp, Homo sapiens; identical to SEQ ID NO: 253645
  misc_feature: GYAE6OF02IEAVL.13.25.C03.1.454.CMB.1.raw
  modified_base (243)..(244): a, c, t, g, unknown or other
  misc_feature (243)..(244): n is a, c, g, or t

SEQ ID NO: 253978 - DNA, 243 bp, Homo sapiens; identical to SEQ ID NO: 253660
  misc_feature: GYAE6OF02H9KWG.13.25.C03.1.454.CMB.1.raw
  modified_base (243)..(243): a, c, t, g, unknown or other
  misc_feature (243)..(243): n is a, c, g, or t

SEQ ID NO: 253979 - DNA, 236 bp, Homo sapiens
  misc_feature: GYAE6OF02FG6IM.13.25.C03.1.454.CMB.1.raw
tcagtcacgtactacacgaccggtgctcgattagtagtgtagatttgggtttgggttgtggtggtctccactcccgccttgacgagctgcctattactgctgctcatatgcaggttcttctgtggtcttcggcgaggtccaaagtgaccgtcctaggtcagcccaaggctgccccctggtcactctgttcccaccctcctctagtacgtgactgagcgggctggcaaggcgcatag

SEQ ID NO: 253980 - DNA, 245 bp, Homo sapiens; identical to SEQ ID NO: 253760
  misc_feature: GYAE6OF02FNGRM.13.25.C03.1.454.CMB.1.raw
  modified_base (242)..(245): a, c, t, g, unknown or other
  misc_feature (242)..(245): n is a, c, g, or t

SEQ ID NO: 253981 - DNA, 243 bp, Homo sapiens; identical to SEQ ID NO: 253633
  misc_feature: GYAE6OF02FPNAA.13.25.C03.1.454.CMB.1.raw
  modified_base (242)..(243): a, c, t, g, unknown or other
  misc_feature (242)..(243): n is a, c, g, or t

SEQ ID NO: 253982 - DNA, 245 bp, Homo sapiens
  misc_feature: GYAE6OF02GVDWR.13.25.C03.1.454.CMB.1.raw
  modified_base (244)..(245): a, c, t, g, unknown or other
  misc_feature (244)..(245): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgggaccgtcctaggtcagcccaaggctgccccctcggtcactctgttcccaccctctctagtacgtgactgagcgggctggcaaggcgcatagnn

SEQ ID NO: 253983 - DNA, 244 bp, Homo sapiens; identical to SEQ ID NO: 253642
  misc_feature: GYAE6OF02G917K.13.25.C03.1.454.CMB.1.raw
  modified_base (243)..(244): a, c, t, g, unknown or other
  misc_feature (243)..(244): n is a, c, g, or t

SEQ ID NO: 253984 - DNA, 243 bp, Homo sapiens; identical to SEQ ID NO: 253652
  misc_feature: GYAE6OF02I7A1R.13.25.C03.1.454.CMB.1.raw
  modified_base (243)..(243): a, c, t, g, unknown or other
  misc_feature (243)..(243): n is a, c, g, or t

SEQ ID NO: 253985 - DNA, 243 bp, Homo sapiens; identical to SEQ ID NO: 253652
  misc_feature: GYAE6OF02INMAL.13.25.C03.1.454.CMB.1.raw
  modified_base (243)..(243): a, c, t, g, unknown or other
  misc_feature (243)..(243): n is a, c, g, or t

SEQ ID NO: 253986 - DNA, 249 bp, Homo sapiens
  misc_feature: GYAE6OF02HR52S.13.25.C03.1.454.CMB.1.raw
  modified_base (241)..(249): a, c, t, g, unknown or other
  misc_feature (241)..(249): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgcctcctctagtacgtgactgagcgggctggcaaggcgcatagnnnnnnnnn

SEQ ID NO: 253987 - DNA, 244 bp, Homo sapiens; identical to SEQ ID NO: 253645
  misc_feature: GYAE6OF02GE1L5.13.25.C03.1.454.CMB.1.raw
  modified_base (243)..(244): a, c, t, g, unknown or other
  misc_feature (243)..(244): n is a, c, g, or t

SEQ ID NO: 253988 - DNA, 248 bp, Homo sapiens
  misc_feature: GYAE6OF02F5OYX.13.25.C03.1.454.CMB.1.raw
  modified_base (243)..(248): a, c, t, g, unknown or other
  misc_feature (243)..(248): n is a, c, g, or t
tcagtcacgtactacacgaccggtgctcgatttagtagtgtagattggtttgggggtggtggtggtcgtccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnnnnn

SEQ ID NO: 253989 - DNA, 243 bp, Homo sapiens; identical to SEQ ID NO: 253660
  misc_feature: GYAE6OF02FKPYH.13.25.C03.1.454.CMB.1.raw
  modified_base (243)..(243): a, c, t, g, unknown or other
  misc_feature (243)..(243): n is a, c, g, or t

SEQ ID NO: 253990 - DNA, 244 bp, Homo sapiens
  misc_feature: GYAE6OF02IA289.13.25.C03.1.454.CMB.1.raw
  modified_base (243)..(244): a, c, t, g, unknown or other
  misc_feature (243)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgcggtcttcggcggagggtccaaagtgaccgtcctaggtcagcccaaggctgccccctcggtcactctgttcccgccctcctctagtacgtgactgagcgggctggcaaggcgcatagnn

SEQ ID NO: 253991 - DNA, 244 bp, Homo sapiens; identical to SEQ ID NO: 253677
  misc_feature: GYAE6OF02GTO0Q.13.25.C03.1.454.CMB.1.raw
  modified_base (242)..(244): a, c, t, g, unknown or other
  misc_feature (242)..(244): n is a, c, g, or t

SEQ ID NO: 253992 - DNA, 244 bp, Homo sapiens; identical to SEQ ID NO: 253645
  misc_feature: GYAE6OF02GIGK4.13.25.C03.1.454.CMB.1.raw
  modified_base (243)..(244): a, c, t, g, unknown or other
  misc_feature (243)..(244): n is a, c, g, or t

SEQ ID NO: 253993 - DNA, 244 bp, Homo sapiens; identical to SEQ ID NO: 253677
  misc_feature: GYAE6OF02HQMIX.13.25.C03.1.454.CMB.1.raw
  modified_base (242)..(244): a, c, t, g, unknown or other
  misc_feature (242)..(244): n is a, c, g, or t

SEQ ID NO: 253994 - DNA, 246 bp, Homo sapiens
  misc_feature: GYAE6OF02F6RB4.13.25.C03.1.454.CMB.1.raw
  modified_base (241)..(246): a, c, t, g, unknown or other
  misc_feature (241)..(246): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgtcccaccctcctctagtacgtgactgagcgggctggcaaggcgcatagnnnnnn

SEQ ID NO: 253995 - DNA, 243 bp, Homo sapiens; identical to SEQ ID NO: 253660
  misc_feature: GYAE6OF02HOFKW.13.25.C03.1.454.CMB.1.raw
  modified_base (243)..(243): a, c, t, g, unknown or other
  misc_feature (243)..(243): n is a, c, g, or t

SEQ ID NO: 253996 - DNA, 240 bp, Homo sapiens
  misc_feature: GYAE6OF02I6TQH.13.25.C03.1.454.CMB.1.raw
  modified_base (236)..(240): a, c, t, g, unknown or other
  misc_feature (236)..(240): n is a, c, g, or t
tcagtcacgtactacacgaccggtgctcgatttagtagtgtagattggttggggtgtggtggtctccactccgccttgacgaggctgcctattactgctgctcatatgcaggttcttctgtggtcttcggcggagggtccaaagtgaccgtcctaggtcagcccaaggctgcccctcggtcactctgttcccacctcctctagtacgtgactgagcgggctggcaaggcgcatagnnnnn

SEQ ID NO: 253997 - DNA, 245 bp, Homo sapiens; identical to SEQ ID NO: 253648
  misc_feature: GYAE6OF02IO8AV.13.25.C03.1.454.CMB.1.raw
  modified_base (243)..(245): a, c, t, g, unknown or other
  misc_feature (243)..(245): n is a, c, g, or t

SEQ ID NO: 253998 - DNA, 247 bp, Homo sapiens; identical to SEQ ID NO: 253813
  misc_feature: GYAE6OF02IIWBK.13.25.C03.1.454.CMB.1.raw
  modified_base (243)..(247): a, c, t, g, unknown or other
  misc_feature (243)..(247): n is a, c, g, or t

SEQ ID NO: 253999 - DNA, 246 bp, Homo sapiens; identical to SEQ ID NO: 253694
  misc_feature: GYAE6OF02GEF4G.13.25.C03.1.454.CMB.1.raw
  modified_base (243)..(246): a, c, t, g, unknown or other
  misc_feature (243)..(246): n is a, c, g, or t

SEQ ID NO: 254000 - DNA, 245 bp, Homo sapiens
  misc_feature: GYAE6OF02HIFG2.13.25.C03.1.454.CMB.1.raw
  modified_base (241)..(245): a, c, t, g, unknown or other
  misc_feature (241)..(245): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgcctcctctagtacgtgactgagcgggctggcaaggcgcatagnnnnn

SEQ ID NO: 254001 - DNA, 245 bp, Homo sapiens; identical to SEQ ID NO: 253701
  misc_feature: GYAE6OF02JV98H.13.25.C03.1.454.CMB.1.raw
  modified_base (242)..(245): a, c, t, g, unknown or other
  misc_feature (242)..(245): n is a, c, g, or t

SEQ ID NO: 254002 - DNA, 243 bp, Homo sapiens; identical to SEQ ID NO: 253652
  misc_feature: GYAE6OF02HHB7B.13.25.C03.1.454.CMB.1.raw
  modified_base (243)..(243): a, c, t, g, unknown or other
  misc_feature (243)..(243): n is a, c, g, or t

SEQ ID NO: 254003 - DNA, 224 bp, Homo sapiens
  misc_feature: GYAE6OF02IYCV9.13.25.C03.1.454.CMB.1.raw
  modified_base (170)..(224): a, c, t, g, unknown or other
  misc_feature (170)..(224): n is a, c, g, or t
tcagtcacgtactacacgaccggtgctcgatttagtagtgtagatttgggtttgggggaagaggaagactgacggtcccccaggagttcaggtgcctgggcacagcggccctgggctgcctggtcaaggctacttccagtacgtgactgagcggctggcaaggcgcatgnnnnnnnnnnnnnnnnnnnnnnnnnnnnnnnnnnnnnnnnnnnnnnnnnnnnnnn

SEQ ID NO: 254004 - DNA, 515 bp, Homo sapiens
  misc_feature: GYAE6OF02G06Y4.13.25.C03.1.454.CMB.1.raw
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggccccccagagtcatcatttatgggggcaataggcggccgtcagggatttccactcgcttctctggctccaagtctggcaacacggcctccctgacaatctctggtctccaggctgaggacgaggctgccttattactgctgctcatatgctaggttcttctgtggtcttcggcggaggtccaagtcgaccgtcctaggtcacgccaaggctcgccccctcggtccactccg

SEQ ID NO: 254005 - DNA, 246 bp, Homo sapiens; identical to SEQ ID NO: 253694
  misc_feature: GYAE6OF02F1W17.13.25.C03.1.454.CMB.1.raw
  modified_base (243)..(246): a, c, t, g, unknown or other
  misc_feature (243)..(246): n is a, c, g, or t

SEQ ID NO: 254006 - DNA, 248 bp, Homo sapiens
  misc_feature: GYAE6OF02I5JSF.13.25.C03.1.454.CMB.1.raw
  modified_base (243)..(248): a, c, t, g, unknown or other
  misc_feature (243)..(248): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnnnn

SEQ ID NO: 254007 - DNA, 251 bp, Homo sapiens
  misc_feature: GYAE6OF02F8RS4.13.25.C03.1.454.CMB.1.raw
  modified_base (243)..(251): a, c, t, g, unknown or other
  misc_feature (243)..(251): n is a, c, g, or t
tcagtcacgtactacacgaccggtgctcgatttagtagtgtagatttgggtttgggggtgtgggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnnnnnnnn

SEQ ID NO: 254008 - DNA, 243 bp, Homo sapiens; identical to SEQ ID NO: 253660
  misc_feature: GYAE6OF02GHEXS.13.25.C03.1.454.CMB.1.raw
  modified_base (243)..(243): a, c, t, g, unknown or other
  misc_feature (243)..(243): n is a, c, g, or t

SEQ ID NO: 254009 - DNA, 244 bp, Homo sapiens; identical to SEQ ID NO: 253645
  misc_feature: GYAE6OF02JH0G4.13.25.C03.1.454.CMB.1.raw
  modified_base (243)..(244): a, c, t, g, unknown or other
  misc_feature (243)..(244): n is a, c, g, or t

SEQ ID NO: 254010 - DNA, 243 bp, Homo sapiens; identical to SEQ ID NO: 253652
  misc_feature: GYAE6OF02GEYWP.13.25.C03.1.454.CMB.1.raw
  modified_base (243)..(243): a, c, t, g, unknown or other
  misc_feature (243)..(243): n is a, c, g, or t

SEQ ID NO: 254011 - DNA, 245 bp, Homo sapiens; identical to SEQ ID NO: 253686
  misc_feature: GYAE6OF02I1SU1.13.25.C03.1.454.CMB.1.raw
  modified_base (243)..(245): a, c, t, g, unknown or other
  misc_feature (243)..(245): n is a, c, g, or t

SEQ ID NO: 254012 - DNA, 245 bp, Homo sapiens; identical to SEQ ID NO: 253686
  misc_feature: GYAE6OF02IYC87.13.25.C03.1.454.CMB.1.raw
  modified_base (243)..(245): a, c, t, g, unknown or other
  misc_feature (243)..(245): n is a, c, g, or t

SEQ ID NO: 254013 - DNA, 245 bp, Homo sapiens
  misc_feature: GYAE6OF02HMHSX.13.25.C03.1.454.CMB.1.raw
  modified_base (243)..(245): a, c, t, g, unknown or other
  misc_feature (243)..(245): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcgttcactctgttcccgccctcctctagtacgtgactgagcgggctggcaaggcgcatagnnn

SEQ ID NO: 254014 - DNA, 244 bp, Homo sapiens; identical to SEQ ID NO: 253677
  misc_feature: GYAE6OF02GP4SU.13.25.C03.1.454.CMB.1.raw
  modified_base (242)..(244): a, c, t, g, unknown or other
  misc_feature (242)..(244): n is a, c, g, or t

SEQ ID NO: 254015 - DNA, 271 bp, Homo sapiens
  misc_feature: GYAE6OF02FH06J.13.25.C03.1.454.CMB.1.raw
  modified_base (248)..(271): a, c, t, g, unknown or other
  misc_feature (248)..(271): n is a, c, g, or t
tcagtcacgtactacacgaccggtgctcgatttagtagtgtagatttgggtttgggggtgtggtggtctccactcccgccttgacgaggctgtcctattactgctgcttcatatgcaggttcttctgtggtcttcggcggagggtccaaagtgaccgtcctaggtctagcccaaggctgaccccctggtcactctgttacccaccctcctctagtacgtgactgagcgggctcggcaaggcgcatagnnnnnnnnnnnnnnnnnnnnnnnn

SEQ ID NO: 254016 - DNA, 244 bp, Homo sapiens; identical to SEQ ID NO: 253642
  misc_feature: GYAE6OF02H94NM.13.25.C03.1.454.CMB.1.raw
  modified_base (243)..(244): a, c, t, g, unknown or other
  misc_feature (243)..(244): n is a, c, g, or t

SEQ ID NO: 254017 - DNA, 244 bp, Homo sapiens; identical to SEQ ID NO: 253823
  misc_feature: GYAE6OF02GPUKR.13.25.C03.1.454.CMB.1.raw
  modified_base (244)..(244): a, c, t, g, unknown or other
  misc_feature (244)..(244): n is a, c, g, or t

SEQ ID NO: 254018 - DNA, 265 bp, Homo sapiens
  misc_feature: GYAE6OF02II8JY.13.25.C03.1.454.CMB.1.raw
  modified_base (245)..(265): a, c, t, g, unknown or other
  misc_feature (245)..(265): n is a, c, g, or t
tcagtcacgtactacacgaccggtgctcgatttagtagtgtagatttgggtttgggggtgtggtggtcgtccactcccgccttgacgaggctgcctattactgctgctcactatgcaggttcttcgtgtggtcttcggcggagggtccaaagtgaccgtcctaggtcagcccaaggctgccccctggtcactctgttcccgccctcctctagtacgtgactgagcgggctggcaaggcgcatagnnnnnnnnnnnnnnnnnnnnn

SEQ ID NO: 254019 - DNA, 243 bp, Homo sapiens; identical to SEQ ID NO: 253652
  misc_feature: GYAE6OF02H0CHO.13.25.C03.1.454.CMB.1.raw
  modified_base (243)..(243): a, c, t, g, unknown or other
  misc_feature (243)..(243): n is a, c, g, or t

SEQ ID NO: 254020 - DNA, 242 bp, Homo sapiens
  misc_feature: GYAE6OF02IJUTX.13.25.C03.1.454.CMB.1.raw
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatag

SEQ ID NO: 254021 - DNA, 245 bp, Homo sapiens
  misc_feature: GYAE6OF02G7WA8.13.25.C03.1.454.CMB.1.raw
  modified_base (244)..(245): a, c, t, g, unknown or other
  misc_feature (244)..(245): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccttcctctagtacgtgactgagcgggctggcaaggcgcatagnn

SEQ ID NO: 254022 - DNA, 259 bp, Homo sapiens
  misc_feature: GYAE6OF02IA5AM.13.25.C03.1.454.CMB.1.raw
  modified_base (241)..(259): a, c, t, g, unknown or other
  misc_feature (241)..(259): n is a, c, g, or t
tcagtcacgtactacacgaccggtgctcgatttagtagtgtagatttgggtttgggggtgtggtagtctccactcccgccttgacgaggctgcctattactgctgctcatatgcaggttcttctgtggtcttcggcggagggtccaaagtgaccgtcctaggtcagcccaaggctgcccctggtcactctgttcccgcctcctctagtacgtgactggagcgggctggcaaggcgcatagnnnnnnnnnnnnnnnnnnn

SEQ ID NO: 254023 - DNA, 248 bp, Homo sapiens
  misc_feature: GYAE6OF02F8LA3.13.25.C03.1.454.CMB.1.raw
  modified_base (244)..(248): a, c, t, g, unknown or other
  misc_feature (244)..(248): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaagggcgcatagnnnnn

SEQ ID NO: 254024 - DNA, 246 bp, Homo sapiens; identical to SEQ ID NO: 253770
  misc_feature: GYAE6OF02FL7M7.13.25.C03.1.454.CMB.1.raw
  modified_base (243)..(246): a, c, t, g, unknown or other
  misc_feature (243)..(246): n is a, c, g, or t

SEQ ID NO: 254025 - DNA, 246 bp, Homo sapiens; identical to SEQ ID NO: 253694
  misc_feature: GYAE6OF02I8SAJ.13.25.C03.1.454.CMB.1.raw
  modified_base (243)..(246): a, c, t, g, unknown or other
  misc_feature (243)..(246): n is a, c, g, or t

SEQ ID NO: 254026 - DNA, 243 bp, Homo sapiens; identical to SEQ ID NO: 253660
  misc_feature: GYAE6OF02GTTC2.13.25.C03.1.454.CMB.1.raw
  modified_base (243)..(243): a, c, t, g, unknown or other
  misc_feature (243)..(243): n is a, c, g, or t

SEQ ID NO: 254027 - DNA, 247 bp, Homo sapiens
  misc_feature: GYAE6OF02JADTB.13.25.C03.1.454.CMB.1.raw
  modified_base (242)..(247): a, c, t, g, unknown or other
  misc_feature (242)..(247): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcgggggtccaaagtgaccgtcctaggtcagcccaaggctgccccctcggtcactctgttcccgccctcctctagtacgtgactgagcgggctggcaaggcgcatagnnnnnn

SEQ ID NO: 254028 - DNA, 247 bp, Homo sapiens
  misc_feature: GYAE6OF02H169T.13.25.C03.1.454.CMB.1.raw
  modified_base (245)..(247): a, c, t, g, unknown or other
  misc_feature (245)..(247): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactcggtgttcccaccctcctctagtacgtgactgagcgggctggcaaggcgcatagnnn

SEQ ID NO: 254029 - DNA, 276 bp, Homo sapiens
  misc_feature: GYAE6OF02I3HYG.13.25.C03.1.454.CMB.1.raw
  modified_base (238)..(238): a, c, t, g, unknown or other
  misc_feature (238)..(238): n is a, c, g, or t
  modified_base (244)..(276): a, c, t, g, unknown or other
  misc_feature (244)..(276): n is a, c, g, or t
tcagtcacgtactacacgaccggtgctcgatttagtagtgtagatttgggtttggggggtgtggtgggtctccactcccgccttgacgaggctgcctattactgctgctcatatgcaggttcttctgtggtcttcggcggagggtccaaagtgaccgtcctaggtcagcccaaggctgcccctggtcactctgttcccaccctctctagtacgtgactgagcgggctggcaagggccncatagnnnnnnnnnnnnnnnnnnnnnnnnnnnnnnnnn

SEQ ID NO: 254030 - DNA, 249 bp, Homo sapiens
  misc_feature: GYAE6OF02GDCAO.13.25.C03.1.454.CMB.1.raw
  modified_base (244)..(249): a, c, t, g, unknown or other
  misc_feature (244)..(249): n is a, c, g, or t
tcagtcacgtactacacgaccggtgctcgatttagtagtgtagatttgggtttgggggtggtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnnnnn

SEQ ID NO: 254031 - DNA, 245 bp, Homo sapiens; identical to SEQ ID NO: 253753
  misc_feature: GYAE6OF02F5ISH.13.25.C03.1.454.CMB.1.raw
  modified_base (244)..(245): a, c, t, g, unknown or other
  misc_feature (244)..(245): n is a, c, g, or t

SEQ ID NO: 254032 - DNA, 251 bp, Homo sapiens
  misc_feature: GYAE6OF02GU2B4.13.25.C03.1.454.CMB.1.raw
  modified_base (245)..(251): a, c, t, g, unknown or other
  misc_feature (245)..(251): n is a, c, g, or t
tcagtcacgtactacacgaccggtgctcgatttagtagtgtagatttgggtttgggggtggtggtggtcgtccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctgggcaaggcgcatagnnnnnnn

SEQ ID NO: 254033 - DNA, 246 bp, Homo sapiens; identical to SEQ ID NO: 253819
  misc_feature: GYAE6OF02HQ6C8.13.25.C03.1.454.CMB.1.raw
  modified_base (244)..(246): a, c, t, g, unknown or other
  misc_feature (244)..(246): n is a, c, g, or t

SEQ ID NO: 254034 - DNA, 244 bp, Homo sapiens; identical to SEQ ID NO: 253689
  misc_feature: GYAE6OF02JG70Q.13.25.C03.1.454.CMB.1.raw
  modified_base (242)..(244): a, c, t, g, unknown or other
  misc_feature (242)..(244): n is a, c, g, or t

SEQ ID NO: 254035 - DNA, 245 bp, Homo sapiens; identical to SEQ ID NO: 253648
  misc_feature: GYAE6OF02F8A1F.13.25.C03.1.454.CMB.1.raw
  modified_base (243)..(245): a, c, t, g, unknown or other
  misc_feature (243)..(245): n is a, c, g, or t

SEQ ID NO: 254036 - DNA, 245 bp, Homo sapiens
  misc_feature: GYAE6OF02JBWOM.13.25.C03.1.454.CMB.1.raw
  modified_base (241)..(245): a, c, t, g, unknown or other
  misc_feature (241)..(245): n is a, c, g, or t
tcagtcacgtactacacgaccggtgctcgatttagtagtgtagattgggtttgggggtggtggtggtctccactcccgccttgacgaggctgcctattactgctgctcatatgcaggttcttctgtggtcttcggcggagggtccaaagtgaccgtcctaggtcagcccaaggctgccccctggtcactctgttcccgcctcctctagtacgtgactgagcgggctggcaaggcgcatagnnnnn

SEQ ID NO: 254037 - DNA, 243 bp, Homo sapiens
  misc_feature: GYAE6OF02FQD1K.13.25.C03.1.454.CMB.1.raw
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatag

SEQ ID NO: 254038 - DNA, 524 bp, Homo sapiens
  misc_feature: GYAE6OF02JZ8SI.13.25.C03.1.454.CMB.1.raw
  modified_base (227)..(227): a, c, t, g, unknown or other
  misc_feature (227)..(227): n is a, c, g, or t
  modified_base (331)..(331): a, c, t, g, unknown or other
  misc_feature (331)..(331): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (423)..(423): a, c, t, g, unknown or other
  misc_feature (423)..(423): n is a, c, g, or t
tcagtcacgtactacacgaccggtgctcgatttagtagtgtagatttgggtttggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccacccaggcaaggcccccagacgtcatccatttatgggggcaataggcggccgtcagggntttcactcgctctctggctccaagtctggcacacggcctcctgacatctctggctcagntgagacgagcngacctattactgctgctcaatntgctaggttcttctgttcgtacttcggcggtaggtccgtaagtcgccggtacccttaggcctacgcccgaagtccgtccgcccccgtggtcccacgttccg

SEQ ID NO: 254039 - DNA, 257 bp, Homo sapiens
  misc_feature: GYAE6OF02G402K.13.25.C03.1.454.CMB.1.raw
  modified_base (244)..(257): a, c, t, g, unknown or other
  misc_feature (244)..(257): n is a, c, g, or t
tcagtcacgtactacacgaccggtgctcgatttagtagtgtagatttgggtttgggggtgtggtggtcgtccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnnnnnnnnnnnnn

SEQ ID NO: 254040 - DNA, 245 bp, Homo sapiens; identical to SEQ ID NO: 253686
  misc_feature: GYAE6OF02F7U21.13.25.C03.1.454.CMB.1.raw
  modified_base (243)..(245): a, c, t, g, unknown or other
  misc_feature (243)..(245): n is a, c, g, or t

SEQ ID NO: 254041 - DNA, 245 bp, Homo sapiens; identical to SEQ ID NO: 253686
  misc_feature: GYAE6OF02JGVIY.13.25.C03.1.454.CMB.1.raw
  modified_base (243)..(245): a, c, t, g, unknown or other
  misc_feature (243)..(245): n is a, c, g, or t

SEQ ID NO: 254042 - DNA, 248 bp, Homo sapiens
  misc_feature: GYAE6OF02HH7KE.13.25.C03.1.454.CMB.1.raw
  modified_base (242)..(248): a, c, t, g, unknown or other
  misc_feature (242)..(248): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgcctcctctagtacgtgactgagcgggctggcaaggcgcatagnnnnnnn

SEQ ID NO: 254043 - DNA, 243 bp, Homo sapiens; identical to SEQ ID NO: 253704
  misc_feature: GYAE6OF02IUOH2.13.25.C03.1.454.CMB.1.raw
  modified_base (242)..(243): a, c, t, g, unknown or other
  misc_feature (242)..(243): n is a, c, g, or t

SEQ ID NO: 254044 - DNA, 251 bp, Homo sapiens
  misc_feature: GYAE6OF02JJZR7.13.25.C03.1.454.CMB.1.raw
  modified_base (242)..(251): a, c, t, g, unknown or other
  misc_feature (242)..(251): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaaccctctctagtacgtgactgagcgggctggcaaggcgcatagnnnnnnnnnn

SEQ ID NO: 254045 - DNA, 246 bp, Homo sapiens; identical to SEQ ID NO: 253855
  misc_feature: GYAE6OF02H02ZG.13.25.C03.1.454.CMB.1.raw
  modified_base (244)..(246): a, c, t, g, unknown or other
  misc_feature (244)..(246): n is a, c, g, or t

SEQ ID NO: 254046 - DNA, 255 bp, Homo sapiens
  misc_feature: GYAE6OF02FKIC9.13.25.C03.1.454.CMB.1.raw
  modified_base (246)..(255): a, c, t, g, unknown or other
  misc_feature (246)..(255): n is a, c, g, or t
tcagtcacgtactacacgaccggtgctcgatttagtagtgtagatttgggtttggggggtgtggtggtactccactcccgccttgacgaggctgcctattactgactgctcatatgcaggttcttctgtggtcttcggcggagggtccaaagtgaccgtcctaggtcagcccaaggctgcccccctggtcactctgttcccaccctcctctagtacgtgactgagcgggctggcaaggcgcatagnnnnnnnnnn

SEQ ID NO: 254047 - DNA, 245 bp, Homo sapiens; identical to SEQ ID NO: 253648
  misc_feature: GYAE6OF02HIWC3.13.25.C03.1.454.CMB.1.raw
  modified_base (243)..(245): a, c, t, g, unknown or other
  misc_feature (243)..(245): n is a, c, g, or t

SEQ ID NO: 254048 - DNA, 246 bp, Homo sapiens
  misc_feature: GYAE6OF02FQY0E.13.25.C03.1.454.CMB.1.raw
  modified_base (243)..(246): a, c, t, g, unknown or other
  misc_feature (243)..(246): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgcccccctggtcactctgttcccgccctcctctagtacgtgactgagcgggctggcaaggcgcatagnnnn

SEQ ID NO: 254049 - DNA, 242 bp, Homo sapiens
  misc_feature: GYAE6OF02HCXM4.13.25.C03.1.454.CMB.1.raw
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatag

SEQ ID NO: 254050 - DNA, 247 bp, Homo sapiens
  misc_feature: GYAE6OF02IBZLC.13.25.C03.1.454.CMB.1.raw
  modified_base (244)..(247): a, c, t, g, unknown or other
  misc_feature (244)..(247): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnnn

SEQ ID NO: 254051 - DNA, 243 bp, Homo sapiens
  misc_feature: GYAE6OF02G0QRH.13.25.C03.1.454.CMB.1.raw
  modified_base (243)..(243): a, c, t, g, unknown or other
  misc_feature (243)..(243): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgcctcctctagtacgtgactgagcgggctggcaaggcgcatagn

SEQ ID NO: 254052 - DNA, 534 bp, Homo sapiens
  misc_feature: GYAE6OF02HPNVS.13.25.C03.1.454.CMB.1.raw
  modified_base (371)..(371): a, c, t, g, unknown or other
  misc_feature (371)..(371): n is a, c, g, or t
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcgttgggacttatagacttgtctcctggtaccaacaccacccagtcaacggcccccagacgtcatctatttagtgggggcaagtaggcggccgtcagggactttccactcgcttctctggctccaagtctgcaacncggcctcctgacaatctctcggtctccaggctggaggacgaggctgccttattactgctgctcattatcgcgtagttcttcgttgttggttcgttcgggcggtagggtccaagtcgaccgtcgtaggtcacgcccgaaggcctcgtccccgtcggtcactccg

SEQ ID NO: 254053 - DNA, 245 bp, Homo sapiens; identical to SEQ ID NO: 253648
  misc_feature: GYAE6OF02IAM43.13.25.C03.1.454.CMB.1.raw
  modified_base (243)..(245): a, c, t, g, unknown or other
  misc_feature (243)..(245): n is a, c, g, or t

SEQ ID NO: 254054 - DNA, 245 bp, Homo sapiens; identical to SEQ ID NO: 253648
  misc_feature: GYAE6OF02H7RAO.13.25.C03.1.454.CMB.1.raw
  modified_base (243)..(245): a, c, t, g, unknown or other
  misc_feature (243)..(245): n is a, c, g, or t

SEQ ID NO: 254055 - DNA, 545 bp, Homo sapiens
  misc_feature: GYAE6OF02IPB2M.13.25.C03.1.454.CMB.1.raw
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctcagctgagacgaggctgccttattactgctgcctcatatgctaggtttcttcttgtggttccgttcgggccggtagggtaccaaaggttcggacccgttccttaggtccacggaccccgaaggcctccgccccccgtcgggtccctacgttcccg

SEQ ID NO: 254056 - DNA, 251 bp, Homo sapiens
  misc_feature: GYAE6OF02HV95P.13.25.C03.1.454.CMB.1.raw
  modified_base (244)..(251): a, c, t, g, unknown or other
  misc_feature (244)..(251): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaaggcgcatagnnnnnnnn

SEQ ID NO: 254057 - DNA, 247 bp, Homo sapiens
  misc_feature: GYAE6OF02H8P5L.13.25.C03.1.454.CMB.1.raw
  modified_base (242)..(247): a, c, t, g, unknown or other
  misc_feature (242)..(247): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnnnnn

SEQ ID NO: 254058 - DNA, 554 bp, Homo sapiens
  misc_feature: GYAE6OF02F3P3N.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttagtgggggcaagtaggcggccgtcagggatttccactcgcttctctggctccaagtctggcaacacggcctcctgacaatctctggtctccaggctggaggacgaggctgcctattactgctgctcatatcgctaggttctttcgtgttggtcgttcgggcgggtacggtacctaaaggtccggtaacccggttccgtacggtaccacgtaccccgaaggtccctccggccccctcggtccaccgttcccg

SEQ ID NO: 254059 - DNA, 315 bp, Homo sapiens
  misc_feature: GYAE6OF02J5XUQ.13.25.C03.1.454.CMB.1.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (283)..(315): a, c, t, g, unknown or other
  misc_feature (283)..(315): n is a, c, g, or t
tcagtcacgtactacacgaccggtgctcgatttagtagtgtagatttgggtttggggttgtggtggtctccactcccgccttgacgaggctgcctattactgctgctcatatgctgttctcgtggtcgtcgtcggaggtacgtacaagtcgaccgtcgtacggcaccgacccgtacggtccctccccgtccccgttagtccctccgttccgttacccggtccccctccttacgtagtacggttcggngacgnggacggccggtacacggacgacggtcatagnnnnnnnnnnnnnnnnnnnnnnnnnnnnnnnnn

SEQ ID NO: 254060 - DNA, 243 bp, Homo sapiens
  misc_feature: GYAE6OF02H6O2W.13.25.C03.1.454.CMB.1.raw
  modified_base (242)..(243): a, c, t, g, unknown or other
  misc_feature (242)..(243): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctctctagtacgtgactgagcgggctggcaaggcgcatagnn

SEQ ID NO: 254061 - DNA, 242 bp, Homo sapiens
  misc_feature: GYAE6OF02FMWJ6.13.25.C03.1.454.CMB.1.raw
  modified_base (241)..(242): a, c, t, g, unknown or other
  misc_feature (241)..(242): n is a, c, g, or t
tcagtcacgtactacacgaccggtgctcgatttagtagtgtagatttgggtttggggtgtggtggtctccactcccgccttgacgaggctgcctattactgctgctcatatgcaggttcttctgtggtcttcggcggaggtccaaagtgaccgtcctaggtcagcccaaggctgccccctcggtcactctgttcccaccctcctctagtacgtgactgagcgggctggcaaggcgcatagnn

SEQ ID NO: 254062 - DNA, 244 bp, Homo sapiens; identical to SEQ ID NO: 253642
  misc_feature: GYAE6OF02JEEXU.13.25.C03.1.454.CMB.1.raw
  modified_base (243)..(244): a, c, t, g, unknown or other
  misc_feature (243)..(244): n is a, c, g, or t

SEQ ID NO: 254063 - DNA, 244 bp, Homo sapiens
  misc_feature: GYAE6OF02INZT6.13.25.C03.1.454.CMB.1.raw
  modified_base (243)..(244): a, c, t, g, unknown or other
  misc_feature (243)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgcccccctcggtcactctgttcccaccctcctctagtagtgactgagcgggctggcaaggcgcatagnn

SEQ ID NO: 254064 - DNA, 250 bp, Homo sapiens
  misc_feature: GYAE6OF02FFTVW.13.25.C03.1.454.CMB.1.raw
  modified_base (243)..(250): a, c, t, g, unknown or other
  misc_feature (243)..(250): n is a, c, g, or t
tcagtcacgtactacacgaccggtgctcgatttagtagtgtagatttgggtttgggggtggtggtggtctccactcccgccttgacgaggctgcctattactgctgctcatatgcaggttcttctgtggtcttcggcggaggtccaaagtgaccgtcctaggtcagcccaaggctgccccctggtcactctgttcccaccctccgtctagtacgtgactgagcgggctggcaaggcgcatagnnnnnnnn

SEQ ID NO: 254065 - DNA, 253 bp, Homo sapiens
  misc_feature: GYAE6OF02I0O58.13.25.C03.1.454.CMB.1.raw
  modified_base (245)..(253): a, c, t, g, unknown or other
  misc_feature (245)..(253): n is a, c, g, or t
tcagtcacgtactacacgaccggtgctcgatttagtagtgtagatttgggtttgggggtggtggtggtctccactcccgccttgacgaggctgcctattactgcctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnnnnnnnn

SEQ ID NO: 254066 - DNA, 244 bp, Homo sapiens; identical to SEQ ID NO: 253758
  misc_feature: GYAE6OF02H462H.13.25.C03.1.454.CMB.1.raw
  modified_base (243)..(244): a, c, t, g, unknown or other
  misc_feature (243)..(244): n is a, c, g, or t

SEQ ID NO: 254067 - DNA, 247 bp, Homo sapiens
  misc_feature: GYAE6OF02JDWFY.13.25.C03.1.454.CMB.1.raw
  modified_base (243)..(247): a, c, t, g, unknown or other
  misc_feature (243)..(247): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnnnn

SEQ ID NO: 254068 - DNA, 525 bp, Homo sapiens
  misc_feature: GYAE6OF02I2KGA.13.25.C03.1.454.CMB.1.raw
  modified_base (418)..(418): a, c, t, g, unknown or other
  misc_feature (418)..(418): n is a, c, g, or t
  modified_base (454)..(454): a, c, t, g, unknown or other
  misc_feature (454)..(454): n is a, c, g, or t
  modified_base (486)..(486): a, c, t, g, unknown or other
  misc_feature (486)..(486): n is a, c, g, or t
  modified_base (519)..(519): a, c, t, g, unknown or other
  misc_feature (519)..(519): n is a, c, g, or t
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctcaagtctggcaacacggcctcctgacaatcctctggactccaggccgaggacgagctgtatttttacngtttcgttcattatgcaggaggagtgtattatgttntttggaagttggactaagtcaccgtcttggcngccaggcccacccgatcgtctactctcgttccnccctcc

SEQ ID NO: 254069 - DNA, 244 bp, Homo sapiens; identical to SEQ ID NO: 253642
  misc_feature: GYAE6OF02F44UP.13.25.C03.1.454.CMB.1.raw
  modified_base (243)..(244): a, c, t, g, unknown or other
  misc_feature (243)..(244): n is a, c, g, or t

SEQ ID NO: 254070 - DNA, 245 bp, Homo sapiens
  misc_feature: GYAE6OF02JFPJN.13.25.C03.1.454.CMB.1.raw
  modified_base (243)..(245): a, c, t, g, unknown or other
  misc_feature (243)..(245): n is a, c, g, or t
tcagtcacgtactacacgaccggtgctcgatttagtagtgtagatttgggtttgggggtgtggtggtctccactcccgtcttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnn

SEQ ID NO: 254071 - DNA, 243 bp, Homo sapiens
  misc_feature: GYAE6OF02G8RHL.13.25.C03.1.454.CMB.1.raw
  modified_base (242)..(243): a, c, t, g, unknown or other
  misc_feature (242)..(243): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccacctcctctagtacgtgactgagcgggctggcaaggcgcatagnn

SEQ ID NO: 254072 - DNA, 545 bp, Homo sapiens
  misc_feature: GYAE6OF02GBE5T.13.25.C03.1.454.CMB.1.raw
  modified_base (228)..(228): a, c, t, g, unknown or other
  misc_feature (228)..(228): n is a, c, g, or t
  modified_base (368)..(368): a, c, t, g, unknown or other
  misc_feature (368)..(368): n is a, c, g, or t
  modified_base (400)..(400): a, c, t, g, unknown or other
  misc_feature (400)..(400): n is a, c, g, or t
  modified_base (432)..(432): a, c, t, g, unknown or other
  misc_feature (432)..(432): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccacccaggcaaggcccccagagtcatcatttagtgggggcaagtaggcggcccgtcgaggggtactttccgactcgcttctcgtggctccaagtcnggcaacacgccctcctgacaatctctggtccnccaggctggaggacgaggctgccttatacgtnctgctacatatcgctaggtttcttcgttgtggttcgttcgggcgtaggtaccgaagtcggaaccggttccgtaggtcacgcccgaaggcctccgccccgtcggtccacttccg

SEQ ID NO: 254073 - DNA, 251 bp, Homo sapiens
  misc_feature: GYAE6OF02GJBEY.13.25.C03.1.454.CMB.1.raw
  modified_base (243)..(251): a, c, t, g, unknown or other
  misc_feature (243)..(251): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnnnnnnnn

SEQ ID NO: 254074 - DNA, 258 bp, Homo sapiens
  misc_feature: GYAE6OF02HMO6W.13.25.C03.1.454.CMB.1.raw
  modified_base (243)..(258): a, c, t, g, unknown or other
  misc_feature (243)..(258): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtaccgtgactgagcgggctggcaaggcgcatagnnnnnnnnnnnnnnnn

SEQ ID NO: 254075 - DNA, 591 bp, Homo sapiens
  misc_feature: GYAE6OF02I980V.13.25.C03.1.454.CMB.1.raw
  modified_base (387)..(387): a, c, t, g, unknown or other
  misc_feature (387)..(387): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcgttgggacttatagacttgtctcctggtaccaacaccaccaggacaacggcccccagacgtcatcatttagtgggggacaagtacggcggccgtcgagggtactttccactcgcttctctggtctcaagtctggcaacgacgcctcccgngacaactctcgtcgtctccgagctgaggacggaggcctcgccttattactcgtctgtccgtcaagtatcggtctgggttaccttcgttgtcgggttccgttcgggcggtacgggttaccgtaaacggtccggtaccgttaccgtaggtccgacggtcccgaacgggtcctacccggaccccgttccggtaccgtaccttcccgg

SEQ ID NO: 254076 - DNA, 248 bp, Homo sapiens
  misc_feature: GYAE6OF02JIPBA.13.25.C03.1.454.CMB.1.raw
  modified_base (245)..(248): a, c, t, g, unknown or other
  misc_feature (245)..(248): n is a, c, g, or t
tcagtcacgtactacacgaccggtgctcgatttagtagtgtagatttgggtttgggggtgtggtggtctccactcccgccttccgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnn

SEQ ID NO: 254077 - DNA, 246 bp, Homo sapiens; identical to SEQ ID NO: 253819
  misc_feature: GYAE6OF02F85PN.13.25.C03.1.454.CMB.1.raw
  modified_base (244)..(246): a, c, t, g, unknown or other
  misc_feature (244)..(246): n is a, c, g, or t

SEQ ID NO: 254078 - DNA, 427 bp, Homo sapiens
  misc_feature: GYAE6OF02IKXRZ.13.25.C03.1.454.CMB.1.raw
  modified_base (421)..(427): a, c, t, g, unknown or other
  misc_feature (421)..(427): n is a, c, g, or t
tcagtcacgtactacacgaccggtgctcgatttagtagtgtagatttgggtttgggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattactgtgcgaaggaaatttacccctatacttttgactactggggccagggaaccctggtcaccgtctcctcagcctccaccaaagggcccatcggtcttccccctggcaccctcctccaagagcacctctgggggcacagcggccctgggctgcctggtcaaggactacttcctagtacgtgactgagcgggctggcaaggcgcatagnnnnnnn

SEQ ID NO: 254079 - DNA, 243 bp, Homo sapiens; identical to SEQ ID NO: 253660
  misc_feature: GYAE6OF02F4N79.13.25.C03.1.454.CMB.1.raw
  modified_base (243)..(243): a, c, t, g, unknown or other
  misc_feature (243)..(243): n is a, c, g, or t

SEQ ID NO: 254080 - DNA, 246 bp, Homo sapiens; identical to SEQ ID NO: 253855
  misc_feature: GYAE6OF02GJ4OL.13.25.C03.1.454.CMB.1.raw
  modified_base (244)..(246): a, c, t, g, unknown or other
  misc_feature (244)..(246): n is a, c, g, or t

SEQ ID NO: 254081 - DNA, 249 bp, Homo sapiens
  misc_feature: GYAE6OF02GPMEZ.13.25.C03.1.454.CMB.1.raw
  modified_base (243)..(249): a, c, t, g, unknown or other
  misc_feature (243)..(249): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnnnnnn

SEQ ID NO: 254082 - DNA, 254 bp, Homo sapiens
  misc_feature: GYAE6OF02HX153.13.25.C03.1.454.CMB.1.raw
  modified_base (242)..(254): a, c, t, g, unknown or other
  misc_feature (242)..(254): n is a, c, g, or t
tcagtcacgtactacacgaccggtgctcgatttagtagtgtagatttgggtttgggggtgtgggtggtctccactcccgccttgacgaggctgcctattactgctgctcatatgcaggttcttctgtggtcttcggcggaggtccaaagtgaccgtcctaggtcagcccaaggctgccccctggtcactctgttcccgccctcctctagtacgtgactgagcgggctggcaaggcgcatagnnnnnnnnnnnnn

SEQ ID NO: 254083 - DNA, 244 bp, Homo sapiens
  misc_feature: GYAE6OF02IECQZ.13.25.C03.1.454.CMB.1.raw
  modified_base (243)..(244): a, c, t, g, unknown or other
  misc_feature (243)..(244): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgcccccctggtcattctgttcccgccctcctctagtacgtgactgagcgggctggcaaggcgcatagnn

SEQ ID NO: 254084 - DNA, 244 bp, Homo sapiens
  misc_feature: GYAE6OF02GS8ZV.13.25.C03.1.454.CMB.1.raw
  modified_base (244)..(244): a, c, t, g, unknown or other
  misc_feature (244)..(244): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagn

SEQ ID NO: 254085 - DNA, 248 bp, Homo sapiens
  misc_feature: GYAE6OF02I03VO.13.25.C03.1.454.CMB.1.raw
  modified_base (244)..(248): a, c, t, g, unknown or other
  misc_feature (244)..(248): n is a, c, g, or t
tcagtcacgtactacacgaccggtgctcgatttagtagtgtagatttgggtttgggggtggtggtggtctccactcccgccttgacgaggctgcctattactgctgctcatatgcaggttcttctgtggtcttcggcggaggtccaaagtgaccgtcctaggtcagcccaaggctgcccctggtcactctgttcccacctcctctagtaccgtgactgacgcgggctggacaaggcgtcatagnnnnn

SEQ ID NO: 254086 - DNA, 247 bp, Homo sapiens
  misc_feature: GYAE6OF02JRI9A.13.25.C03.1.454.CMB.1.raw
  modified_base (242)..(247): a, c, t, g, unknown or other
  misc_feature (242)..(247): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctctctagtacgtgactgagcgggctggcaaggcgcatagnnnnnn

SEQ ID NO: 254087 - DNA, 244 bp, Homo sapiens; identical to SEQ ID NO: 253642
  misc_feature: GYAE6OF02IH1PE.13.25.C03.1.454.CMB.1.raw
  modified_base (243)..(244): a, c, t, g, unknown or other
  misc_feature (243)..(244): n is a, c, g, or t

SEQ ID NO: 254088 - DNA, 627 bp, Homo sapiens
  misc_feature: GYAE6OF02ILZ9L.13.25.C03.1.454.CMB.1.raw
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccgggctgaggtgaagaagcctggggcctcagtgaaggtctcctgcaaggcttccggatacaccctcaatggaaaactatgtccaactatgtgcgacacggccccaggacaagggcttctgtggatggggtgatcaacctaatagngtnacaacaaacgtntacgagaagtaaaagtttggacgggtccggtacacgtactacggaaccgagggaacgacgtaccaagtaccaaactaacacgtaccttacgaagtacggaacgttcgaaccgacgactacgaccttcggataaccggacaccggccgtagtacttaacgtcgtacggtaccggtacgtaaacgtcgtaacgtaccgtaaaccttacgtttagttaacgttttacgggaccgtacgggtacgtacccgtggtacctaccggtccgttacccg

SEQ ID NO: 254089 - DNA, 244 bp, Homo sapiens
  misc_feature: GYAE6OF02JDTD0.13.25.C03.1.454.CMB.1.raw
  modified_base (243)..(244): a, c, t, g, unknown or other
  misc_feature (243)..(244): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggaggtccaaagtgaccgtcctaggtcagcccaaggctgccccctcggtcactctgttcccgccctcctctagtacgtgactgagcgggctggcaaggcgcatagnn

SEQ ID NO: 254090 - DNA, 248 bp, Homo sapiens; identical to SEQ ID NO: 253812
  misc_feature: GYAE6OF02I0IFC.13.25.C03.1.454.CMB.1.raw
  modified_base (244)..(248): a, c, t, g, unknown or other
  misc_feature (244)..(248): n is a, c, g, or t

SEQ ID NO: 254091 - DNA, 547 bp, Homo sapiens
  misc_feature: GYAE6OF02FZ3HH.13.25.C03.1.454.CMB.1.raw
  modified_base (367)..(367): a, c, t, g, unknown or other
  misc_feature (367)..(367): n is a, c, g, or t
  modified_base (433)..(433): a, c, t, g, unknown or other
  misc_feature (433)..(433): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccaccaggcaaggcccccagagtcatcatttagtgggggcaagtaggcggccgtcagggtatttccactcgcttctctggctcaagtctggcaacncggccctccctgaccaatctctcgtctccaggctgaggacgaggctgcctatactgctgctcatangcgtagttcttcgttgttcggtcgtttcgggcggtacgggtaccaaggtcggtacccgtccgtagggtccgacggacccgaggtcctccggccccgtaccggtcaccgttcccg

SEQ ID NO: 254092 - DNA, 244 bp, Homo sapiens; identical to SEQ ID NO: 254084
  misc_feature: GYAE6OF02HO19L.13.25.C03.1.454.CMB.1.raw
  modified_base (244)..(244): a, c, t, g, unknown or other
  misc_feature (244)..(244): n is a, c, g, or t

SEQ ID NO: 254093 - DNA, 251 bp, Homo sapiens
  misc_feature: GYAE6OF02G7V0A.13.25.C03.1.454.CMB.1.raw
  modified_base (243)..(251): a, c, t, g, unknown or other
  misc_feature (243)..(251): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggaggtccaaagtgaccgtcctaggtcagcccaaggctgccccctcggtcactctgttcccaccctcctctagtacgtgactgagcgggctggcaaggcgcatagnnnnnnnnn

SEQ ID NO: 254094 - DNA, 622 bp, Homo sapiens
  misc_feature: GYAE6OF02ID5C9.13.25.C03.1.454.CMB.1.raw
  modified_base (478)..(478): a, c, t, g, unknown or other
  misc_feature (478)..(478): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatcctcctgcactaggaaacagcagtgatcgttgggacttatagacttgtctcctcggtaccaacaccaccccaggcaacggcccccagagtcatctatttagtggggtacaagtagggccggccgtcgagggtactttccactcgcttctctcggtctaccgtaagtcttcggacgaacgaccggtcccttcccgtagacctaaacttccttcgtcggttccctccgaggtctgggacggacggacggcgtacgtaccttagtttaccngtcctcgtcctactattagtacgacgtagtttccttcgttgttcgttcggttcgggcgggtacggtacgtaaggtccgccgtaccgttacggccgtaccgaccgacggtccgtccggcccccggtacggtccctacgttccccg

SEQ ID NO: 254095 - DNA, 580 bp, Homo sapiens
  misc_feature: GYAE6OF02IKVDX.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggtggttataactatgtctcgtgtacaacacaccaggacaaacgaccccaaaatcatagtatttatgatgtacagtaacgccggcctcgacgggtccctgactcgtcttctctcgcctccaagtctaggcaacgaccggccctccctgacctactctcgtacgtcctccgacggctaggaggacggacggtctcgtaccttacttactcgtacgtgtacctcattagtcgacgttacgttcttcgtgttcggtcgttcgggcggtacggtacgtaacggtcgtaccgttcgtacgtcgacgaccgtaacggtccgtaccggccccttacggtcctacccg

SEQ ID NO: 254096 - DNA, 246 bp, Homo sapiens; identical to SEQ ID NO: 253838
  misc_feature: GYAE6OF02F73F2.13.25.C03.1.454.CMB.1.raw
  modified_base (243)..(246): a, c, t, g, unknown or other
  misc_feature (243)..(246): n is a, c, g, or t

SEQ ID NO: 254097 - DNA, 246 bp, Homo sapiens
  misc_feature: GYAE6OF02JDPKE.13.25.C03.1.454.CMB.1.raw
  modified_base (242)..(246): a, c, t, g, unknown or other
  misc_feature (242)..(246): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnnnnn

SEQ ID NO: 254098 - DNA, 245 bp, Homo sapiens; identical to SEQ ID NO: 253837
  misc_feature: GYAE6OF02F9R7Y.13.25.C03.1.454.CMB.1.raw
  modified_base (244)..(245): a, c, t, g, unknown or other
  misc_feature (244)..(245): n is a, c, g, or t

SEQ ID NO: 254099 - DNA, 250 bp, Homo sapiens
  misc_feature: GYAE6OF02H5CNP.13.25.C03.1.454.CMB.1.raw
  modified_base (246)..(250): a, c, t, g, unknown or other
  misc_feature (246)..(250): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgcccccctcggtcactctgttccccgccctcctctagtacgtgactgagcgggctggcaaggcgcatagnnnnn

SEQ ID NO: 254100 - DNA, 249 bp, Homo sapiens
  misc_feature: GYAE6OF02IHJM7.13.25.C03.1.454.CMB.1.raw
  modified_base (242)..(249): a, c, t, g, unknown or other
  misc_feature (242)..(249): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgcctcctctagtacgtgactgagcgggctggcaaggcgcatagnnnnnnnn

SEQ ID NO: 254101 - DNA, 244 bp, Homo sapiens; identical to SEQ ID NO: 253677
  misc_feature: GYAE6OF02FU2TT.13.25.C03.1.454.CMB.1.raw
  modified_base (242)..(244): a, c, t, g, unknown or other
  misc_feature (242)..(244): n is a, c, g, or t

SEQ ID NO: 254102 - DNA, 556 bp, Homo sapiens
  misc_feature: GYAE6OF02FHZ2K.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagacgtcatcatttagtggggcaagtaggcggccgtcgagggatttccactcgcttctctggctccaagtctggcaacacggcctcctgacaatctctgctcaggctgaggacgaggctgaccttattactgctgctcattatgcctaggtttcctttcgtgttggttcgttcgggcgggtaggtaccgtaaggtcgtaaccggttccttagggtccacggtacccgaacggtcctaccggcccccgttcggtcctaccgttcccg

SEQ ID NO: 254103 - DNA, 597 bp, Homo sapiens
  misc_feature: GYAE6OF02F6VND.13.25.C03.1.454.CMB.1.raw
  modified_base (423)..(423): a, c, t, g, unknown or other
  misc_feature (423)..(423): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccaccaggcaaggccccccagacgtcatctaatttagtgggggcaataggcggccgtcagggatttccactcgcttctctggctccaagtctggcaacacggcctcctgacatctctgtctcaggctggagacgaggctcgccttattacgngctgctctatatgtcgtacggtttctttcgttggttcggttccgttcggggtaccgggtacggggttaccaaacgggttcggtaaccccgggttccgttaacggggtccaacggtaccccgaacgggtcccgttacccggcccccccgttacgggttaccctaccctttcccgg

SEQ ID NO: 254104 - DNA, 244 bp, Homo sapiens
  misc_feature: GYAE6OF02GOAEE.13.25.C03.1.454.CMB.1.raw
  modified_base (243)..(244): a, c, t, g, unknown or other
  misc_feature (243)..(244): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctcctctagtacgtgactgagcgggctggcaaggcgcatagnn

SEQ ID NO: 254105 - DNA, 246 bp, Homo sapiens; identical to SEQ ID NO: 253819
  misc_feature: GYAE6OF02HUX94.13.25.C03.1.454.CMB.1.raw
  modified_base (244)..(246): a, c, t, g, unknown or other
  misc_feature (244)..(246): n is a, c, g, or t

SEQ ID NO: 254106 - DNA, 134 bp, Homo sapiens
  misc_feature: GYAE6OF02H5MAM.13.25.C03.1.454.CMB.1.raw
  modified_base (132)..(134): a, c, t, g, unknown or other
  misc_feature (132)..(134): n is a, c, g, or t
tcagtcacgtactacacgaccggtgctcgatttagtagtgtagatttgggtttgggggaagaggaagactgacggtcccccaggagttcaggtgctgggcacagcggccctgggctgcctggtcaaggactnnn

SEQ ID NO: 254107 - DNA, 247 bp, Homo sapiens
  misc_feature: GYAE6OF02FHBSJ.13.25.C03.1.454.CMB.1.raw
  modified_base (245)..(247): a, c, t, g, unknown or other
  misc_feature (245)..(247): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgcccccctggtcactctgttccccgccctcctctagtacgtgactgagcgggctggcaaggcgcatagnnn

SEQ ID NO: 254108 - DNA, 554 bp, Homo sapiens
  misc_feature: GYAE6OF02IGPF7.13.25.C03.1.454.CMB.1.raw
  modified_base (335)..(335): a, c, t, g, unknown or other
  misc_feature (335)..(335): n is a, c, g, or t
  modified_base (374)..(374): a, c, t, g, unknown or other
  misc_feature (374)..(374): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (492)..(492): a, c, t, g, unknown or other
  misc_feature (492)..(492): n is a, c, g, or t
  modified_base (544)..(544): a, c, t, g, unknown or other
  misc_feature (544)..(544): n is a, c, g, or t
tcagtcacgtactacacgaccggtgctcgatttagtagtgtagatttggggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactggaaacagcagtgatcttgggacttatagacttgtctcctggtaccaacaccacccaggcaaagcccccaaactcattatttacggggtacaataagcggcctcagggctttcngatcgcttctctggctcaagtctggcaacacggcctccngacaatctctgactcaggccgaggacgagctgtattttactgttgttcattatgacgaggaaaggngtgattntgttcgtttaggaagttgggactaaggtctaccgtcgttggtacncggacccaacggccctaaaccccagtcgtacctaccttcctcggttcccccncccttacccg

SEQ ID NO: 254109 - DNA, 245 bp, Homo sapiens; identical to SEQ ID NO: 253760
  misc_feature: GYAE6OF02JS005.13.25.C03.1.454.CMB.1.raw
  modified_base (242)..(245): a, c, t, g, unknown or other
  misc_feature (242)..(245): n is a, c, g, or t

SEQ ID NO: 254110 - DNA, 674 bp, Homo sapiens
  misc_feature: GYAE6OF02ICV1C.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctccgtggtaccaacacccaccaggacaaccggcccccagacgtcactctacgttttaagtcgggggacctaagtacgggccggtccgtacgagggtactttccgactcgtcttctcgtcggcctaccgagtcgtggaccacgaccggtcctccctgtacattcctcgtcggtcctccgaggtactggacgggacgtcggcgttcgccttaacgttacgtgtccgttacgtcctactacgttacgtcgtaccgttacggtttccgtttacgttcgggtttcggttccggttccggggtacgggttaccgggtaccgtaaacgggttccggtaacccggttccggttacggtcccgtaccggtacccggtacggtaccctcccggtaccccccggttcgtaccccgtacgtttccccgg

SEQ ID NO: 254111 - DNA, 246 bp, Homo sapiens; identical to SEQ ID NO: 253838
  misc_feature: GYAE6OF02GYHWD.13.25.C03.1.454.CMB.1.raw
  modified_base (243)..(246): a, c, t, g, unknown or other
  misc_feature (243)..(246): n is a, c, g, or t

SEQ ID NO: 254112 - DNA, 249 bp, Homo sapiens
  misc_feature: GYAE6OF02GC2GM.13.25.C03.1.454.CMB.1.raw
  modified_base (242)..(249): a, c, t, g, unknown or other
  misc_feature (242)..(249): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctggcaaggcgcatagnnnnnnnn

SEQ ID NO: 254113 - DNA, 511 bp, Homo sapiens
  misc_feature: GYAE6OF02G0GJ2.13.25.C03.1.454.CMB.1.raw
  modified_base (334)..(334): a, c, t, g, unknown or other
  misc_feature (334)..(334): n is a, c, g, or t
  modified_base (373)..(373): a, c, t, g, unknown or other
  misc_feature (373)..(373): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (495)..(495): a, c, t, g, unknown or other
  misc_feature (495)..(495): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaatcattatttacggggtcaataagcggccctcagggctttcngatcgcttctctggctcaagtctggcaacacgcctcccngacatctctggactccgaggccgaggacgaggctgtatttttctgtttgttcattatgcagggaagngtgattntgtcttggagtggacagtcacgtcttgcagccgagcccaccgatcgcncgtctcgtcccgtccc

SEQ ID NO: 254114 - DNA, 245 bp, Homo sapiens; identical to SEQ ID NO: 253837
  misc_feature: GYAE6OF02JC2VZ.13.25.C03.1.454.CMB.1.raw
  modified_base (244)..(245): a, c, t, g, unknown or other
  misc_feature (244)..(245): n is a, c, g, or t

SEQ ID NO: 254115 - DNA, 648 bp, Homo sapiens
  misc_feature: GYAE6OF02IT4M3.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcgttgggacttatagacttgtctcctggtaaccaacaccacccaggcaacggccccagagtcatctatttagtgggggacaagtacgggcggccgtcgagggtacttacccgacgtccgtcttctctcggtctaccgaagtcgtacgacaacgaccggccctccctgacactctcgtcgtctccgacggtctggacggtacggaggcgtcgaccttagttactcgtctcggtactctaatcgttcgtacggttacgtttcgtttacgtcggtttcgggttccgttcggggtaccgggtacgggttacccgtaagggtacccggttaaccggttacccggttagggtacccgaccgggtaccccgtaacgggcccttacccggtcccccgttacggttccctacccgttcccg

SEQ ID NO: 254116 - DNA, 247 bp, Homo sapiens; identical to SEQ ID NO: 253850
  misc_feature: GYAE6OF02HK0ZF.13.25.C03.1.454.CMB.1.raw
  modified_base (243)..(247): a, c, t, g, unknown or other
  misc_feature (243)..(247): n is a, c, g, or t

SEQ ID NO: 254117 - DNA, 245 bp, Homo sapiens
  misc_feature: GYAE6OF02GA2QU.13.25.C03.1.454.CMB.1.raw
  modified_base (242)..(245): a, c, t, g, unknown or other
  misc_feature (242)..(245): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttccccaccctcctctagtacgtgactgagcggctggcaaggcgcatagnnnn

SEQ ID NO: 254118 - DNA, 821 bp, Homo sapiens
  misc_feature: GYAE6OF02I8X5Z.13.25.C03.1.454.CMB.1.raw
  modified_base (249)..(249): a, c, t, g, unknown or other
  misc_feature (249)..(249): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcgttgggacttanagacttgtctcctggtaccaacaccaccaggcaacggcccccagacgtcactctatttagtgggggcaagtacgggcggtccgtacgagggtactttccgacttcgcttctcgtggtcctccaagtcgtggaccaacgtaccggtccctcccgtagaaccgtaacttccgttccgtacggtcccttcccggaacggtccgttagggaacgggtaaccggagggtcccgtacggtacccgtttaagttacccgttacggtccgttacgtccctttcgtaacgtttaacgttccggtaccggtttaaccggggttttccttttccggtttcgggttttccgggtttcccggttttacccggggggaccggggtttaaccgggggttacccgtaaaaacggggttttcccgggtaaaccccgggttttaccccggtttaaacggggttccccggttaaacccgggtacccccgggttaaacccggggtttacccccggttttaccccccgggtaccccccccccgggtttaaccggggtttttaccccccggtaacccggttttttcccccccgg

SEQ ID NO: 254119 - DNA, 246 bp, Homo sapiens; identical to SEQ ID NO: 253734
  misc_feature: GYAE6OF02JJOCO.13.25.C03.1.454.CMB.1.raw
  modified_base (242)..(246): a, c, t, g, unknown or other
  misc_feature (242)..(246): n is a, c, g, or t

SEQ ID NO: 254120 - DNA, 271 bp, Homo sapiens
  misc_feature: GYAE6OF02HSAP6.13.25.C03.1.454.CMB.1.raw
  modified_base (245)..(246): a, c, t, g, unknown or other
  misc_feature (245)..(246): n is a, c, g, or t
  modified_base (249)..(271): a, c, t, g, unknown or other
  misc_feature (249)..(271): n is a, c, g, or t
tcagtcacgtactacacgaccggtgctcgatttagtagtgtagatttgggtttggggggtgtggtggtctccactcctgccttgacgaggctgcctattactgctgctcatatgcaggttcttctgtggtcttcggcggtagggtccaaagtgaccgtctaggtcagcccaaggctgccccctggtcactctgttctcgccctcgtctagtacgtgactgagcgggctggacaaggcgcaattgnncannnnnnnnnnnnnnnnnnnnnnn

SEQ ID NO: 254121 - DNA, 246 bp, Homo sapiens
  misc_feature: GYAE6OF02F474E.13.25.C03.1.454.CMB.1.raw
  modified_base (246)..(246): a, c, t, g, unknown or other
  misc_feature (246)..(246): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgcccccctcggtcactctgttccccgccctcctctagtacgtgactgagcgggctggcaaggcgcatagn

SEQ ID NO: 254122 - DNA, 244 bp, Homo sapiens; identical to SEQ ID NO: 253645
  misc_feature: GYAE6OF02GT6BK.13.25.C03.1.454.CMB.1.raw
  modified_base (243)..(244): a, c, t, g, unknown or other
  misc_feature (243)..(244): n is a, c, g, or t

SEQ ID NO: 254123 - DNA, 562 bp, Homo sapiens
  misc_feature: GYAE6OF02FUXP3.13.25.C03.1.454.CMB.1.raw
  modified_base (228)..(228): a, c, t, g, unknown or other
  misc_feature (228)..(228): n is a, c, g, or t
  modified_base (408)..(408): a, c, t, g, unknown or other
  misc_feature (408)..(408): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccacccaggcaaggcccccagagtcatcattatggggcgaataggcggccgtcagggagttctactcgcttctctggctccacgtactggcgaacacggtcctccctgacaatctctgtctccacggctgaggacgnggctgccttatactgctgctcatatgcgtaggtttcttcgttcgttcggttcgttcgggtacgggtgggtaccgtaaacgtggtacccgttccgttacgggtcgtacgacccgtaacggcgttccgtcccccggtccggttccacgttaccccg

SEQ ID NO: 254124 - DNA, 546 bp, Homo sapiens
  misc_feature: GYAE6OF02GW4MI.13.25.C03.1.454.CMB.1.raw
  modified_base (307)..(307): a, c, t, g, unknown or other
  misc_feature (307)..(307): n is a, c, g, or t
  modified_base (426)..(426): a, c, t, g, unknown or other
  misc_feature (426)..(426): n is a, c, g, or t
  modified_base (468)..(468): a, c, t, g, unknown or other
  misc_feature (468)..(468): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcgttgggacttatagacttgtctcctggtaccaacaccaccaggcaacggcccccagagtcatcatttagnggggcaagtaggcggccgtcgagggtactttccacgtcgtcttctctgctccaagtctggcacacgcctcctgacactctcgtgtctccgaggctgaggacgaggctcgccttattacngctgctcatagtgctagtttcttcgttgttcggtcgttcggngtacggtacgaagtcggaccgtacgtacggtccacgcccgtaaggtccgtccgacccccgtcggtacctaccgttccg

SEQ ID NO: 254125 - DNA, 557 bp, Homo sapiens
  misc_feature: GYAE6OF02H4U82.13.25.C03.1.454.CMB.1.raw
  modified_base (229)..(229): a, c, t, g, unknown or other
  misc_feature (229)..(229): n is a, c, g, or t
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
tcagtcacgtactacacgaccggtgctcgatttagtagtgtagatttgggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgattcttgggacttatagacttgtctcctggtaccaacaccacccaggcaaggccccagagtcatctattagtgggggcaataggcggccgtcgagggtattccactcgcttctctgctcaagtctggcaacgacggcctcctgacaatcgtctcggtctccaggtctggaggacgcggctntcctaattacgngtctgctctatatgctaggttcttcttgtcggttctcgggcggtacggtaccgtaaggtcggaccgttaccgtggtaccgaccgacccgtaacggtcctccggtccccccgtcggtccacgtttccccg

SEQ ID NO: 254126 - DNA, 246 bp, Homo sapiens; identical to SEQ ID NO: 253819
  misc_feature: GYAE6OF02GT51K.13.25.C03.1.454.CMB.1.raw
  modified_base (244)..(246): a, c, t, g, unknown or other
  misc_feature (244)..(246): n is a, c, g, or t

SEQ ID NO: 254127 - DNA, 247 bp, Homo sapiens
  misc_feature: GYAE6OF02H3YXM.13.25.C03.1.454.CMB.1.raw
  modified_base (243)..(247): a, c, t, g, unknown or other
  misc_feature (243)..(247): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctctctagtacgtgactgagcgggctggcaaggcgcatagnnnnn

SEQ ID NO: 254128 - DNA, 246 bp, Homo sapiens
  misc_feature: GYAE6OF02I36Q3.13.25.C03.1.454.CMB.1.raw
  modified_base (241)..(246): a, c, t, g, unknown or other
  misc_feature (241)..(246): n is a, c, g, or t
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccgccctctctagtacgtgactgagcgggctggcaaggcgcatagnnnnnn

SEQ ID NO: 254129 - DNA, 648 bp, Homo sapiens
  misc_feature: GYAE6OF02F7DR7.13.25.C03.1.454.CMB.1.raw
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactaggaaacagcagtgattcgtaggacttagtagtacttgtctccgtacggtaacccaaccacccaacccgaggaccaaccggacccccagacgtacaatcctagtttaggtggggacaacggtacgggccgggtccgtacgagggtactttccgactcgtcttcgtcgtcgtcctaccgagtcgacggacgaacgaccgtcctcctagacatctcgtacgtcctacgagtcgtggacggtacgacgtcgtacgtaccttagttacgtcgtctcgtctacgtatacgtacgtcgttacgttcgttacgttcggttcggttcgtacgggtagtaccgggttacgtacggtccggtacccgttaccgtacggtaccgtaccggtaccgtaccggtccgtccccggtcccgtaccggtacctaccgttcccg

SEQ ID NO: 254130 - DNA, 253 bp, Homo sapiens
  misc_feature: GYAE6OF02HCTEB.13.25.C03.1.454.CMB.1.raw
  modified_base (244)..(253): a, c, t, g, unknown or other
  misc_feature (244)..(253): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccgccctcctctagtacgtgactgagcgggctggcaaggcgcatagnnnnnnnnnn

SEQ ID NO: 254131 - DNA, 258 bp, Homo sapiens
  misc_feature: GYAE6OF02FM2BL.13.25.C03.1.454.CMB.1.raw
  modified_base (246)..(258): a, c, t, g, unknown or other
  misc_feature (246)..(258): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgcccccctggtcactctgttccccaccctcctctagtacgtgactgagcgggctgggcaaggcgcatagnnnnnnnnnnnnn

SEQ ID NO: 254132 - DNA, 249 bp, Homo sapiens
  misc_feature: GYAE6OF02HCJ9I.13.25.C03.1.454.CMB.1.raw
  modified_base (244)..(249): a, c, t, g, unknown or other
  misc_feature (244)..(249): n is a, c, g, or t
tcagtcacgtactacacgaccggtgctcgatttagtagtgtagatttgggtttggggggtgtggtggtctccactcccgccttgacgaggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagnnnnnn

SEQ ID NO: 254133 - DNA, 246 bp, Homo sapiens; identical to SEQ ID NO: 253838
  misc_feature: GYAE6OF02H88DK.13.25.C03.1.454.CMB.1.raw
  modified_base (243)..(246): a, c, t, g, unknown or other
  misc_feature (243)..(246): n is a, c, g, or t

SEQ ID NO: 254134 - DNA, 704 bp, Homo sapiens
  misc_feature: GYAE6OF02G11ZO.13.25.C03.1.454.CMB.1.raw
  modified_base (225)..(225): a, c, t, g, unknown or other
  misc_feature (225)..(225): n is a, c, g, or t
  modified_base (313)..(313): a, c, t, g, unknown or other
  misc_feature (313)..(313): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctcgtgtctgggtctctggacagtcgatcaccatctcctgcactgaaacngcagtgatcgttagggacttagagtacttgtctcctacggtaccaaccaccacccgaggaccaacggccccagagtcatctagttagnggggacaagtggcggtccgtcgagggtcttaccgactcgtaccttctcgtcggtcctaccgtaagttccgcggtacctaaccgtccggtccctaccctaggaacctaacgtccgttacgtcggttcctaccgacggtcgtgggaacgggtacggaacggttcgtaccgtacctttaagttaccgttcggtaccttacggtccttaacgagttacgtcgtacggtttaacgtttccgtttacgtgggtttccggttccggttaccgggtacggggtaagggttaccgtaacggtccggtaaacccggttccgtacgggtccggtaacccggtaccggtaaccggtcccgtacccggtccccccggttacggttacccgtacccttaccccgg

SEQ ID NO: 254135 - DNA, 553 bp, Homo sapiens
  misc_feature: GYAE6OF02GTJGM.13.25.C03.1.454.CMB.1.raw
  modified_base (310)..(310): a, c, t, g, unknown or other
  misc_feature (310)..(310): n is a, c, g, or t
tcagtcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaaccaacaccacccaggcaacggccccccagacgtcatcatttagngggggcaagtagggcggccgtcgagggtactttccactcgcttctctggctccaagtctggcaacgacggcctcctgacaatctctcggtctccgaggctaggaggacgaggctgccttattactgctgcctcatatgctaggtttcttcgtgttcggttcgttcgggcgggtacgggtacctaaggtcggtacccgtcgtaggtccacggcccaggcctccgccccgtcggtccacgttccg
